United States Patent 7,745,391 (HUMAN THROMBOSPONDIN POLYPEPTIDE) - sequence listing, part 55

SEQ ID NO: 169180 - DNA, 508 bp, Homo sapiens
gctctgggaggaaggaggcaaaattcctagttgacagtgagaggaaaagcagtactagacggaggttcaaggaagtctgttaatattggacaaggtttgaaatagccactgcagacaatgggctagttggtaaaggtccagctaggctgtcacccaggaatgtatagccaccccattctgtagttttgtgacatcctgcttcctagctgtctgacctagagcaacttcacttagcctacttaacttcactgcacctgaatttcctcatctataaaatgggcatgaataaaacaaagccattgaaataaatgagttaatccatgtgaagtgattactgaggacactgcctggaacatataagtgcttgatggaaatcaactctttagagttatttttatttttgattgacaaatcataattgtgtacacttatgggatataatatgatgttttgatatatgtatacagtgtggcatgattaaatcaagctaattaacatatccatcacc

SEQ ID NO: 169181 - DNA, 480 bp, Homo sapiens
ctcttccaaactttatttttacaaaataaaaatgactatttgggaaattagccttaatgatgaataaatcacttaatcaaacaagaaaattgctcttacatctcagaacatacaagaaggcaaattgtacctcccaactccaaatgaatgtgattgataaggggctctgtggaaaccaaaagtgaccctgtcaattccaaggtcagtgggataacttacaggacaatttattttagccttaaacactaacttcttcctctttgactttacacctatctaaattcagatggccttccttctttttctcagttctccttctgctcaaaatagcacatataaaagaaagtcacttctagaccatcaaatgaaggcaatctctggttaaaaaaaaacaaccaaacaaaaaccaagaaaggaaacagagatgtgtttatgtgtgtgtgtgtgtgtgtgtgtgtgtgtgcgtatatatttgcttca

SEQ ID NO: 169182 - DNA, 436 bp, Homo sapiens
ttagttgggagctgcatggaagattatctaaaattgaagaatagattttctaatcttgattggaataatatccacatgctgtggatctctctgtgaagaggcctgttttcagtttagacatcatggggaaaccactcttcccatcaaagtgagctcccccaaggatgaaatggacaccatgctatctacttgatattatgaagactgaatgaaataaaaagaatccagcaaagtgcctgaaaaaatgtaggccgtccatattccaaactgggaaaaaaatgcttaatgcaaagattaccacgtcacgtataaaaacaaaatactggaagcaacctaaatgtccacagtgagagaatgattttcatattatgcctctgttgaaattggtagcaatataataaatagtcattatgaaaagcatggagcaccgtaggaa

SEQ ID NO: 169183 - DNA, 388 bp, Homo sapiens
aacagtaatctaaagagtaggaatgagatccttggcctgtaagaaagcacttataaatttgcaagaaaagtgagatcaagatttgaaaacagacaactttgggaatgaaaagagatggatttttttaaaattaggattaaaaagcatcatcaacactaacagttaaaaactaacaaatgacctaaaacataagaagattttaaaagtgtgaccacttctaggccgggcgtggtggctcacacctgtaattccagcactttgggaggccgaggtgggcagatcacctgaggtcagaagttctagacaagcctggccaacatggcaaaaccccatctctactaaaaacacaaaattagccaggcatggtggcatgcccctgtaatcccag

SEQ ID NO: 169184 - DNA, 438 bp, Homo sapiens
cactgtgagccgccgcgaccctccttgactcgccgtgacccatcgtgatccgatgtgatccttcttaacccgccgtgacccgctgtcacccacagtcacccaacgtgattcgccgtaactctggtgttgtttgctgcttgctgcccgagcctgggcgtacccatgggcgcgggtgacagtgcaagtgcttgggacgacaacccgggctcctcatcgcggccggaatccaagaggctgcggcgcgaggtctgggtattcgggggcggaaccctgggagggaaggggagcaaagggagacgccgcagcgtaacgccgcctggccccagcgccggcgaggctccttccgacgccgcgggcatcccgcgcggcgctgccggctggccctcctctcgtgtccttccgccgtcccaagcagggcctgggccagcgccccgcgcg

SEQ ID NO: 169185 - DNA, 144 bp, Homo sapiens
cttgcattaacaggttggtctgctaatttctatgtagtttgagaatcagctcttctcaaagctttgctcagttcatgttttagacaacatataattgtggcttggaaagaagtcactgaataatgtcctttccttttcactttg

SEQ ID NO: 169186 - DNA, 483 bp, Homo sapiens
ctggggtgaagtgattctccatggcctgttcaagtgctgccattacattacaggtatgagtcaccatgcccagctaattttatttttaaaaagagaaaacaacttcccataacttccacagttcagtgcattagataccaacacctgcgtgtctgtcttaacctgcgagctctgtcactcctcccactgctgttacagagagagaatgggacgggtatgagaaaaatggctcagaccctagacagagttctattttgtaaaccagcccttcatgaaaatttttttattctttgatcacattataatataaagaatattattaaaggttttcttgaataatggtgaatgtcaataatatacagcatttgagcttgattttgaaaccttaaaaaactcattaaatggcactgcatcactgtatcttttagcctttttggaggaattagatacttaaatgtctaaatgaatctgccctttatatta

SEQ ID NO: 169187 - DNA, 338 bp, Homo sapiens
tgatagtaagcccaagtttacagctttccattgtttttactgtcatttttttccaatagtttgttttactttttaaatatttttatctcaatgttattttagtaaatagtactacgttatggaagtctattttatgcactgctcattctctatagagttccttattgcaagatttattacgtgttttttggtggtctagttttgtgatcaattttataaatatggcttacctcctcaacatagtatatagtctatgactgtaaagttaaaaaataattatctgtcttaaaaattttaattatagtattgaaataatctgtattcgtatcattaaaata

SEQ ID NO: 169188 - DNA, 458 bp, Homo sapiens
taaataacatgggaaaatgggtatgttataatgaataagaaggcgtcagactaacactattaaacaaaaacatgcacagaaaaagcatcagtgtgttcacagtaagaatgtggccattttttccttcttcctatgttttgtattttccaaagtatgtgtgttacttttacatgagaatattctttaaaatttatttttaaacagcgtattcaaagggcacaagaatatcatatattcaaattttagagaataccccaaatccttagggaggcagctaccttgcagactggtccaaactttaagaatggaaaagactggggaggcgaagactggaaggcttcatactttaaaatgatggccctaagtcagctgtttataacttagcacataccattctcgaagaaaggatgttataaagagtggttatattcccagggtagcccatacagccaggtaaa

SEQ ID NO: 169189 - DNA, 354 bp, Homo sapiens
tgtcaaatcccgtcaggcccttacctcaaagccacagctgactgtgtttgttcagactccacagtgtggccttgtatgcaggttcttcccagcaccctcttctcacacagcttgtcctggggctctaggcattctacatcaacctccaaagaggccacgctctttcatacctccacacattttgcctatgcacatgctcgttttttccacctaccgacttgcttctggaaactcttctttgcatctctcctcttgcaaagcattttggcacaagcctcaagcctagcgagtgagtgtcgtgtactccaaggtgatgctgaccatgctggggacagttcatttctgtgccagtct

SEQ ID NO: 169190 - DNA, 540 bp, Homo sapiens
acagagaggagtagatgaagtctgtttggacatgatgccaatttttagtcttttctctttgccagtggttaatatttcctggatatttgatgagattcttagggaggagtcatcttaagacaactgcatttcttttggaagaagttttcatcagtcaaataagggaacttccaaagagagcccctccctgtgcttgggagatggggagaaacaagagaaagttaggaagtccttggttctgaggcagcttataaggccctccaatagcttcttttgttttgttttgttttgtttggtttggtttgagacagggtctccaccgtcacccaggctgaagtgcagtagtgcaatcactgcagcctagaactcccaggttcaagccatcctcacacctcagctttttgagtagttgggaccacaggcaccatgcctagctaatttttttttttttttttaatttgtagaaacgaggtcttcctgtgttgcccaggctactcttgggctcctgtgctcaagtcatcctcccaccactccagcctg

SEQ ID NO: 169191 - DNA, 338 bp, Homo sapiens
agcagcctgaatgaaatgataaaaatatacaattatgataaaataataaaaagaccattttggtagtgctatgcatacatataggtgcacctaatccaggctcatgaaacttagaggacttcccaaagaaagtgacattcaaaatggagagctgaagactaagtgttagtgattatgataatgatgttgaaaatatctttgcagagttctcaccatgtgccaggcactgagttaagccctctatgtgtatttcattataaaaccattaaagattattatcataattgtatatttttatcatttcattcaggctgctataaccaaagtgccattgaacc

SEQ ID NO: 169192 - DNA, 107 bp, Homo sapiens
tacatcctgcaactgttcacctctcctgccgcctcatccctctaaacttctcttcacaacctcatgtttccttcttgctttaccttcctgctcagcctggaccttac

SEQ ID NO: 169193 - DNA, 500 bp, Homo sapiens
caaccctggagaaaagtgcagaatggggaggagcataaattaccagcacacgattcatactccaaaactccactctgatgtctggctttcaagaccttccattttatggctcttcccaagctattctctaccaaccccgcagaagagggcagaatgcagaggagagtaaataaggggatgagaacgctgacgaatatagccattgtcccttcctcaagagcagtaataaagttaccttacaagctgtttaaccaagagcctggaggatgacaatacaaagagtagacacaagggggagccaatgggtccatcttaaaagtaactggagaccaggaaattgggcttttaagaactttaaattccacaaacaagccacaaaatgggaatgaatgaagtctaagagtaacaacagatgccatgaaggaaagcagcaaagagcaggagacactgagatttctgatttttaaattcagttctgaactgaattaaaaaaccaaaag

SEQ ID NO: 169194 - DNA, 421 bp, Homo sapiens
tttcaccgtgttagccaggatgggaccttgaagtattttagatgagaagggaagtagatgtatattggcagcagtatggatggtgataatttggatggtggcaagaacagggatgggctgatgagatcgctactgcagaggtccagtgagatgtggaggcagtgtggagggggatggtagaataatactggaggtgaaggtaaatgggtagactcgagaaatacttagacaagaggattacaggacttgactggggacggtaagggagaagggcgactcctaggttttcgtgttgcacaactagctagttaagcaactctggaggcagatcaggtttgtgcaggaagagcaggggttcagtttgggcatgttgggactgagataactttcagatactcaagagatacacgataagcaggtc

SEQ ID NO: 169195 - DNA, 525 bp, Homo sapiens
taacaaaggtgatctatgtttacattgcatataaatatcacacatgcttccatgaagccattcctttttcttccaaaagtgggttttcaggaaaaatggaaatcaagactctcatttatatgccaggtggtccaaactcatgatcaacaggtacagccagtagccccgtatgaaatgcttcatgtaaatatattttatagaaaataagactatatattaaggaatttatttaattaaagaaacactgtaataaatcgactatgtaacatatatcaattggaataaaaactcagattttttcctcgacttatagatcagaaaacaaataaccagttttttttaattagcattttattcacttcaaaattatgagaaaaaaatatgtatagtcggcctcttttatcacttggtcgtgtatacttttcatccttctatgagccacacaaattcaattccatgtacatacagattatgtaaaaccacctactacactcaattaacagaaggaaaataaatcatgaggtt

SEQ ID NO: 169196 - DNA, 326 bp, Homo sapiens
tgcccagaagaaggagctgccaaggatggagcctgggacacgtggtgacatttcctcagcagcagagcaggtcagggattcagagtgagtctggaagagcccagatctgctctgtggtttggctgccttccttgccatgggaagaagccatcaggtgtcctgtggatgcctttccggaagcctctgcatccttgcatcttcatagtggaggatctgcctttgaccccagctcagctttctcgtccacattgcctaggagggtacaatggagtggaccaacatctctccagcatctgccaggcgctgcctggccctggacattcgtt

SEQ ID NO: 169197 - DNA, 112 bp, Homo sapiens
catttgttaatactcatctttttcttcccccaaatcaccaaatcctaatgatgcctctcctaaagtacatcttgaattcatccatggccttcctgtatccgccccccaagtc

SEQ ID NO: 169198 - DNA, 343 bp, Homo sapiens
gcacacgcacacgtgcacaggcacatgcacacacacacatgcatgcacgcatccgtgcacacatgcacatgcacacacatacatgcacacacgtacatgcacacacatgcacacaggcacacacctgcacacaggcacacacatgcacacacacgtatgcacacaccatgcgtccacacatgcacacacacgtatgcacacaccatgcgtccgcacatgcacacacctacatgcacacacatacatgcacacacatacaggtacacacctgcacacaggcacatgcatccacacacatgcacatgcacacacatacatgcactcacacaggcacgcataaaca

SEQ ID NO: 169199 - DNA, 242 bp, Homo sapiens
gaaatgttcctgtcatgtcaagaatcacttctggtattccccataattactgttttgccattctctaactcaggttatcttcacttgcaagtctgttatcaattgagatagatgataggtatcaatcagaaatataattataaatgggctcattgagaatggagacaagaatgagtatttcatatttctaaggatgacacaggaggcataattattgttatgtccgttaagtaagaaaatcc

SEQ ID NO: 169200 - DNA, 196 bp, Homo sapiens
tgtttttgttcttctgggttcagccatccagcagagagctactgggctccaggctggtactagggagtgtctgcagagagacctgtggtgtgatccaccttcaggtctgtcagctgtggataccagcacctgttcttgaggaggtagcaggagagtgaaatggacactgtgaaggtccttgattttagttttgttt

SEQ ID NO: 169201 - DNA, 502 bp, Homo sapiens
ctgacctggattcttctcttctattaactgagaataatgatatttttggaacagggttcctggagactgaaagatataacgcatgaaaaaatcaagcactcatttggcatttatccttgctccccttccatttccttttctgagcagtgatttcaagtcctctggccaccctaaatctgaagatatgtctcacctcatcactgggcctttctagggaagagaatcccatgctttagttaatggaagaatgacagcattttagaacctttacaggccaactcggagaggcggtcatttcacagaaaccaagaaaagctgctacctcaaggcctgaaactcatctttggtgatgacctatggctactgcttcagggcagggcagttccatgccagacaaggtggtagaacctccacatgctacaggcactgtgataagatgcaagcggtgccatgggcacttttcatatacagtcttatgtaatcctctgtgatcctgaggcac

SEQ ID NO: 169202 - DNA, 423 bp, Homo sapiens
ttttccttatagaactgctacattgctaaataagcaatcattaaatgctttaatcaatttacccagctttgaatttcttgactagtatcattctgaggatgtatcttttttttcttttcatttctttagtattttgctctcaactttgttactactcaggtcactgattttcatgattaaataatgttctaacccatactgtgttataaatatatccatcaatattttgctttataacatcagtcctcatacaaaagtgggaaatttaagtacatgtatctgaaataaaaggcttaagaaacacatttcttctgtgtgtgaacaaggagaacgtacaaattaatatgccactcctctaccccatcttaatttcatcttcagcagctgactcagtctacttcctgcaggaacacttgattgtga

SEQ ID NO: 169203 - DNA, 603 bp, Homo sapiens
ggctggagatctgcatttgaaaataatgaaggatagggaagacttatttgaaattttcttcttggcagttcaaaatgtctagtccaaccactaattgaattaacagacaaaatgaaccccaaacagcagtattgctggtacaaaggaaggaagttatgaatacaaattgtggcctcatgatcagttgcagaaaccactcaacacacacataattatagataataaccaataatagagatactgagcatgttttcatttgcacaaaggatcatggcattttgttaggtgagagcatgtttggattgctactgttgtttagaaattaaagtatggacagaaggatatgtagagatgttaactggccaaaggagtggaatatgttagtgttggtgggtcatttttagcattgattccaaactccttatagaggatcttcctgtattgcagaagctggagagcttaaaaccacatttctgatttcctgaattctaaggtagtagattggatacacatcttatttctcttcctcttgaaatcctacacaaggtacaataaagagatttattttctaaaaaagatgtaatccctctggaactgggtgaa

SEQ ID NO: 169204 - DNA, 403 bp, Homo sapiens
attcactagaacttttacgtttgtaaaggatttttacatttgtaggaacattaaaaatcattaggaaacattagaaatcatctacttcaactgtgacatttaggctacagttatttgactaggttttttttttaaatttatgatataatgaactttaaaacgatattgttgggcaatgacacaccccctagaaataaataatgataacaatcttgtcagatcgtaaaatttgtttggatggtttctgcttctacaatctctgatttattcagtgcacagaccctcctttttcacaggtaaaaaaggatgggaaagatatggttgtcacttgcctgatggtgcctttctgaagtcagctgggttttccttttcttttctttctttctctctttaacttattttc

SEQ ID NO: 169205 - DNA, 316 bp, Homo sapiens
cccctacacagcatcggggcagccactgggagcaggtgtcactcagatgccaaaccccaaacccggggctgggtgggaacacgcaggtgcatttggctgtggcagtgtgagtgcattcctcatgcttagactaaaaggaaaccacgagccacacaatgactccagggaaaaagggagtttggaataaaccctccagcatgccatcggaagggccccgtgctcagccagggtccgctggggcccagggctcctctccaagctgccaaaggccatgtctcattggcttccagactcagaccccctgcccacgaccctc

SEQ ID NO: 169206 - DNA, 287 bp, Homo sapiens
ttccactagctacatttagactgatatattcaaattatattcaaatttttgttttacataaatgcattgccttggccaaactttgcttcatagggaatgaagtaagtacattgttctggtgccccttcacgctcatgaattacatgtaacacttagaataaaacattttatgtgctgtgaaaaatgcataggcaatagttaaaaatgtaaagataaaaaaggagtattaaatgtcttcagatctctttttacaggttaattttagcatttggtttaaaccaccaaaa

SEQ ID NO: 169207 - DNA, 708 bp, Homo sapiens
gcacaaggacttcatgggggacatgtgacttaccatcacatgtggaaaaagacttgtgaattttcctaaccactacctatgtggcccacagagtgacatgatgttccaaaaaacgaatacaacctgtatgcgatcgtagacacatacaccacaccccaaaacatgctacacaggatataattttcaaagtaggacaacaaactgcctactttattttaagttggcattttccaagtagttctgtgttcattactgcacaatagaggtataagtaaagcagggcatgtctaaaacaatgtggccatttgatgaagggcactcgaaaatgtatgattgagccaatcacagatactgaggaaacttgaggccaggattttgaggctgcagtgtgctacgattgtgcctgtgaatgaccactgcatttcagcgtgggaaacatggcaaaacctcatctcttaaaaaaaattaaattaaaaatgtattatggaaaaccatggtgcattgctgtcttcaataataaaggactagagcaaggatagaggcttagatttaaactttgtttgctccaacccttgaagatacatagaagcagaattcaatacaacataatttttagccatatttagagaatccaaaaatgaagcaggctcatttggaggcagtgagtcccttattactggaaatattcgagcaggaatttcagtagcc

SEQ ID NO: 169208 - DNA, 419 bp, Homo sapiens
cagcagtcccctcgtcctcaatttcactttccatggtttctcttatgcaaggtacggtataataagatatgttgagagagaccctacattcacataacttttattttagggtattgttataattgttctattttattattgttgttaatctcttactgtgcctaatttataaattaaactttatcacaggtatgtatgtatagaaaaaaacatagtatatttagagtggagtactattttggtggtttcagacaaccgctgggagtattagaatatatgccccatggaaaactggggacatgactgtataccacactaaccctcacaggttcacatttataagcatttttcatttgatttgctcctcatgtgcaaccaaggtatagagaaagcagatgggggaactaagaagaggcaga

SEQ ID NO: 169209 - DNA, 163 bp, Homo sapiens
agttggttttgactagttttgcctgacatcattaacaatcatgcaagtgtgagatcctggtgcgtctgaaagctattttctccacgtggaaggtaacttagacatttaataaaacctcacggtagtgggctttttcatttatttaactgtcccccacccctca

SEQ ID NO: 169210 - DNA, 300 bp, Homo sapiens
gggtggaagttcagcaggagggcacatgagaaatgcagctggtgcctaatcgccacgtttgaggccttcagctaacgcttcgctagaggaactaggattttctgattaactttgtagaagaagtgtcggaaatgcttttcaacacgtaggttgtgacattaacctcagcataaaaaacccctgtatgccttctgggtcagaaatcagaggggcttagcattctccaaatccccagtgatgacgactaaggtggattcaaaattaagacagataatttcctaaaacaaggtgctctcattc

SEQ ID NO: 169211 - DNA, 434 bp, Homo sapiens
gggccaagaaggtgctctattacttggacagcctcttcagtagccagctcctgtagtcttctgctcattgaggacaagggacctgtggagctgctggaggagtctgtgttccagtttccaagaaacaccacgcacagcccaagatgtgactggttgggatgggactgggtgcagggaggccaaggaggggcttcctgagggtgtagctccaggtagaaaccctgaaactctgtcttcccgagtatcagatactttaatccgtttgcagctgatgagcccttttaatggtatccaagctagctgcagggtgatggttctaataatgatgcatgttctgcaaataagagcttcatcattattttgaaattgttaatatgaaagcgttcaactggatttgaaatctactcacatcatcatgagaagttttaacaata

SEQ ID NO: 169212 - DNA, 357 bp, Homo sapiens
tcgggtgagaccagggagatcgaagccacagtaaatcacgatcacatccctctgctggacctgaacggtactgccgcctgcaagagccatctggtcgaccttagacatgacaaggcgagaaccatctggtcaaccttagacatggcactcttgtggctaagtccaactctagttgctgaaatacgtctcaaaaaaacaaaaacaatccaacagtaaatgttttacaaaaacaaaaaaataaacaatattaaagaacaatgtataaataagtgggagtgaaccaaggtaaaaggtaattaatatcaccattaagatctcctctctttctctttttctctccatttgtgatacccaggc

SEQ ID NO: 169213 - DNA, 359 bp, Homo sapiens
ccttgccagaaatgttatatcctagtctctgaaacctgtaaatgtattacatgataaggaagatgggatcttagatggaactaagattgctaattatcggccttaaaatgaagagattatctgggtggtcccaatgaaatcacaagggttcctaaatgaagaagagggaagcagaagaatcaaaagcagagagacgatgtcatgagaaagactcaaacaatcatcattgactttgaatataggaaaggaccatgagccaagaaatgtgggcagcctccagagctggaaaaggcaagaaaatggattttgtcttagagcctccagaaaaaaatgcagccttgcaaacaccttgattctag

SEQ ID NO: 169214 - DNA, 246 bp, Homo sapiens
cttacgaggccaagaagtcctgtgatctgctgtctgcaagctggagacccaggaaagccagtggtgtaattcactgtgagttcaaaggcctgagaaacccgggcttcaatgctgtaactctcagtctgaggctataggactgacaaggtgtgggatgggggtactgatgtaagtctgggagtctgaagacctgagaaacaggagctccagtccctgcgggcatgagaagatggatgtcagagctca

SEQ ID NO: 169215 - DNA, 360 bp, Homo sapiens
atgtagcgaagcaaatttggatttgtatgtgaaagtgacctagatgagaagtatggaaggagacggagacagcagcaagtttgctcctcccttggtttcagaggaaaatggtttttaagagctgggccagatgtttctcatagctacttaaggtggattccttttttctgtgtcttctgtttttaagtgtaatctggtttttgagcacttgcagaaaagctgcagaggccagggaatgacacagcagagaatggaggtgagagggaagacaactggtgatcttagttgctttgattttgaaatatgttgttcaggaatagcttttcttagtggtaaaataattgggaatttgtaggaaga

SEQ ID NO: 169216 - DNA, 294 bp, Homo sapiens
aagacgttaggcagtgggcccaggagatcagggtggtgttggtgtcactttctaactttagatctgcgcactcagcacgtatgtcccctcttaatgttttgtctgaaattctagcaggctatcaccaagtggtagtaatggcgcctgggacaaagaggcatgattactaaaggaagaaactatgtaccaattttatataccactttttgttctacattaataaataacaatggcattaatattcctgttttgtcttctgtgtgccaggcactgttctaaatgttttgcatttac

SEQ ID NO: 169217 - DNA, 268 bp, Homo sapiens
gatacccccaccagagggggcacgtggtatatggggagtatcttatgtctgttttaatttatagctgtgaacctaaaactgctataaaaactttaagccttcttttagaaattcaattaaaaggtttcaaaagatgttttaagtcatatttagtataagatggagaaaacaattgcctaagtcaaaaattactcccattattattaccatatccgttatttttcttcttttttttttttttttttgagataatgtctcactcttgtct

SEQ ID NO: 169218 - DNA, 557 bp, Homo sapiens
gagaatcatattttgatgcttccagatgagttttggaggaaagccatactgaaaatatttgtttgttagattaagattattaagtgataactctttctttattttaaatagttaactttttctgtaagggagcaacatatgttctttcttgggcccataatgcatggccctgaaagtcagggctacctgggttgtggttataactgccagggtctggtattattactagcttagtggtggtaccctcagcaagttacagtttctctgactttattttttcccatgctcacaatgagaaatttggatagatgaatctaattgcatgtctctttctagataggaaaaacttaactttttccccttagaccacgtataattgtgaaatggaatgcatagaaatataatcttctgttttatatatttcttgttgaactgactttaaaaataatttgattttgtttctcaaaaatcatatattccttttggcattgtcagaatatagtgaagaacaaacatgcctcaggtagtacagagctgtttgttgaagtgaaggcgtt

SEQ ID NO: 169219 - DNA, 427 bp, Homo sapiens
acatcatatggcaagagtgggaacaatagaggggcaggtgccacacacttttaaacaaccagatctcacaagaactcactaccctgagaatagcaccaagccaggagggatccacctcagtgttagtcagggttctctagagggacagaactaataggattgatgtatatatgaaggggagtttgttaatgagtattgactcacaccatcacaaggtgaaatcccactataggccgtctgtaagctgaagagcaaggaagccagtccgagtcctaaaacctcaaaagtaggttttagccacagggctgaaggcctgagagcccctggcaagtcactggttcaagtgacaagttcaagagtccaaaagctgaagaacttggagtttgatgtttgaaggcaggaagcatccagcacgggagaaagatga

SEQ ID NO: 169220 - DNA, 402 bp, Homo sapiens
atgggagaaaatacctgcaaactatacatccaacaagggtttaatatccagaagatacaagaaagtcgaaaacctcaacagaaaaaaaaatactccaatttcaaaatgggcaaataagctaaataggtatctctcaaaagaagacatacaggaagtttatattcagagcaacttgaatctatgctactggattgcaatcctcaatcttggcccaaataaactctgtatctacatttaaaaatgacgatgacaaaaaaaacatacaaatggctaacaggtatatgaaaaaaatgttcaacatcactaattagcaagaaaatacaaatcaaaatctcaatgagataccatctcatcccagaaaggctaattaactgatgactaattttttgtcatcaaaactac

SEQ ID NO: 169221 - DNA, 336 bp, Homo sapiens
agtagagatggggtttcaccgtgttagccaggatagtcttgatctcctgtatgtcttagtttttaacaaaaagtttaaaagtttaaaaaataaaaatttttaaaataattttttctatttaaaatagaatatagaataacgatataaagaaaaaatttgtacagctatacaatgtgttttaagctaagtgttattacaaaagaatccaaaagctttaaagcatttaaaagtttgtaaggttaaaaagccacagtaagctaaggttaatttattaatttattattaaaagaaagaacatttcaaaaataaatttagcatagcctaagtgtacagtct

SEQ ID NO: 169222 - DNA, 182 bp, Homo sapiens
aaagactttgctgaatacactacaattatcactagagaccgagacctcagaaggctaatagaataacagtaatagtaagaggtacattatccctagcaatatttaaaataagatttgaaagaattaaagtgattttcaataactactttaagccaaaacagccttcaaatctataaaaagat

SEQ ID NO: 169223 - DNA, 130 bp, Homo sapiens
ccaatgtactggatttttagttaattattagctcccacactggtcaacatgtcccttgagaacacaggctttttcatctctgtatttctaggaacttgcacaaactagcctggaccagcttcttaaacac

SEQ ID NO: 169224 - DNA, 560 bp, Homo sapiens
ggtcatcataccgctaagtgcgctctgggaactgttctctaaccctctccacccttaccctgccagttaattaacttacatggttccctccttttacctgttctaaaccacttaacacctcctcccaacactcacacactcatgttacattcatccatgtcttaaagcccacatttcagcgatgaatcgatagagtgtgataaagtaaagagaaatatggaagatgacttgatgatatctttcgttgagcacattaacatagaaagctttgtcttaacccctgttaggaataaatagaacaaacagatacgttttccatcgatgaaatcagcaattaagtggcagcttttattaagaggctactggttttctttgaaaggaataacattttatgaaggaaaaagtctctgaatgtttccagggcagagaagtttggccaggttttactgtggactattgcaggtgtagaagaagacgtttaggagaggccattttgaaaaagctttgcagatgtgttttgaatgatgcaggctgagaccctctcataatagtgagtacaa

SEQ ID NO: 169225 - DNA, 169 bp, Homo sapiens
cctcccaaaccccttctatcccatcaccctgcttcccctgtctgccccaagaccttggcctggcacggaaggctagcacctcaccctttcctttccaattcatctcctgttgctccccaatgttcgggccaaactgaccaatttccaaatacaatttcccagccgctca

SEQ ID NO: 169226 - DNA, 300 bp, Homo sapiens
aaaataactccactaggatttaaatttattattgttcaaaggattttcaaaatgctgttccctgaaaagagtgtgttgttaaatacatttagggaagttttggtgttttcaaccattttgaaacaattttgactcagtaacttataaataattatttgtacagaattttttacacaaatacaaatagttgctttttatttctagttataaatataacattaatacatgagaggaaaatggaaatatataaattacattatatgcaattaaaaaatagattatttacctaaacacaaaagc

SEQ ID NO: 169227 - DNA, 216 bp, Homo sapiens
attggtggagcaattcctacatattttgctgggtatgccaggaatttagggctgtgacttctctttgcccaggctatttctcagggttgatagcaatgagcatcttgtgggatggtggaatagttccattgaataaagaacaggcttgcttacttcttaccatgaaaacagtagatttccaatgtccaagggttcctttcttgtcagcagcctact

SEQ ID NO: 169228 - DNA, 174 bp, Homo sapiens
attcatttattgtcaacaaacgtcctgggagagcggctacagccggccgctgaacccagaagggactttctctaggctttcttggcaccctcccaattatcttccttctcttgcccgagggcagaccaacacagctacgaacatgggtgactgagggtcagaccccttcccgga

SEQ ID NO: 169229 - DNA, 565 bp, Homo sapiens
ctcatttcagatcttcccagagggattaaaacggatgaatcagcaaatccccctcaaactgttcctagggagctggttggctgtaagtcccacagaaagcatgatccttgcaggcaagagcccccacagctctggggatttttcagcagaaactgtcagagacagcctttgactcctggaatggttcccatgccagcttgaggcactgggggacattccattttctcttttgtagaccctcctccctctgtttttgggtccctgctcctggcttctgttgagtccagcttggctcttgaccctcctcgttcctgggcttggagccaccttaaggtaagagagaacccaaccaataaacatgtttggagtatcaacccaggcactatgttgggttctagagaccgcaagatgaaccagtcatgaagcccgccatccagaactctatggccacactggggagatgaagtgagtgcacatagaaaggaaaacagggaagcaggacctgatttaacgttgaataaatgacacaccactggagttcagaggaggggatgagggatttctt

SEQ ID NO: 169230 - DNA, 795 bp, Homo sapiens
gtcatttaaatcagaacaaccacttgaaattatatacatacaattcttgtgtggaatttaactccatgactgaatagcataaggaagaggttatttaaaagcaagaactactttttttggttggatttttttgttcaagtccagaaagaaatgttatatttgtgcctactaaattatccaaacctcagtgtttatatacttaaacaagtgccactttttagtaggtaattatataccatctgatttaggacttacctgaatgtatgtaccagaaagtgtcctgcctctggcataggggctgggggaggtctgtttctggagccactaccagcattcctgggcagtgactggccaaagggaagtcacttttttatggaaatagaaagtgacccaactcaaaactgccaagagctaacactgccaaagcccttctggctgccacctgtggtacttgtatgcctggatatttgttcttttatttgacctggagctaaaaatgtatttccctactggcaaaaatgttatactgatatacttaaataccttgagttaaatactcttgtgtagtctaagggccaaactccagcgtgtagcattatttccataggaaaatgcaaaccaagttccaagcccaggtctatgtctgactctcatagcaaagcactggagactgctgaagagtgtcaccatcagagaaaaggaagctttcagataagtttaggctattcaacttttctaaagagatggttggttcacctaaataacatgttaaaagcaaagtattaaattatatgc

SEQ ID NO: 169231 - DNA, 542 bp, Homo sapiens
tccccccaagggggctgcgatccccagccttctaggacacttaactgcagggcactccctgccagtaaggctttggggtctatgggaccacctgctagtggcttccagcagccatgggctcctctgttccgacctttcccgtgccctgcagttttctagggcgcactgaggctcgaccacggaaggtccgtgccactctcgcaggccgctcccgcacaagtgctaccggccggcggcgggacactttcttcctctgggccaaactcccgcctccgcgctcagagagacagggagctagcgggccggcacaagaggcggctctctttctcaccgagtcacgctcatgcagatgtcccccggagggtccaacccgccttcccctcgcctgccgggcaccctggcgctcgcgccgtcctcccgcgctcccgcttgccccgagctctggagcccgattctccccgaagccgctgatttgctcggcgctcagcgcctctcgggttacgcggcggctggcgcgagggtgatggctgcggtgagagcag

SEQ ID NO: 169232 - DNA, 115 bp, Homo sapiens
ctgctctcaaacacctgggctcaaacaatccacccacctcagcttcccaaagtgctgggattacagaactgagccatcacgccagcctctactgttccttttatgtttaaggata

SEQ ID NO: 169233 - DNA, 571 bp, Homo sapiens
tatttccccactagaatgagtccacaaggtcttaactctagagataataatcaacattgatgagcatccaaggaattctccagaaaactgctccccataatacctttaaataaacatggataaacagcaactcaaagtactattaaaaaaagaaaagaaataaacatggaaaaacaaaagttaaaacaaatgaaaaatcttatacaattctggtggatactagagccactttcatctactataaactctaccttaataagctaatacatccctcagagtaaaaatgtttactctgtggaaacattatttctgtggtagggtttcaaatcaagttgaaaaggttcccatactggaagccatccaactgacactggtgtcatttacagaaaatcatactttttaattatgtgatactgccccagtaaatctgctggggcaagacttgctctccaaggcaaaagggcatataaaattctctttcagagggacaaataatcttagagtttcctgactctcctgaaccagaactgttatgctctctaaaggcagaaattgaaaaaatattggtggg

SEQ ID NO: 169234 - DNA, 354 bp, Homo sapiens
cccatccaccgagcagtttctactttgaactggacacactggatggctgcattctgacatctgtggcctcacttagtggatggaagagcatgtgatttgcccagaagagacctagcaagggccaggctggtctcgatccttttcattccttgtatttcctcgtgctctggaaggaagaagcaacaggcaggcctagggagtgcaagtggcttgctcaaggcaataaattagatggtggtgaaggagaggctgaaacgcaggctctgactccagctacagggccctttgggaggatggaactcaaggtgctttacgctttcctcagtcttaccaggaggcttggcctctggaaca

SEQ ID NO: 169235 - DNA, 423 bp, Homo sapiens
gtgccgtagcttgtggcagggtttccttcctttttaaggccatgtgacattccagtcccaccttgctaaagcagtttacctggtcactggggtgaccctggagctcccctctggcctcactgcctgtgcttggtcatgttggctagctgtcctcccttctccacctctgagtctacaagggctgcactccacggaggtcccatgcgtcagccccgaccgcagcgcttggctctgctgctgtgtcccgtccccgtgaaggctcagcaggcactcactgggccttctcccctgctcactgctccgcactctgcaccccacccgcactgtgcgtcttcaccctgcctggcctgggccactgtcccttcctgctcagatcagtcaccagggtgcctcagcttgttccccacctccaccctggccccc

SEQ ID NO: 169236 - DNA, 190 bp, Homo sapiens
aaatcaccgttccagctgatgtcaccccagagagagttccaacacacattgtagattactcagaacattctattgataaggtaacaagtcgatggattcctctcataaatgaaagaacagacaaagacagcaggctgcctttaatattggtgtggaacaaatctgatctggtggaatatagtagtatagg

SEQ ID NO: 169237 - DNA, 542 bp, Homo sapiens
aagcagctgaatctttaggaggcccaggcaggaggatcgcttgaggccaggagttcgagaccaccctgggccacagagggagagcccccatctctacaaaagaaattttacaaatcagccgggcatgatggcgggcacctgtggtcccaactactggggaggctgaggtgggaggatcgcttgatagcccaggaagttgagggtgcagagatccctccactgaactccagcccgggtgacagagcagagcgagaccctgtctcaaaaagaaaaaaaaaaaaaaaaagcgtaactgagacccagaagtgaaataattaaccagtgtcacaaagtatgaatggttgagtcacaaattggatactgtttactttctttatgtgattcccatgtaaggaatattaaaaacagtagctacatgctgattgctctgagtcctggatgccatctatggtgaaaggtgcagtcacagaaagaaagaaaagaaaatacaatgctgtggctcttagatagacctgggttggaatcccagctttgctaattgt

SEQ ID NO: 169238 - DNA, 493 bp, Homo sapiens
ggttttttttttcatgttttcattacccttgtttttgattaattgaagcatatttactttacagtttctattattactattacccatagttgttggaagtctaattctgccacttattttatctgctgactctcacttatggtggtttccaactaatttgcctagttcttttttctttggtttttttttttcatgttttcattaccttgtttttgattaattgaagcatatttactttacagtttctattattactattacccatagttgttggaagtctaattctgccacttattttatctgctgactctcacttatggtggtttgtaacttctgattgtgagtttctgttcagtacgactttatctgtgggaatcatctgggaggggttggattcagggtgtgtccctctgcagtggttttacatttgcttctattactatcctgagagcacttttttttaaatggaaaattttaaacacgtcaaaaagtt

SEQ ID NO: 169239 - DNA, 361 bp, Homo sapiens
aacattttggaatgttctcagtccaaacaaaaccagcatacttctcattttttccaacctcatgactgaggcaggaggtaaatggaaaggaaaaaagcctacagttgcaaaatgtaaatttaaaagaaaaatcaatctggacagtcatataaaccaggtggcaggcaaaaattggactcatttatgaagaaatgcaaggcatcctgtaacaggcaacaattaaggaacagtaaaaagaccaaagaacttggaaaccaaaacaggttcaaatcttaagtccaccactcacaaaaatgtgggtgtctggataaacttcttagcttctctgagactcatggttcctcacctggaaaatggaggg

SEQ ID NO: 169240 - DNA, 349 bp, Homo sapiens
tgtggtggcgggcgcctataatcccaactactcaggaggctgaggcagaagaatcacttgaacccaggaggtggacgttgcagtgatctgagatcgcaccactgcactccagcctgggcgacagaggaagaccgtgtctccaaaaaaaaaaagaaagaaatttaggcgggaaaaactctcgggccgtccccaagtccgttggtcgaaccctgaccaccgccgccaaaccgttaagctagagggcggccccgatcccgagcctccgcccccagccgcgtggcaacccaggcgggaacggagcgatcccgcccattcgcgaaggaccactgagggacaaggctcacaccgg

SEQ ID NO: 169241 - DNA, 397 bp, Homo sapiens
gactaatgctgcatactaaagtacaatggtggtctttataaaaaaaattttctgcaattgagttgtgaactgacctagcaactttattcagaaaatggcatttttacatgaaagaagtgataaacaaactacaataattcagacatgggtatttgaaatatttgcaaaaataaatagagtgcgcctgtcatttttagaagaacaattgacattatttgttgccaaggataaaatttaagcttctaagtaaaaattagaaatttgaggccgggcgcggtggctcacgcctgtaatcccagcactttgggaggccgaggcgggcagatcacaaggtcaggagatcgagaccaccctggctaacacagtgaaatcccgtctctactaaaaaaaatacaaa

SEQ ID NO: 169242 - DNA, 672 bp, Homo sapiens
  misc_feature (1)..(1): n is a, c, g, or t
  misc_feature (3)..(3): n is a, c, g, or t
ngngtgaaactccgtctcaaaaaaagaaaaacaacaacaacaaaaaaaccccacgatgatatgaagtctttattcatagacaacttttgatggggatgggcagtatcttattacaaccccatacatccacttaaattggcacaaggtttatctgtaagttttacaccttaaaatgtatttaagttgaaaactaaactgatggggagaataaatcaacattatttaaattcaagtcctaagtaaaacagagtactcaaaattggcactagtataaaattttctttaaaatttcattaattagaagagatcaaacagtcatttcagatatgtctattagttttactctgatcacactctttcaagtattatggtgatcaattttccccacaaacttgcaagggagaaacaactgacctccccacaaaatctaacttcaattaactatctaaggatgatattcagtgtttctcacattaaaggagttcagaatcatgctctggctgtaacaggaatgagcacagagcacttcatgttagctgtttggtatcactgtccaaatccacggcctctttctgcataccttatgacagtgccatgtgtacatccttaatcaaatactgttaatttttaacgcatgagttttttatttgaggatcaaacaagaattatgtt

SEQ ID NO: 169243 - DNA, 178 bp, Homo sapiens
gcaactatatgtagatagatatagaggcagatatagatatacatagatatacatttatgtatctctatctcttacctatatctatctatatatttggataagaaaagttttcctcctggcccccaagtaatcttgtgtactgcaaacatcactgaaatcagcaggtgcatgttccaag

SEQ ID NO: 169244 - DNA, 499 bp, Homo sapiens
tatgtatatatgtatctgtgtgtgtatatgtctgtgtgtgtgtgtgtaatatatttacatatattcttctctcccccctcttaggctcttccatgctttccatgagtttcttatataatgagaagcagcatataatacatattatttctaaaaataactgaaataattaaaagccttctgctggcaaatctacaagacaatgacagtaaacactgtccaaggtgaggggcagcagtgaggggtaaccacagtcactgtctctgctgcccttcaccttcacctttttgaccttccagtggacaccgctagtagcacttctcaaactggaatcctctgcatcttttcagaacgtccaggactggcattgctggtacccactcctcctctttcactcttgtcctcccttagaggcaaacctgcaaatcacctctcatgaataatcccctcatccatgatgtgaagtacacctactcttcccaatgcccaccacctactaatg

SEQ ID NO: 169245 - DNA, 362 bp, Homo sapiens
tcattgcatacttggaacttgatgcctcgtgtagtcattggccctggggcaggactgatggctgaccctgggagaaagctccggaggctctgtcttcagccctagccctgcctcatgggagtgaatccctgacacctataaaatcactttccttctctataatcttatcattcacgtatatagagtcttacaataagaaaatgagcctgctgagctaaaataaggcccttgaaccccaacccataggagaaggaggaaaactacgctagcatccagaacactgtggcccatgatgctttaatgccagcctctgcagccaagcaaccccaggaaataaaaaatcccaagattatataccaaag

SEQ ID NO: 169246 - DNA, 324 bp, Homo sapiens
atagaaaaactagttccctcaaacgaaacttttagaaagagccttgtcttaggattaggttaagtttttctggtgacaggaaacccaaaaaatctatagctgaagttagatagagctttactcctctaccacatgaaagaaatctgggagtaggcagtactaaccgatattgcagttccatgttaattggggaccccggttgatgttactgtggtgttctaatgttgttttctttccttttttcttttatgcttattaattgaaattcttctgtaaaaaagtgctgatctcttcttcctcatttatttatttaatcttttaaac

SEQ ID NO: 169247 - DNA, 367 bp, Homo sapiens
ctgggacgttccaggtaaagtgaaatatatgaagaccctggttataaatcacagaaaaatcttagttaataatttaacatagactgtaagatatagtatttcactctttaaaaatgtcttaagcatgcactaaatgttttatggtgtgctagttctttgttagtgtgtacaaacatgaatctaatacacaggtctcagcttacaaataggagataaaagataggcatgtgcagcatggtttggctctttaagatgctgcttctggcccggtaagatgtatcaaggcagccagaaaaacttataattctcagaaccaagcgttcaatgctcttttgtcacttcctggttttgctcccaccttcctctt

SEQ ID NO: 169248 - DNA, 291 bp, Homo sapiens
attcccaggtgactctagagatcccggtagccgggcggccttccttccttccagagggagcagctcccgtcaaggctgccagtggcctcatccgtctcccttctcatgcggcccgaccagcccccagacactcccccctcttattgtctgggatacagctcgcccctcctctgctcctgcctcctggcacctctgtgctggctctggcttctctatcctcgccctccttccgggtcattgttcccaaaagtgggttgtaacaaatcacaaacgcagcggcttacaaatcac

SEQ ID NO: 169249 - DNA, 475 bp, Homo sapiens
catgcccaccctgaagcgagctgcccgctcagccccagctcccgcgtagactccttgcttcagccctggcttcacccagcaaaccctcctgagaggagcaggtgcacattgcactgtttgtcctgctatttgctcctcactgccttacgtcatacacacacccgtgcatttgcctttttattgattataccttcttaagacatggagaaggagaatgaagacacatgttatcttcacccagagagaagcaaaacagttatttcctactttctaagccctttccaatcactgctgtctcaaagggaatcatcaccctgagtctgctgtttttaattccataattttctttacatttttactacgtatgtttgtgtccttaagcactatatggtatttccttccatgcatttaaacttacaaaatttaaagttttaaacttatagaagatacaataaattcactcatttacaatgga

SEQ ID NO: 169250 - DNA, 153 bp, Homo sapiens
tctggggatgccaactgccacattgtgtggacattcaagcactatggagggggtctacagagcgaggaagtagatccactctaaaagtggattctcccagtctcagttgagccttcaggtaactgataactgtaactctggctgacatcttta

SEQ ID NO: 169251 - DNA, 360 bp, Homo sapiens
cccgactctcccctgcgaggaaagcagagaggaggggtgtgcgtggacgcactcgttcaagcccttccttgtcttcttgggccaatgacatacatttttcagatggcaagccaggaggaggaggtctgtggttcgtgaccctataatggaggggaggtagttggcccccagggacagaggagtcaaggtagcttgctggaaaactctgggtctttgtaatcatcatttcgaatttcagcatctctgcttaccaggaggccggccctgggcttgtcttgtcaccacactaagccatagcttgctttttttttttttttttctgagacggagtctcgctctgtcgcccaggctagtgtgcag

SEQ ID NO: 169252 - DNA, 178 bp, Homo sapiens
ggatctggtataaagctcccaggaattgcaaagctgttcttagcacatcagctcggtgggcctgggcggatggaggcagatgcacacagcaacaccaggagcaggggaaagtctgccttttaaggttcatgttccccagcaggccctttcccattctaaacacgtttcccaccattct

SEQ ID NO: 169253 - DNA, 144 bp, Homo sapiens
gcaaccaattgatctcttaacgtaagaactctagacagaggcaaaagcaaagcaaaaataacttgtagagttcaaaagagttgatctcacattgaaatttacaaatggagttatttatctaataaggatcacatctggtaggct

SEQ ID NO: 169254 - DNA, 481 bp, Homo sapiens
ttgtactggttactgctctagaactagtgaccagagaggtcaccattcctggtacctcaggtgaaacagttagaacagctgagctggcttctaccccatgactggtggccattgaaggtgtggtctctggctcactagaagaaagagttagaattggaatagttgtactggtcactgccctggaactagtgaccagaggggtcaccactcctgataccccaggtgaaacagttggagttggaacagctgagctggcttctgccccatgactggtggccattgaaggtgtggtttctagttcaccaggagaaagaatcagagttggaatacttgtactgtttactccactagaactagtgaccagagaggtcaccactcctggtacctcaggtgaaacagttggaacagttgagctggcttctgccccatgactggtggccattgaaggtgtggtctctggttcaccaggagaaagagtcag

SEQ ID NO: 169255 - DNA, 425 bp, Homo sapiens
gttcaaagttaagagtttcataaaatccactgttttccttttccagttattcaagttaaaaaactgatttggtgttatcccagcagattttagaagctgtaggccaaaaaatgatctaaaataactaaaatataatttatttattatttgaatgagacagcatgatttagtggaaagaacactagactggaagatagggttttagaagataagatttctaggaatagctactaacagtgaccatggaaaaaatctctctggtatctttggtgttaaaaggtaaaccaggtaatatttactgattctttcactaggtacttatggagcattaactatctgtcagcactatgctaggtataggggacacaagtccacgtaaaacagacatggtccttaccttcatgctaacaatctagtgatgaaga

SEQ ID NO: 169256 - DNA, 86 bp, Homo sapiens
atttcagccccacttagccaagacctcaagtataaataattctgataattatggagaaatcaactgctattttatactgattctga

SEQ ID NO: 169257 - DNA, 318 bp, Homo sapiens
ccgccacctccaccgcggcttatcccctggctggcggcgttggcggggcgggggacagtagttgtagacgcccgcccctgcctcagagaaggataccacattgaatgaacaaaggactgaactttgtttacagataccctttataaaagatgtctgtggagtagtgttacagttcaaataacaaaggattttgcattatgagatgagtgagagttgagagtttggacacaaattgatttttgatctctgaattgtggggtttagctcaccacatatatgtgtagtgtcactatattgaaaatacatactgcagaaact

SEQ ID NO: 169258 - DNA, 250 bp, Homo sapiens
tggggagcactgctgtgtcatggagacccaggcctcagttctggcctggttgttgagagacctgagttctagatctactctgccaggcacttgtttgactttgtgaccctgaaaagtcaccctcttgttcttggtgtgatcatctacaaaagagaagacagactaatgaacactgctgctaataagtcctgctctgaacaacatactccaacagtctcacttctgttcccccaaaagtcctgcaactggg

SEQ ID NO: 169259 - DNA, 734 bp, Homo sapiens
gattaggcatgcatcaattcagagctccatgctgctagctcctgtattctgctgagctcccagggaggaaataggaaaagggaggagaactcacctgtccaattacaacctactctgcagtacaaagtactgcaaattccacacagtggatctctgtgattgaaggagcacttgtaaaatctgagacatcctagtttttgatttggtatccaaaacaaatctgaacttttaattaaatattgttctttttccttcttgtttccaaatgaatagttacaccagcaaacttattggctgaaaagttgtttcctacatttgcactttgaagtgcatcagacagtggtgtgtttggatgtgggtcttgttgagtttggttagtgagttattattggttgggattgcagtggtcctgccaatggaagagaagtaggtgtgccgagtactgtcatgttcacctccgcctttcacagaggcatatttagccctcagttggtaagtgaactttttgacaaaggtttaagaggtcgtagagtctgtgtaaaagacaaaagtccaaaagtgaagcagaaggaatccagcttcttatttatgtctggcatgggaagcttctggatttgatagtgggtgcaccgaaatttgcatcccaagtcatagcctttgctctgccctaccttctggtatgttgtttttcaagttacttaacctctcagggctgcaacttacttatttgaaaa

SEQ ID NO: 169260 - DNA, 237 bp, Homo sapiens
agaagtttttagtctttcagtgcagttatttggaagaacaaatatttttaaatggacaatggacggtacaataagttacttgaaataagttacttgtttcagataaatttcaattagatttgaaataaacattttgtcttttaagttaatgaaataaaatttgaaactgaaaaaaacaataggtaaacaaaattggcaaacctttagccatattaagaaaaaaagagagaaggccca

SEQ ID NO: 169261 - DNA, 585 bp, Homo sapiens
cagtgttggccacatttcaatcttgaagcaaagtgatagtgtatgggtgtcactttcctaaaatgtatttctgtgatgtacacttcccactctgcccctgctatggccacctgagtctcagcatcactgaggcttgttaggctcaggtcagtagagcactagggagtgctgggcattgtagacaggcttcttgtagcgtcaccagattccttccttagacctgggaacagatttatctttcctgtctcactaaggaactggggagattatcgagaactaacctttattggcacattggagtatacagtgtaaagcactctcacagacattgaaagcctgtgatttagtccttgattcagactgaatcattgcaagtccattgattcaacagtgagcagtaaggaaggcagggctgagcagggcaggcagctggtgatggggagagctggacatgaatgacttgacattcagtgctgttttcacacaactggactgcagcttatcatatttattatctgcctttctgtctgaagcaagcacacgatcttttcatatttttgaaatggtcgcctatccgtaatcagc

SEQ ID NO: 169262 - DNA, 303 bp, Homo sapiens
gtggaatctcacggtacaatgaagtgaaatgaaattttaaaaattaaggaatatgatagcttcagaaggcaggggattatatacgaaaatgaattcatgacttttaaagaagtattttaaagacatgagatcccagagaaagaaatcataaaagagatccttgatggttaagaaaaaaatagaaccattaggttttctgtgtgtgtgttttttttaattcttatttgaagaataaggatcagaaatgatctggtgcttttggaccagaataagtgagggaggatgtcatgaatgggaaaggat

SEQ ID NO: 169263 - DNA, 119 bp, Homo sapiens
ttattagtcttctggtttaaacatttatatagtgtaaatgcaaaataaaaatgattgtatcaaattatggtttttatttggatgctttgcaagaaaatacttaaatgtgagtcatacat

SEQ ID NO: 169264 - DNA, 323 bp, Homo sapiens
tgggccaggatggtagatgtcacagctggaataaagaacatcccccaactcaccccagaatcagagacttgggttgtgccagtgacaaccatgtctggttctgccctttcctcccctgcctccctcagatgaaggtgatgcaggtgccttccctcttccccagatttgctgtgatcctggtcaagttcatcaggcctggagagtggttggaactcctcaggagatagacccccaaaacacaggagcagggctgtgttcttttgtcagcccttggggataggcagggactgtgttgtagtgccctaacactggctgggtgcttt

SEQ ID NO: 169265 - DNA, 224 bp, Homo sapiens
tggaaaggctccataagaaaaataatattgccagatacttccttgaacttcccactgtgtcagatagtgttacgaaactcatctgaaatccacattgcctagatttctagctctgcaactggaagggcctactaacacaaaccacagaaacattattaagtaaacagcagcaaacaagctatgttcaagttctcttactaataaaagcaatacagtttggtcag

SEQ ID NO: 169266 - DNA, 265 bp, Homo sapiens
gttccatatccccccaagttatgcaaaatgatttgcgtaataattttgtagatgatttttgtcttgcacttgtattgattaaaggactatattttttattagtggttctcaaactttggttggtatcagaattaccaacttggggaacttagtataaatacataggcccaggctctttgagtctgggccactgttcagtaacatcccagatgattctgatactaaaattgggactactgtttcttttgctcagctaacaccagta

SEQ ID NO: 169267 - DNA, 432 bp, Homo sapiens
agaagggttcagaaatactttgagcaatgccaccagtactgaagtaaatggatcagaccccaagatcctactctgaaaacagtgcttatttggatgtataagctttggtttacttccaaaaataccatagggaccacttaaccctagggtgtaagaataacaacagcatcaacagcagcagcaatagctagcctatgttgtatttctatgttatacatcagtaggataaatgccttatctatattaatgatgtatattaatatatgaattcatttattcttccttaggacccaatgcggtagatgtcatgtatttttattttgcagctatagagatgaagtcacaaagattaagaaaacttgccaaggtcaaaaactgtgactatcagtgctagaatttttgcccagaccagtaaatgttaatggaattact

SEQ ID NO: 169268 - DNA, 661 bp, Homo sapiens
gggctctcccctctctctgatgatgtcacccctcacctgactggttaccttttttagaaaggagggaggttagctcctgggcgtgggcattcccaggacccagaacactgctgagggggtgccacctgttggcagctcccactctagtcctgctatctcagcctgctgtttgttttctctggagtttttgcaccagccagagggcagccatctttgctgttggaactcttcttatcagaccacatttcatgtctgtggccgctcggcatctatagggataagtagtgaagggactgccatggcttgcagaatcgcaggtgtcttcttcgaccccaggtgcttcatacggttcttgctttgtgtgttctgtgatttggctgcttgggactgcttctgagagtccccatttcagtcaggctctcccagcaggagagacctgtccaagtgtgcacctactctgccaccctagcatccagtgaagccacagcagacaagagcccacagagcaaatgtctacatggactgaaactgcacactcctgctgtgccagcactcagcggccttgctgacctagggtgcagctaaaagctcattctccagagcctgagttctttgtgctttcctgcctaccatgtcattccacccatagagggaggtgata

SEQ ID NO: 169269 - DNA, 494 bp, Homo sapiens
ccaatggcagtcggcgccattggggccggcccaatggcagccatctttgctgttggaactcttcttatcagaccacatttcatgtctgtggccgctcggcatctatagggataagtagtgaagggactgccatggcttgcagaatcgcaggtgtcttcttcgaccccaggtgcttcatacggttcttgctttgtgtgttctgtgatttggctgcttgggactgcttctgagagtccccatttcagtcaggctctcccagcaggagagacctgtccaagtgtgcacctactctgccaccctagcatccagtgaagccacagcagacaagagcccacagagcaaatgtctacatggactgaaactgcacactcctgctgtgccagcactcagcggccttgctgacctagggtgcagctaaaagctcattctccagagcctgagttctttgtgctttcctgcctaccatgtcattccacccatagagggaggtgata

SEQ ID NO: 169270 - DNA, 440 bp, Homo sapiens
ttgtagattcacttgcaattgtaagacataatacccagagagcctcgtgcccttcatgcaatttcccccaatggtaacagcttgcaaaactgtagtacaatctcacaaccaggaaattgcctttgataccatccactgaacttatccaggttctaccagttttacatgtaattgtgcgtgtgtgtttagttccatacaatttactcagtactctaaaaatagactcttcatcttacaatggttttaaatttacagaaaaattgttaagacagtaggatttgcatatatcctgtaccatttcccccttttattaacatcttgcactggtatagtatatttgttaccgttaatgaactgaaattaatacattgtaattaacttaagtccatactttagttagatctccttaatttttaccaatttcctttttcttttctttt

SEQ ID NO: 169271 - DNA, 387 bp, Homo sapiens
gtgtcacctgtcccagggcagggaccaaccctgtgcagtaggaaaaggggctcatcatttcctcttctgaatccctctatcattaccctttttgctccaacctaatgatatcaggaactgaacttgattaacagcatttcacagcagaaaaatataatagtcacacaaaggagcccactgaatgtggccatctttttcttggccacttcatcctgcataggcaaagcataacatctctctcccaccccctaccaatgagcagtccaccagtctgtcagggattcagcatacttggtggtatccaacactgtctacagtgtgagagcaccaggtctagagcctcgtgaacatatctacctgttaactgatgagacatacacaccacag

SEQ ID NO: 169272 - DNA, 129 bp, Homo sapiens
ctctagggtgctgaataaatttgaaaggcagtctaagccacagagattgaagctgggctcaagtactacaaggactggtggtgtgctaggctcagaacagtggagctggggtgcattctagccaatgag

SEQ ID NO: 169273 - DNA, 573 bp, Homo sapiens
tgagacagagagaaggtataccatctgaactgaaaaagtaacccaaaatgtttctgagttaaatttgcaacagctaagtctttaagaagttagaacaagagtaatcacacaattttggtgacttctaacaaataaattcttgctcatgttcataaggaaaagacagtatctcagcatcacattcaagtttctcttagcctacaagtacagcctatctggagccttttccagaacactatttctgatagaggtaatcaaaacttggattgtccttttcaaactaggcctctgcaaagaatttgcagagcaggaaagttagcattaacttacaattttaccttagatgtcaaatatttagtctgaatggactttttacctctgacctcttcagattttaaagaagatgtcatcatattggttcgtgagatgctggtagctccctgctgagatgaagacaggccttcatccctagagctagaactgcaagttctcccttaagtcctataaaattcatttagagccatctttcctgacatctgtacataaagcagtgtaaaacattacaatataaat

SEQ ID NO: 169274 - DNA, 547 bp, Homo sapiens
tcttattttgagactaattgaagatactgaggcccagtaattgaatcatatagattgctaaaagaagttctgagaagaaatgaaatacaaaagcttggtttctaaggctgaatatcatgagaaactatcatgttatcctgtgtgagtgagctccacgaggccaggttaaagaaattatgaaaactgaaagcctgtctttatccaagaaccaacactgcctggacaaataacttatgaatacatcctattctggaggtatcatcaatgactttgcctctgtagcactcttaccattatttggacatttccagaaatcaagatccacttcagtttgtgaagatgagctgtgcttagacataggcttaaaaagaaaagcaggctgaggcagaaggatcgcttgagcccaacagttcaaggctgcagtaagctaagaaggtgccactacactcctgtctgggcaacagagcaagaccccatctctaaaaaaataagataaaataaaaatttatatttataatgccttaaaattaaaaagttataaagtcct

SEQ ID NO: 169275 - DNA, 154 bp, Homo sapiens
aaaaaggagactacaatactgcttatactatcttactgttacattatcttcagtgggagttctagtgtttttcctagtacatagaagatgccagaggatagcaactggcttctagattgatctagtaatgttattaagacttacagggtgatct

SEQ ID NO: 169276 - DNA, 344 bp, Homo sapiens
cttctagcctccagaactgtgggaaaataaatctctgtcatttgaagccacccagactgtcgtactttgtagcgacagccctaggaaactgataaaacctgtaaaaagatgagggaaggcgcacaaaatgaaagtcccacgcaagacacacaaagcctgggccaccttgatggggagctggaggaagagtgccaccgtgccactcagtcacaagaggtgactgccccaggaaggccatgacctaggctaaactggctccctgcagaggcatgcagtaaggcagtcttcccttcttacaggagatctgggtagctcatctccatgtctacacagcaagccgagcg

SEQ ID NO: 169277 - DNA, 374 bp, Homo sapiens
tgagatggagtcactctgttgcccaggctggagtggcacaatcccggctcactgcaacctccgcctcccaggttcaagtgattctcctgccttagcctcctaagtagctgggattataggcatccgccaccaggccctgctaattttgtattttcagtagagacagggctttaccatcttagctaggctgctcttgaactcctgacctcaggtaatccacccacctcagcctcccaaagcgctgggattacaggcatgagccactgcacccggcacataccgcattgttgattcaaagttttcataaagtctctgggcaattttaacatttaattaaattatagattgtatgtgctcacatcttgataaagctg

SEQ ID NO: 169278 - DNA, 369 bp, Homo sapiens
tcgcactccagcttgggcaacaagagcaaaactccgtctcaaaaaaaaggaaaaaagaattctaacatgtttgagattgactgcaattcctagcatattacaagtgttagtaaatagtagccattaatattatgagcttatcatcaccttcagccagcattctaattttacagtatagaatccagtacataggaggcactcagatagacgggatgccccaaaattgggagacggacaaacttattttgaaatagtctttttttgacatttccaaagaatatactcaatgtttttctgcaaccctttgccttctttttaggtgaaggacctctacatttaaagcagtgggttcaactgctaacctgaaaa

SEQ ID NO: 169279 - DNA, 409 bp, Homo sapiens
accaaggcaatacgagctacacgcaaacacactaacacacgatcccccctgggatttccaaatacccactgagtatcaggtacacagtaataggcagccagcttccagaagccctttatttatagatatgtgtgtgtgtgtgtgtgtgtgtgtatgtgtgtgtgtgtgtgtgtgtgcgtgtgcacatacaatctaggggaacagtcaatagcgtatccttcatatatacactggcgggactcaccacccagtgtgcctgggactgacgaagattccccggatgtggaatgcttggcactaaaaccggaaaactccctggcaaacggtgaactcgtcatcctcttaatacaattataacatacctaattaggctttacaatcaccccaagggctatttattctttccccc

SEQ ID NO: 169280 - DNA, 678 bp, Homo sapiens
tcaagtgatctgcccatcttggcctcccaaagtgctagggttacaggcgtgagccactgtgcccagccactccattctctcttaaacccattccagtcaagcctgtaagcctactagcctgccaaactccatcaaggtcaaggatgcccaccatgttgctagataagtcagttctcaatccccatcttacttccattagcagcagtctcacctttcatatcagagaataaataaatcaagacagagatataaagaaattatctaaagttacagaagtaaaacaaataaaatgagactgaatgtcagtcaaaggagtactgtcttcctgaaggcttctgtatatttatcttactcctgtgtgattttaaaaaaacaatttaagaacaggttttaagacataaacaatagagtatcatcttatgcagcagttgggttctaaagtctaagcataaagcaaaaaatcaagttttgacaaaaccactttgaaaatcccttatattgtacataatgtgtggcattgtgctatctttcaataagttcaacacagccagtctttcccctctaacattagcccatacagcactttgtcaattaaacacagatgattcaatttagggaccgtcctgtacaaagactgcatgttgtaactttaagcactagattgatattctgttgatc

SEQ ID NO: 169281 - DNA, 330 bp, Homo sapiens
tgctgggatcgcagacgtgagacaaggtggccagcccactttgctcatttttaatgcatgggaagctggcggagatttattttcttcttcttcccccaggaatatgttctcatacatacatactatctaggtccctgtaattccccacttccctaactatccatgttcatgcatatttacatttaaaaaaaaataggatcatactggctatgttgattctgtgactttatctttttcactaaataatatgactcaggaacctttcaaggtcaggaatgtggatccacctcattcatctaaaatctactcattctcccacatgaatgcata

SEQ ID NO: 169282 - DNA, 575 bp, Homo sapiens
ttcccttgcagctcagagcagccacctgagtagctaaactctgcccagcaggatgtggaaattagtgatgtgagcaacttctggatcacacacccttcccacaggccagtggagtaacaaagcagaagaaacctgggccccggttcctcatggaaaagagctgcctacccaccccacacctaccacttcatacttttatgcaaagatagagataactctatcttatttaacccaatgataagctatgttaagttaaaccaacactctcactaaaacaagccccagttttaggctgccatcctgctccaggtgccatagatacagcagagatgtacagagatggccaagctctctgcctccagcagctcacactggaattggcgacagacaacatacaaagaaacaagtaacagactgtgtttttccgaaggaaataagccgggtgaagggttggagatgaatctaggcatggccagccacgccatctcaaggaagggagggctcagacctaaaggcggacgggccatcggccttgggaagagcatttcaggcagagggagctgcaagctcaaccg

SEQ ID NO: 169283 - DNA, 596 bp, Homo sapiens
gagaaaagaacaaaagggactcatatttgagctcctgctgtatgttgctgtgttgggaatatttcccttttccttacttatttcttcttcccagtaaccctatgggattaacctcatatgagataatatcccagataaggaaattagagctcagggaagagattcaccaaagatcacacaattgtagctaaataaggattagaacccacccatttctgcctctgtttgaaagctttgctccctgaaatcacatgcaaaactatgtgtctatgcatttttggggcatttggcatccatactttcatcacagtttccaagggttctgtgactcagaagttaagaacctgtggtccaaactccttgacatatactcttcctttgtactgttggaggtgggaatagagggaaccaagacctgtctctcatgaggaagctgtcatgggagatttacccaaggtgtgcataagcttttttccttgttcagatagctttgtgacacttgagtgtctttcctgtacttgtcctgggaagactcttagtcgaatcctgagcattctaggatatcaggaaaggatctgccacttcaggaagtgacc

SEQ ID NO: 169284 - DNA, 480 bp, Homo sapiens
tctgtacagacgaagtctcactatgttgcccaggctgatctcaaagtcctgggctcaactgatcctcccaccttggcctcccaaaatgctaggattacagatgcgagccactgcacccaagctctcttaattcctcctgactagaaagagccctttgccactttcagctttgtggctgataattctataaccttgggcaaattacttaaggtctctgagcttcagtttccccatctgtaaatagaggaataggacctaccacacaggcttgccatgaggttcaaataagataatgtgggtaaatcactttagcacagtctctagcacagggcagggctcaacaaaagtcacctactttcctttaccctactacttccagttgattcctactaaactctaggtgtataaaagataggtccaagcataattaattcccctgcgtactctgctcagggtcctgcctcagtgccagggacacat

SEQ ID NO: 169285 - DNA, 565 bp, Homo sapiens
gtggtactgctcctaggacattctaagctgaggaaaaaagcccgagagcttttgtacttgttccctctctttgaaactctttgcccagagctcaagtggctcagatgtggacttttcctgtacatacctcactctctgtctcccgacctttcttgattgggcctactttataaagacactcactaattacatctgagggctccaccctcatgagctagtcacctcacaaaaggcctcccacaaccaaatatcacacttgggatggggtttcaacataatgaatttgagggggacacaaacgttcaaaccatagcactttcccaacatgaagatgatttttcagttaagttctaacaatcttttcagaaacagataattctcaccttgtgccgttagttccacaaaataaaaaataaagtatcccaacatcttttacgaggctcatataaccttaaatacagaacaagctaaggataacacaaagtatgaaaatgatgaacttatttcaagtatggatataaatgtgtgtaaatagaatattagttaactgaatacaaaacagcac

SEQ ID NO: 169286 - DNA, 441 bp, Homo sapiens
tgacatctttgttgcctgcttggagagtccttgctctttccattgactgagtagttctagctagtttcttttgtgttcattgttctgccttaaacaggatcataaagctttcaaaaatttttttttcagcttgttacctcatgtgtctgtgctggccaagaaggaagagaagaaaataactttatcatttgcatcacatgattttacagctttgaaaacccatttgtcagtgtggttactgggaggatgattgcagctattgagtgctctgagagttacttctttaatctcttccctcttctttccccgtttaaaaaaacagttaattttgctgagggagaaattttattgtttttttggtatatgatttcaaagttgaacctttaaatgatttgtgaaaagttaaaagttctttgccccaagttcttagtaactcttcta

SEQ ID NO: 169287 - DNA, 409 bp, Homo sapiens
aagtagaaggagctgagcttcttgatgtgtgaacagaaatgggaaattctttatttttaggctttctagcaattaaccttgtttctgtgtgccctattgtaggtagatttaaagctagaagcaccaggtgggtgctgctggaggaggagcagccagtgaaagtcacagattactgccatgtttaagcggatgtggtgttagacattcagacaccagtgtgttggctgggattctgaatacctgtgttttttatcaggattggtgtcagtactaatattttggtatttaagaaatctggagtctgaataatttacattttgagacatatccctagaaagttactgcattaaaatttgaaatggaacaaagcagcttgtttagaaagggttctgaccacttccctcaatta

SEQ ID NO: 169288 - DNA, 161 bp, Homo sapiens
gccgagatggcgccactgcactccagcctgggcgacagagcgagactctgtctcaaaaaaaaaaagaactatttctcctcattcatcattttgcatctgattccccatatatcttcttctcatctcccaaccaggtatgatgcccaggcaggacccctgct

SEQ ID NO: 169289 - DNA, 447 bp, Homo sapiens
cataaatcaagaaatacaactgcatggcttgaaatgtattgccttaaggctgattctaaaccaagaaaataataccaacatcactagcgatgctatacaagtcacttagatgggagctaaatcctctccaactctaagcaatttagatttggaccaatttaattcttaggagttactaactttgataacacataattcattttgacagtttaaaccaaaccaattactccaaaagggaagaaattatgtgattgcctaacacatggaagcagaggctttagagatataaaagtctttggagaccgtttagtgcagccccctcacaatataacggggaaatgggacccagataagcagacgcttgcctaaggtcacagcttgaacccagttctcctgacacccattaaagtacagtgttcccctattgctgggagttgtataacgaaa

SEQ ID NO: 169290 - DNA, 358 bp, Homo sapiens
ccaggtctccatccccagtgcagcagcccaagcccacaggtggagggaggagaagggcagggggaacaccccttctactgcattcacgttcaggaaatcgaatgccccttgccctccacctttaaggaaagtgctcctggcctctcaccgggcagcgtgcccagagttgagttaccaagggagggatggtcggcctggagtcaatcaactctctctccagagccccttgatatacacccagaacatcagacctattcagtgactctatcgagcgctgtggctttcaaaaaaaagtttttttcttttagcaaaacctagttacctaaaacacatcaaagtagagtgctaccaacttgac

SEQ ID NO: 169291 - DNA, 1025 bp, Homo sapiens
gaaagagatagatagagagagagaaaggcagaaaaggaagaaatttgtaatgagcagtttggttttctagaatgggcctagtaatttgaagagctaaagagataaaaattcttacggcagatcaaattccaaataagcattctcagttattctttatttgtttgtgtttccaccttcataactactccagctattgcctctagtctccctcctaaggatattactcagaaacatagtcttcctagaatgctcacaaagcttccattatcactaatgagagctacttatgtgcacctggggaagagctacctgttaatattctatctttattttgctaacgggctcagccttaacatttttcactattatttggctgctccaatgtctctctttttttattgtgtctttttttttaactccataatgtactttcttagtagcactagttatgagttagcagaactgagtgtacctgagtagggatggttccaggtaacttaggtaaatgctgctcatccttgacagttacatggtgtttagagctttctgtgggttcacaaattagcggtggctcacacgtgtaatcccagcgctttgggaggccaaggtgggtggatcagaaggtcaagagattgagaccatcctggccaacatggtgaaaccctgtctctaccgaaaatacaaaatttagctgggtgtggttgtgcatgcctgtagtcccaaatacttgagaggctgaggcaggagaatcgcttgaacccaggaggcagaggttgcagtgagctgagatcatgccactgcactcccgcctggagacagagcaatactccttctcaaaaaaaatgcagcattccattaacacaatagatgtgttccttaatagagtgtatagctaatacaggcatactgtggacatattgtggtttcagttccagaccaaggcaaaaaaaagcaattatcacaatgaaacatgccagacaaattttttggtttcccagtgcatataatagttatatttacactac

SEQ ID NO: 169292 - DNA, 189 bp, Homo sapiens
ccaacaccagagaaagatgtcttgtagacaaattttctagccctagtgttacccacctgtgttgctaatgatggtatactttttaatgtgagtcaacacgtgctggctcccattttcagtgttcctagatttttatctgcctgccttattttcagaggaactggcctaacatctcatgagtgttgatac

SEQ ID NO: 169293 - DNA, 445 bp, Homo sapiens
tcagaaacagcagaggtatcctaagcccacctgcattccttacctaatgcactgcactcctctcttcccagggatgtgaccctgaccagatgtcctctggggcacctgtgattcacactacactacacgtgtctctatctcccaacagagttacaggtcccagagggtaaagtctctcactctcggcaccttgttttcttttttttaaagtatgtttttttgtgtgtgtttgtttttgagacagagtcttgctctgtcatccaggccggagtggagtggcacaatcctggctcactgcagcctggaactcctgggctcaagtgatcctcctgcctcagcctcctgagtacctaggactacaagtgcgtgccaccaggcctggtttctgcttctttttcatccttgagtctctccagccaagcttcatgtacagaaggacgaatca

SEQ ID NO: 169294 - DNA, 489 bp, Homo sapiens
ccacaggcttcttaagaccaataaattctgctaattccagccattattcagccgtccctgtagtgctgagcttagaaatgtggttccctgtctcttgagcaccgcccattgcccagatggtcaccttccagggcaagacacacatgacctgcatctggtgaccctggccctgtctttgggggagagaccctgctggccatggggtgctgcagagggttggaggctcacaggccacacatggctcgtgggcgggtccttggcatttattgcctctgtcgtatctgtgccttctctaccctcattagcagcaatgcccctgagctcagaaagagagaaaagccagcctggctctcagaggtcagacttcaccagagcatcctccctgtagctttataattaaacagagagagagagagagagagagagagagagagagaaatagaagccggtaactcagcatcctgtgtcagttactgacctgtgcctcct

SEQ ID NO: 169295 - DNA, 462 bp, Homo sapiens
tacatgctgacggcaagctatccggttcaatacatgggaagataaactgtataaaactatctgagctgtgaaaagaagtcactgttcggccaggtgcaatgacttaacgcctgtaatcccagcactttgtggggctgaggcaggcagatcacttgagcccaagagtttgagaccagcctggacaacatggcaaaacccagtctctaaaaaaaaaaaacaaaaaaccaggcatggtggtgtgcacctgtggtctcagctactcgcgatgctgagggggaagaattgatttagcttgggaggtcaaggctgcgttgcccctcagtctgggcaacagagtgagactctgtctcaaaaaaacagaaaaccagaccaaccttccccttcagaactttagtaactggggattatatgtagccttggaatatttattctgtgttggccaacattgaaccggatagcttg

SEQ ID NO: 169296 - DNA, 312 bp, Homo sapiens
ttttttactgagaagggaccttttaaacgttgacttactactctagctacccagtttgaattgaagggctgaatacacatgcacaggcacaccttcatcaaaagaattcagtctgatagtatgaataatataccttactttaaagcttactgtggtattaaaggaaaatacttcaccatgcttttactccctattaatctgcatattacttgtttgtgatattagaattgaaacttgagattgggagcaagacataatcataggcatttgtgaaccaaacgcttaagtaatttaaaagtgaaaatatgttga

SEQ ID NO: 169297 - DNA, 276 bp, Homo sapiens
caagctatccggttcaatgcaataaaagaggatacaaacaaatggaagaacattccatgctcatgggtaggaagaatcaatatcgtgaaaatggccatactgcccaaggtaatttacagattcaatgcaatcccagctcttcttactaaccaactttgttttcacctctcattttactccagctgtttaaacctgccaaaaagtttgtattcatggaaactaacataagccagaaacttataatggaagtgtattgaacaacataatgagagaacc

SEQ ID NO: 169298 - DNA, 529 bp, Homo sapiens
cacatccctcaccacaaacacacaccccacacacatcatacacccccacatacaacatacacaccattcctcctcatacttccctacaccccacatgtacacacagcactccctgacaccacatagacaaacacataccacacccccacatacacacacacaccacacatacactcatgtatgtaaatatacaaagtacagtatattaattttatagtctcatcgtggccagaaggaccttagagagtctctgtccaactccatggatgagggaactgtgatcatggccagagactttatgggactggcccatgttcgggtggcagaggcaggcccaggttccccagtcctgacacaatgtattttctttaatgtctttataataggcaatacatgttccctaaaatgtattgttgaactgaaacctttaagaatcatttattctctttgtatgaatgtttttccctcaagtcttgtttacattgtgagctttcatagcaaaccctttctttggcccaacgtaggctaa

SEQ ID NO: 169299 - DNA, 108 bp, Homo sapiens
ctacatcacagtaaatgggataataatagccaagcctcaatttctgttctcaataaaaggcaattactatggatgtaatgaatttctaaactccatttaagtcttttg

SEQ ID NO: 169300 - DNA, 499 bp, Homo sapiens
tggggcaacctctcctcctcggggaggacccagcactccctctacctctgtggctggcggcgtggaccctttgggactcccaatccagcaaacagaggctggtgccgaccttcagcctgacacagaggatcccactctagtgggtccccctctccacaccccagagacagaggaaagcaagactcagagctctggggacatgggcctccctcctgcctccaagtcatggagctgggccactctggaggttccagttcccaccgggcagccagagagggtctccagggggaaaggctccccaaagagaagccagcacctgggccccagtgacatctacctggatgacttgccctccctggactctgagaatgcagcgctttacttcccccaaagtgactctgggctgggggccagaagatggagtgaacccagcagtcagaagtccctgagggaccccaaccctgaacatgaacctgaacccactctggacacagtggat

SEQ ID NO: 169301 - DNA, 543 bp, Homo sapiens
ccaagattgcggcactgcactccagcctgggcgacagagcaagactccgtctcaaaaaaataaaaaaaaaaaaaaaacagctacacttcttcagtaagggcttgcccatccccctgcatacctgatttaaagtactcctgccctgaccagagcatggagccagccttcagggattccaaagtgccggatcctactaagtcaaggctgttgatacagaggtgagatcgtttcacaaacctgtgtgactccaagatggttatccattctttcctgctgcctggagttaagaaaggctttccttaaaagggagcattgaagccgagtcctaagagataaagagctgcgcaagaaagtaagcaaggaagggtattctaaggataaggaagataatgtgcaaagggctaagagaatgtggctctttaactgaaacattcagtatggccaaagataaacaggccctttggcaccccctactttgttaggcagagacagctttatttcatagcaatgtatgaacaaacacccttgatctttccctaggtg

SEQ ID NO: 169302 - DNA, 372 bp, Homo sapiens
gcaattctcccaaagtgccacattataggcatgagccaccacatcctgcaatatatttaatttcataagaaacaaccacaccattttccacagtggttatgcctctaaccccttctggaaggagaccatatcatcttttccatacaggacaaattaaatgaggtattacagatagtgatagaagtaggcatggctgatatataggcttcctgtgcactataaagctgtccatgctcagatgcatagttcaaattaatcattagtcaacctagttaaattgtgcagttattttaaaacaacagaaaactactttgcgaggttacatgtcacagtttctctaacatcctacttgggccacaccttttccaagaa

SEQ ID NO: 169303 - DNA, 446 bp, Homo sapiens
cctttatgtggctgtaatcagtgttagcgatggtttctgtcacttcgcattgaatcatatcatttaaaaaaatgacttacagaattcaaaaccagtatcaaagagctgcataccatttcagaaggggagggtagactcttaacttcctgttcccccactgttggaccttgaggtcacttccaaattctcaccataagtgcctcacaaacaccttcgtacatacagctttgtacatattttagattatctcattagactaggctttggtaaataggattattggatcaaggggtatgaaccaaatactttctacaaagactatttcaattcacaccatcaataatactgtagaaaaatgccagtgaaactcgcatttatcatgtttgtattctgcctttttttttttttttgatatggagacttgctctatcacccaggctggagtg

SEQ ID NO: 169304 - DNA, 385 bp, Homo sapiens
aaaaaaaaaaaaagaagttggacacagtgaaatgacacaagcagatgttaattcacatgctactgctattgctgtgagtagtagtcctttatttctgacccagggatatcatggcttccagaaaggtaaaatctcaaactctgcacaagccttgagctgcctgttacagtcttttctctcagtctccttggagcctcttaagctaaacaaggacatacacagaggagattaatcccaaatggaagtgccaaactgtggaggaaacaggttaaaataattttgtggtatattaaagaaaggaagcatttggattcatgggaaaacaaagacttcttgaaattatgtattttcaaccagaaaacaataaaaatttagcttttttcct

SEQ ID NO: 169305 - DNA, 226 bp, Homo sapiens
tgatttcatgatgttatccccaacacctacacaatcaagtccatatacctgtggcctgctattgaagatctgcagggcatgatatgatgactcctagaggttttttcagcctcttcttctgccagtccatcctccatctctgcccttgaggagttcatattttagtgggtttcagacacagacatccgcactgtgttgggcgataacatggggtccgataggggtc

SEQ ID NO: 169306 - DNA, 442 bp, Homo sapiens
gatatctcataaacataaatgtatactgcctacttgtaaatcactctccatctttaaacaatttgtatatttatttatctaccttaagttcgtaagttccatggcccttcattttttgtaaactatactattttggcttcttggacttttgcatacagatctaaatataatgcctcactgctgagaatctcttttttttctagttcacaagttgatgaaccaactgatctcctataaaattatcagaacctataagaaagcatgtttttaaagaaggaaggaacaaaggtgttggggagaaatcaccatctttttttgtactacattgagaattatgaatatcattgtagagcaaaatatcacagtattccattctcctgtgacatttttacatggactcaactaagctgcgggtccaatcctgattcgaagatgtccagcc

SEQ ID NO: 169307 - DNA, 214 bp, Homo sapiens
aaggtaagaagagctatagaaaactttcaaggaaaaagaactatagaaaggctgcagtgagctgagatcgcaccactgcactctagcctgggtgacagagggagaccctgtcttaaaaataataataaaaattaaaatgactgattgcttttggtattattcctaaacctaaaataaggtggggaggggagttgctgaaggaattaaccccacc

SEQ ID NO: 169308 - DNA, 354 bp, Homo sapiens
gcatttatatctgtatctttattttagaaagtggatggcccagccctggacttcctaaatgatatcatttaggaaaatgtgtataaactctgttatcagaggagtcagaaatggaaaactggagaataccttttatattatttgatctgatcagtcccctttttctctacagttaaagtagctatatttgtaccccttgtggtttctaaattctgaagaattaaaagaaatagaaaaaagcaaagaaaaggagtgtcaacttggtcgaggtaggcatgtgtaaaagtgagagctatctcttccatttttttttaactgtatctaaggttgtacaaaaactcaaactaggcagat

SEQ ID NO: 169309 - DNA, 244 bp, Homo sapiens
ctcttaacatcactgaagctccttagcaggtgctctcagcatcttatgaggagcacatgccaactgggaacgcacatcctcgttttttgctcagaaactttggtcttggcccttctccctttcccactgggattaagggaacttgctatttgccttgcctgtttggggaggacattctggacacagatgagagcctttgggtcaagctgctgggagctctcacacccatctgaggagggctcgt

SEQ ID NO: 169310 - DNA, 305 bp, Homo sapiens
aggaaacttaaatgcccatcactaagtgaaaaaagccaatctgagaaagccacatattgtatgattccaagtctatgacattctggaaaaggcaacattatagataccataaagaagaccactggtttctgcgagtttgtgggcaggaggaataaataagtggagcagaagggaattttatgacaatgaggctactctgtatgatactaggtggttgcacgtcattgcaatttgtcaaaacccatagaatgtgtaataccaagagtgagccctaatataacctgtggatgttgggtgatgaggat

SEQ ID NO: 169311 - DNA, 145 bp, Homo sapiens
tccctgataaataatgatgttgaccatctactcatgtgcttgttggctatttgcatggcgtgtttggagaaacgtctgttcaagggctttgccttttttttttgagacagagtcttactccgttgcccaggctggagtgcggtgg

SEQ ID NO: 169312 - DNA, 207 bp, Homo sapiens
atattgtgaaactgatctgatggataattagaatttgcccgtatctgtaagaaggcctgttttgggccatttcaaacaattaagattattagttctaatatgaatgtaagaaaacattggatggagaaaagaaaaaaagtttctgtgtttagagattgaaaaccttgctttgatatcttaacctggatatctcaaatagtatttcct

SEQ ID NO: 169313 - DNA, 345 bp, Homo sapiens
aatgagatgaatgctaagcccttgatatatctgtgctgtatgccatgaatctgttctgaaagcgattcaaaacagatgcccctttggcagtgcaccctaattccagggcagacccatttttcgatatgaacttttttttctgcagtagaatatacttttaagctttgattgcatgttttcttcagggagtaggttattctatagaaataaggattgactttaagtaatatagcttgttttattttgatcattatggataaaattctttaaattacataatatacttcctagcattcttaacctaaattgaaaagtgtataacccctgttacggaaaacaaaaaca

SEQ ID NO: 169314 - DNA, 318 bp, Homo sapiens
tcgagaccagcctggctaacatggtgaaaccttgtctctcctaaaaatacaaaacttatccagatgtggtgacacatgcttgtaatcccagctacttgggaggctgaggcaggagaatcgcttgaacctgggaggcagaggttgctgtgagccgagatcgtgccactgcaccccagcctgagcaacatagcgagactccatctcaaaaaacaaaaaattaggcacagtccaggccagtcacaacctaagatgtttacgtctgaggaagcagctacgtaacgcctgcgaggacaaactcctacgatggagaaggttcag

SEQ ID NO: 169315 - DNA, 488 bp, Homo sapiens
atcccaacactgcttttcccacataaatgtgtgtgttttgaccttttctttgacctggttatgacattgtttgcgtccttcatatcatatgagtaacataaaacctttagtacatgtttgtttttatgtttttatgagtcatgattttatttttcccaaaaatatcttttaacgtgtgtgtgagtgtgtgtgtgtgtgtgtgtgtgtgtgttgggcgataaatgtatgttatccccaacacccaagttcagacattaatgattaatgttattatatatttactgaaatctaggagtgatcagtggcatctctgacctatgaggttgttttaacaggaatgccactagaggagctgtgtattctagccagtctgtttctctcttttcccccatttcagcctttcagggatacaagaatggctctataacagctggtcaattgtatgtcagtgttaatggattcatatctagtgtggggcgataacatca

SEQ ID NO: 169316 - DNA, 422 bp, Homo sapiens
caccatgttcacaactttccttccccatgttagcgtcttttaggcagagaccctaacttgctaacgttagaattccacacagcagccagcacaatgctgcggagtaagcatctgctgaatgatgaatacccactgagccactgagctaggtgcccagggtggcaggggtgtcacatgagtatgaattaggcagagttcacaaccccaaggaacttaatctgttaaatgagtctggctcaccatatattttggtggaatttaccatatttggtgggaaaaacatgtttttaatgagatcatttcttctaaatttattttggcttctttaaccaggcagcttttaatcaatttgaagtttcaaaaagtattatacggaggcatagaaaaataaaaagcatagaaaccgaaactcgagatttagg

SEQ ID NO: 169317 - DNA, 428 bp, Homo sapiens
gatcctggaaggaaaaaaaaggacattagggcaaaacaagtgaaatctaaagtggagagtttggttagtagtaatgtacctgtgttgcttccttagtcacaacaaatgtaccatcataatagtgttaactgtgggggaaactaggtgagggaggtgtattgaaattgttctgcttattctaaaataaaaggtttatttgtgagaagcacctttcagtggcgtgaacacatggattggcatgggcactctgcccatgggcctttttttttttttttttttcctggaagtttagttaaccccaccataataggatctttgtaagagcacacagccaagagctatgtgagagctgtgcgctcttaacaaagagatgtgtgccagttggcattcatgtcttgacccctgaccgtaaaaccaacaaaaaaaaa

SEQ ID NO: 169318 - DNA, 508 bp, Homo sapiens
ctgatattcacatccagtcttcagtctgcaagcctttattgttgtccttgcaactgtagctgatacaatttgccaggtggttgtggaagtgtcccgtttctcaacaatgtaattattgatagaacttccaccatcatacttgggtgggccccaggaaagagtaatactatcagctgtcacttcatccattttaactggtccagttggaggccctggtttgtcaagaacgataacattaagggtttcaatagcttcaccagctgagttagtcagtttaaccacataatggccaacatcttctcggcaggcgtcctttattgtcagtagtgaattattttctgtgctctctgcatttactctagttgtctgcttcagtggtacattatctttatgccaggttacagctggggtagggcggccaatgaatggaacatcaacttttaggtcttcacctgccagtacagtgaaagtattgaacaggagtttgaaggctggtggaatgacaaga

SEQ ID NO: 169319 - DNA, 128 bp, Homo sapiens
atttggagccctgtagttactgtgacgacaacacacactaatggaaaacaaagatggtctgctcatcagggcaagccaggaagagttttgccagctcagatttttcctaattattctataagtcttga

SEQ ID NO: 169320 - DNA, 356 bp, Homo sapiens
cattattccaatatcactgccaacacaggagacctggctgacctgcatgctctatgccaccacgtcaggaactttgctgctgcctggacaagtataaaatgttatagcagtaatctaaagtgtgatctttaatacaccctgcacacacactccacgcaagtcctgctctgtaatctcttccccccatcaaagtgagacttatggaagttccaaggcagccccctgcccagggcagagctttctgggagcctctttattctcctccctatatcctggcttagctacacccgaccctatatgaggtttgcaggacctggagagtggagggtaggcattattgcaaaaatatatagaaa

SEQ ID NO: 169321 - DNA, 336 bp, Homo sapiens
cgggctttgccaaacttgcagttaacagtcagcaggggttcctcctctgttgtttccctaacataagcagagtgctgaggtagaaagagaactctctttccctatcgtaagcagagtgctgagatagagaactctctcacttagaaaagaagaaaaacaactcaacttaaagtgcataagttggggagcctgagggaagagactcttgctctgtgaaaatgggttccttcaatcattgtatcctcccctagttcagtctagctagacctccctgaagggaaacagagccagcattccttttacccaaaggaaagagcatggtgacagggtcttgga

SEQ ID NO: 169322 - DNA, 466 bp, Homo sapiens
taattacagtttaagacccctaaaaagctaattaataaaagacatcatgttctgataactaaaaggcttataaacatcattctgagtcctatgaaactgagtcctcaaagcacagattaataacaaatggcatctagcaaatctctagtaaactttcttatcataaaaacaagtttatgctctattattaaagccatatgagaaacagttttgggtgtttttttttttttaactacagtaaagttacttacaaagaaatgtgaaagataactggggtagtagtaataaaaattcattttgaaactgaaaaattcatattgtaatgtctgtgatcaaaggtcaacgtctttcaacattctcatacaagtccaacctggatagaaatcaactcaaatataatttagaaaaataacaggatatcaaacaatgtattaaaccctgtgaaatacaggcataccttacaaaa

SEQ ID NO: 169323 - DNA, 150 bp, Homo sapiens
ggagaagactttcagagttaggcagaccaactaagaggtcagctgaagcacctaaccagttgtaaggaggtgaaagacagcaccccaagaagagacgtgcaggaaggaggaaagaggcttggtcataaaggatggaggaattccaaagtg

SEQ ID NO: 169324 - DNA, 619 bp, Homo sapiens
ttgagcctggcaccttcgcaccagcaagaccagagcctgatggacaaacttgggacaaattcccgctggttctcttgcctagcagagaactgccaaggtggcatctccttcctgcctggtctgggtagaaaaccctaagctgaacccagagcagggctagaaccacagaaacatcccttattgcatctagggcaccgacagggggacagggagagtagagaatctgctcttggccaaaacttatattcttagaaacatggggtccccagcccctaagagcaaagtcttcaactcccagtgggctttcttcagcctcttggcacttgccaatcccactccaaggactacagggccaaacccagcacccacacagcacactaagaatacctccaccgaccactttccagacctcagggagtgggactcacccacgacctcagagggctcgctccagcccaggcttgtgggtggctgcgccctcaggggagggaaggctctccttccccttgtactgatcagaggccaacgtcctcataaagtcacagtggcatggtaaggccagagtgtcctccctgggggcctgccctgactccacagcagggataccttccacattcct

SEQ ID NO: 169325 - DNA, 506 bp, Homo sapiens
cgtgggtctcaaaagcagctcctgggatctcagttaagtgcccagttattctgtgattctgggagaagcgcacagacgccactggagtagctgggtgtcagattgcagatggaaggacctgaggtttctgcagtcccagctcgtattcacaccgtggaacatttgtccttagcttgtttccaacttccttccatcccctgctcccgtcacttgcccccaagttgtctttgctaaacagtgaaaagggcttaatgaaaatgacattataactagatgcatgctcactaatctgaaaagagaagggttctttctgttgatttatttgtagtctgcattgctattatctgtcgacataaacagaaagcagagaggagaacctcaggaattctgaactttcaatcgggacaactttctcatttgttgttttaaactttaaaacagcagcagacctttctggaaggagaggtagtggccaaagtataaatatgttacgttgccaggagacg

SEQ ID NO: 169326 - DNA, 185 bp, Homo sapiens
ttgaggatcccccgaagtattatcaagagaaaagctataatatctttagaatgtcaatggcaggtatcaatttaaaatgcgcaaataccataactagtaatgctttttgtaatgtattgaaagaaacctaagttaggcaataatattgatgatgaatattatgattataacagccgatactaaat

SEQ ID NO: 169327 - DNA, 491 bp, Homo sapiens
atagctcactagaattatccctgatattctggtgaaatcttcaaatggcattggctacactagtcctattagccctggtgcaagtacccagacagatccgtggtgtaagttctgctcagagcatcttggcagcaaatgtctgccccaaacagccaggagtcccattctatatttatcagaggtcactatttaccaaacagacctcaggttcatagtgcatcttctaccaaggacacccttaaggactcttaacccactccacccttgtcctcaattcattctttgcactcacagccaaatgcttaaatacaatactgggttcattttctaagctaagagaaaagggaagggctgtgtagtatgttgattcagtgagccaaaacacagtttgaggagccttttgcaccagaagccaagggaaagattgatttgccggcttgaaatcactggactcctttaaggagcatggtgcaagatgctttctttagaac

SEQ ID NO: 169328 - DNA, 584 bp, Homo sapiens
agaattgctttaagaccgaatgtgtggttgatctcagaatatgtgccatgtgtagatgagaagaatgaatattctgttttcaggtggagcattctgtcgatgtctgttaggtctgtttttttcaagtgtcaagtttagattctagatatctctcttagttttctgcgttgatgatctgtgaaactgtcagtggagtgctgaagtctcccactaatattgtgtggttatctaagtctcttggtaggtctctaagagcgtgcttaatgaatctagatgctccaatattgggtgcatgtatatttaggatagttaagtcttcttgttgaattgaaccctttatcattatataatgtcctttttgattgttgttggtttaaagtctgttttgtctgatataagaatagctaccccagctgggcgcagtggctcacaccttaatcacaggaggcagtggtggaagttggagcaagatgcccaccaaaattaagtccttatcctcccacagagactgacagtaagttatctaccttaatgtttgcatttctaaaatctctgagaagaaaattctggtagaacatttacat

SEQ ID NO: 169329 - DNA, 437 bp, Homo sapiens
actgctctcatcatcataaactttctagtttcacagaaaaaaaatacataaaaaaagttaaacactgtttattatattttattctactgttaaataaaccaactagtaaatctttacctttctgcaaacaagctagaacaaagatttctgggtatttccaactcaatatttaacattcaaccataggaaaatttagccttctgatctaatggtttggacttatttcttctttggtacagagcaaaagtctacagtctacatctttattcctcaattagataatctatggaaacactgaactaaaggacctgaagaaataaaaaaaaaacaaaaacctgggaatattcttaatgagtgtctaaatttgataaagaaaaatgttacttaagaggacaagccagttgtggtagcgcatgcctgtagtcctagctacctgg

SEQ ID NO: 169330 - DNA, 1676 bp, Homo sapiens
agcagggacctgggatgccaggctctggggttaggctttctggtgaggacaaagggagcccttgaagggcattcggccactcgggtgatagtagcatggagggatgattgggtagggggcactgggagactcatgcctggctgtcttctgtaaatgcctcattgctggaaagccctccatcctttaactgtcaagggccaatgaggagtccctcactgtgcgaagtcttccctccctcatgccacccccagccccaaccttaaggggacaacgagcactccctcatccaccctttacctccattgcacttggagtaaacctcaatcctaggcctattgtttgctgacttgagttgtcagaagtcagcctcctccaccatcccctggaaaacaggaatctgtgtcttggccaaggccactcccctgcccaggtgtttgtgaaggccctgccccatgtcctgctaatcagtgctctcccactgattggctgattacttgcaagccccagaggagtcacctgacctgtctaggccataggtacatctagaagagaacaatctcaactcctgggtcttcaggagtggagtagatttcaggtggagcaaggcagacatagagccaggaattgcagccacaagagagaaactgaaagttcagcccactgtgttctgaaacctttcactcatttattccctgcaacagtcccttgaggtagatactatcattttattcagcttgccaatgtggaaactatggtacagagaggttaagtaaatcccttcaaggttatgtggccagcagaggcaaagccaggatctgaacatgggtaacactggctccagagcctttgttcttaaattctgtgctatcctagagcctacctactccttacttccctctgcgtggcccagatcctggccctggatgtagtatgctccagttcttccaggtaggctggagattcctggaagcttgtgggagaaggagccttataacaaccttccgtcttggggaccctatcctgggtcctgagcctcaggagcctgcctgcagtccctgttgtaggctcttccccagctaagcatctgctttaggtgttaggccacatgaagtacgtcatcccaacagattcctgggcaaggaggaaggctgggagtcaggcttccatctggcctgggcttagcatctgaggggactttcacccttccctgtgaaggttggaagaagagggggccccagaaccttgccagggagtctgaggtgcaaggagtggaaagcgggagggacactggtcaggatgatggagtcctgttaccaaatagacccagaaagtagggctgcccactccttctcagggatcagcaagtggaatgtgcttttctggggaaataggacgaaagggccgggcgcagtggctcacacctgtaatcccagcactttgggaggccaaggcaggcggatcacctgaggtcaggagttcgataccagcctgggcaacctggtgaaacccagtctttacaaaatacaaaaattagccgggcatggtggcacatgcctgtaatcccagctactccagaggctgaggccggagaattgcttgagcctgggaggcggaagttgcagtgagccgagattgcaccactgcactccagcctgggtgacggaataagactcggt

SEQ ID NO: 169331 - DNA, 1622 bp, Homo sapiens
agcagggacctgggatgccaggctctggggttaggctttctggtgaggacaaagggagcccttgaagggcattcggccactcgggtgatagtagcatggagggatgattgggtagggggcactgggagactcatgcctggctgtcttctgtaaatgcctcattgctggaaagccctccatcctttaactgtcaagggccaatgaggagtccctcactgtgcgaagtcttccctccctcatgccacccccagccccaaccttaaggggacaacgagcactccctcatccaccctttacctccattgcacttggagtaaacctcaatcctaggcctattgtttgctgacttgagttgtcagaagtcagcctcctccaccatcccctggaagccctgccccatgtcctgctaatcagtgctctcccactgattggctgattacttgcaagccccagaggagtcacctgacctgtctaggccataggtacatctagaagagaacaatctcaactcctgggtcttcaggagtggagtagatttcaggtggagcaaggcagacatagagccaggaattgcagccacaagagagaaactgaaagttcagcccactgtgttctgaaacctttcactcatttattccctgcaacagtcccttgaggtagatactatcattttattcagcttgccaatgtggaaactatggtacagagaggttaagtaaatcccttcaaggttatgtggccagcagaggcaaagccaggatctgaacatgggtaacactggctccagagcctttgttcttaaattctgtgctatcctagagcctacctactccttacttccctctgcgtggcccagatcctggccctggatgtagtatgctccagttcttccaggtaggctggagattcctggaagcttgtgggagaaggagccttataacaaccttccgtcttggggaccctatcctgggtcctgagcctcaggagcctgcctgcagtccctgttgtaggctcttccccagctaagcatctgctttaggtgttaggccacatgaagtacgtcatcccaacagattcctgggcaaggaggaaggctgggagtcaggcttccatctggcctgggcttagcatctgaggggactttcacccttccctgtgaaggttggaagaagagggggccccagaaccttgccagggagtctgaggtgcaaggagtggaaagcgggagggacactggtcaggatgatggagtcctgttaccaaatagacccagaaagtagggctgcccactccttctcagggatcagcaagtggaatgtgcttttctggggaaataggacgaaagggccgggcgcagtggctcacacctgtaatcccagcactttgggaggccaaggcaggcggatcacctgaggtcaggagttcgataccagcctgggcaacctggtgaaacccagtctttacaaaatacaaaaattagccgggcatggtggcacatgcctgtaatcccagctactccagaggctgaggccggagaattgcttgagcctgggaggcggaagttgcagtgagccgagattgcaccactgcactccagcctgggtgacggaataagactcggt

SEQ ID NO: 169332 - DNA, 286 bp, Homo sapiens
tgagacagagtcttgctctgtcactaggctggagtgcagtggcgctatctcggcttactgaaacctccgccttccgggttcaagcgattctcctgcttcagcctcctgtgggtctggatttctttgagggatgataaaaacatcctgcaatgatactgtggtgatggttgcatgactctgtaaacatactaaaaaccactaaattggaaactttaaaatggtgaattttatggtgtatgaattacaacacaataaatctgctacctttacaaaaagtcagtgtgca

SEQ ID NO: 169333 - DNA, 518 bp, Homo sapiens
gtgttgatggtggtggtgtacagcaatgagaatggtgataataataatatcttatatttgacctaaacatacttttcaaagcttttatattgtctatttcagtatttataaaagtgtattaaacaaattccatggaggctatgggatttgggaattgaatggttaataattttcttgttgtaatggacttcccagtgttttaatattctcagagtttttactaggaaattttagatggtacaaggcatatgcacaattcactatgggaacatttttaactgttaaatggaatatattttgggatgccctcatctaatgtagagacatatagaaccttagtgcttgaggtgaccacagtcacatgtcatgtacttcaacatcttcattgagcaaataaagcattaaagctcagaggagttaaatgacattttttgaggctacccagaaaattagtgatagaggataaattatagtccaaacttttaaaccctagagctttgtctttgttattgtgacat

SEQ ID NO: 169334 - DNA, 378 bp, Homo sapiens
tgaattgggtgatagagggaggttcaagaatattaggcactgtaaataatccagaaattaatgacctatagaagattatgaagaggggctaatggaagacactatggatgggacggaggtgaggagggaagaggattgctttagacttgagtggaggctgtcttccacctctatattctccactgtttcccatttatcggaggaacaagtaacggctgattttaacttacatcgtcagatatgtctattgctagaaaaatttattcatccagaatacagtcactcccacctcatttttcagtgaatgtttgaagctgaccctcagaatgcagctatgaaaggctctttgagtgggcgtttcagatccacggacacaag

SEQ ID NO: 169335 - DNA, 983 bp, Homo sapiens
actggcattaccgacgagttgtccgagttaaaggaatggggctaccccagtggtatctgtcatgagtaaaccaaaatgcctggtgatttatgggaaaactgtttctgagaagtaggtgtcagtttggttctcaaggccattgggacaagggagtgagccatagggagctgtcagagcttgaggactgcttctgggatggctgtcaattgccatgacttgctcaagacagcagatgcaattgcccttaaaatccaagtggggagagttggctctgcagttaaagcctttcacatgtgtcaaaactgaaaacataagcatcgggtttctgatcttggccttgaggatgttcttcaaacatgtcggtagacttgcttagaaatataaaacaaggttgaatgtgaatcatggtgaacccaccctgcctcctgtgaaagcttctgttctcaggagggttagaagcaattgtagcacatgctgacaaatagttaaaattgaactgagctttgtagaactgtatcctagccctgagtgttatgttccgagaagctcactggctcttttagaacagaaaaaccttgcaactgtgttcatggtccaggttctccgggggcatcctctagtcagcacaaaagacagaccctacaagaaaaattttgctttacacaggctagggtagaatgcaaagccaactgacaggttggtgagccataggagcatggagcaggactttatgcagatgttcttggaaagccacaaagggctctgatgagaagaaacccagtgggcatgattaattattcatctttagttggttgggcagttggaaatgaataaaggctgcctgaccagctaggagattacatgtcaaaaaaaaaaaaatcatgatttggtggaaagaacacagcaaacgaggtcagatattctagtcttgaatcctggtgcttctgcattctaactcggacaactcgtcggggtcctcaact

SEQ ID NO: 169336 - DNA, 435 bp, Homo sapiens
gcctcggtgatggactctagaggaccccgcatcatacagttcttcacaaccattctgatagcttaaagcttgcttctagctgtagcatgtaacagaatatacttttatttaacaattcagagggaaaaaaacacaagatgaatgaaaaggtctattatatttcaagtgtgtagtgatttcctgtttctttcacacttttggcagccatgtgccatgtcacagagtactttttatactacaacatcaacaaaaatctcttttcagactctggaaaaactgggcatctctctcaaataccaacagctctccatttaataatacaaaacagcaatgtgactaaaaatcatcatcccactaacaaagtacctttgtcataaataaaccctccctttagattatccaaatacatatcagacctccaaccctcctttcaga

SEQ ID NO: 169337 - DNA, 518 bp, Homo sapiens
cagtataagagtagaagtgtttacatatccctaggcaaaactataaaggaatactgatatgttccccatgaatacaaatagtttttaatccttttttctgactgaaacagaaaataatgcgtttgccaaatcaatggccaaatatcgaagtataacctgctctagcaaagatatcaaatccatcatggcagccacatttggggatgctaaatcaaaattactgaagtccagtcattctctgatcaatccagttttacaggggcagactaatgaattaaatatagataggatagagaccaccaccttgcatcttaagatacttaagggtaggtcgggtgcagtggctcacgtctgtaatcccagcactttgggaagccaaggtgggcagattacctgaggtcaggagttcaaaaccagcctggtcaacatggtgaaaccccgtctctactaaaaatacaaaaattagccatgcgtagtggcgggtgcctataatgccagctacttgggaggctgaggca

SEQ ID NO: 169338 - DNA, 245 bp, Homo sapiens
attccctgtatagcattattttaccacttaaaaattgtattttaccacttttatacttttatttatgctgtgtccattttgtgcagtacacttccccaatacatttttgttttgttttattgtaaacaaatataaatataatcctaccaaatttttagggcccagctcaaatgctaccccttccataaaatttctgttaccatccaaatggaaggtttctatatctcttttgaacgctaatgcca

SEQ ID NO: 169339 - DNA, 246 bp, Homo sapiens
tcaggcagggagcaccctgtagcctgcttcgaagagtgagtgtggagcccaccctcaggcagggagcaccctggggacacacacatgtctgcatcctcagctcagaaaccaccatcatcagagctaatgtctgttggtacctccacaccctttgcatgattagcttcatcttcaccgatgaggaaacagaggcaacttggaggttaagaaactcaccaagggtctcgctttcatccccctgccgtg

SEQ ID NO: 169340 - DNA, 304 bp, Homo sapiens
cccaggagccagtggccgtgctggacgggggccaaggtctctgcagccctgagacctttgcatagcacagccaaggacagagctgctgtctgctgcctgggcaccccttcctgcctggctgccttgtggtgcccccaagctggttctgtagcgactggggaggtgtgagcctggcctcagaggtccagatcatcacagcctctgatggcctctgacgtagcatcagcctttagtccagcgggccatctggactccctgttcacctatcaccatccccacctcggacttcttgtgggattaaccc

SEQ ID NO: 169341 - DNA, 424 bp, Homo sapiens
tagatacataaaatgcttggagaatattctgatgtaaaatttgagaaggagtaagaagtctagtgatatcagtttactaatttttaaaattaaattatctttaatctgtgttgtttttagatgatctttttcatgcgtgtccctgtgaagagaccaccaaacaggcttcgtgtgagcaacaaggctgtttatttcacctgggtgcaggcaggctgagttccaaaagagagtcatcgaagggagatgggttggggccgttttatagaatttgggtaggtaaaggataaaggggggttgttctctggcaggcaggagttggggggtcacaaggtgctcagtaggggagcttttgagccaggatgagccaggagaaggaatttcataagacaatgtcatcagttaaggcaggaacaggccattttca

SEQ ID NO: 169342 - DNA, 127 bp, Homo sapiens
tgtcaaggatgtggagacactggattccttataaattactggtgggagtataaagtgatgcactcactttaaaacacagttgtcagttcctcaaaatttaaacatagagttaccatatcagcaattt

SEQ ID NO: 169343 - DNA, 407 bp, Homo sapiens
tcggtaagccatctccctgctctctggtttaagatagttctaacttggtgaggcgtgcttaccgtcaattttcctccaaaggttaacttcctgctttcctcgaccagtattgccgcagccccgatggactggatgcattgaggccatccacaagtgactgggtccaacacctttgataggaaggctacgggctgccggcggcctctgtgttcttgagtcagcactcctaaaactaccgcactgtccacattaacaaaaaggtggaatggcttttctagggagggtaaggcagttatgagcctttccttcagcttctagacttgatcagcttcctcagaagtccacaggagatggttcggcttctcctgggcaagtttttaatataacagtttactgtgcagtgcatg

SEQ ID NO: 169344 - DNA, 369 bp, Homo sapiens
ggtgaggattcacggcttcagggccaagggcaggcaggtcttggtggttgttcttggccttaactcaacctaatcttgcctactctctagcaagattttgtgtcctggaaggaaagggcatgatgatgctcagtagtgttattgcttcctaagtgatccaagtcacctcagcctgttgggttgagggaatccaagtcccctaaccctttcctttaattaatgaaaagaatatcccctccaggcttccctatctcacatgctgtggccaatccagtgatctgacaatccagtgagatttccatgaattctgggggcttacaatatcatagtttctgttcctcttacttcctgcttccattgacatctaag

SEQ ID NO: 169345 - DNA, 349 bp, Homo sapiens
ctgaacacccctttgcttttgaacccagctgacagtgcacctctctgtcccagcaggaacgggtactccaggccctgtcgcagcccttatcctatggagatgcattctgaacagatggtgacctctgtgaggacaagactgtgcttggtcatcttagcctctctctggctctgggccagacctggcccagggcagacaataaacccacatctgtggaactgactggaagccaacagtggcctgaagccacaggctgctgattcacaccttggctgaggaggaggaaatggtgacgccaacgcgtgggttctagctttctttgccagcacagcgggcggggggccatgca

SEQ ID NO: 169346 - DNA, 444 bp, Homo sapiens
agggtcagcgccccctgcccagagactgattctctcccgcctcggcttcctgaaagcctggttcatgtacctttgtggcagagaaagcggcaaggtcacagtaaatctgcctttctgaaagctgtgctgaaatgacaccaggattaggacactgaaacccctctcagggtgggagagtgagtgggagggctcagaaccctgagggagcccacaaacaggttctaggaagaagctgctggtctcctggttatcatgagccccctgtgtgttctggctgctgctatcagtgtgtcattcactttgatttagcctcaaataaaagacagattattttgctttagagactatcacattaggacatcttacaccttgttaatgacccagtgaaaggagagttggaagccttccccaaaagcataatagcacaggtgacattttactgat

SEQ ID NO: 169347 - DNA, 500 bp, Homo sapiens
tctgactgctttaatatcatttccttacagtgcctgagctccactgagaaacaaaatgcccaaaaggcaaggagctaaaaagagaagaaataacattatctcaaaactgtaatcttctcctaaatagaatagttcatatcattggtagtttatttgtacagttaattttatttgtagtgtcaagttgtgaatatagtattaagattaccatttctgcactgtttagttttaaaaaattacctcagtgaccttggttttgtcctaactataagttattaataacttaatggccatggaaattatttaaatccccttcgataattacacatacactggaactacttatctgataccacagagcagaatttggattatgagcctgtcttagacattatcaaaaaaaaaaatttaactggctgggtgcagtggctcatgcctgtaattccagcactttaggatgtcaaggttagaagatcacttgaagccatggagtaatgaga

SEQ ID NO: 169348 - DNA, 337 bp, Homo sapiens
caaagaagaatatccatgactacctgagatggccattaaaatattgcccctttttccaactatgcctctgagtgaggtcagattttatttatatacttcaacaaaacatcacattgtaatagattaaatgaagaatcagatgagaatcaagctatcctctattaagccagatgttgaagagataagcaaacataaaataatgccattttctgaatatatttttttaattttgaaacattttcataaggaaatgtcaattatgttcccatgtcatgggtgtatttttgttactttcatatgaattaaagcgataactttaaattttatgttttaactt

SEQ ID NO: 169349 - DNA, 137 bp, Homo sapiens
agtgtatatggaacattttccagaatagaccatatccaggatagcgacaaagcaagtcttagtaaatgttaaaagattgaaattattaaagtactttctctgatcacaatgaaatgatgctagaaatcaacagtaga

SEQ ID NO: 169350 - DNA, 410 bp, Homo sapiens
acgttgggctcagttcaccaaacaggaacaaaattcaaagttaagttaaacaaggccaggtggaactctatgaaactgtttaaccttcaaaagatagttctgtctaggggacatgggatttagagtagagcaatcaggatgtatatctcggctcctcaacttaataactacatacttgagcaattgtcttaacctttcaaagcctgtcaaaagggcaaacattgccacattcaaatactcagattatcttctgtaaaaagcacccagagatgtgtctcaaaaagcccagtaagtctgacaattgataccaattgggtgggtcccatataccagacatttttgcttggctgaggatgaaaagatgagttagatacagtacttgccttaaaataacttcgtaataagagaga

SEQ ID NO: 169351 - DNA, 328 bp, Homo sapiens
gatagcgttcattccaaaacagctccaggaatggaacagcatcccgtgtccgaacaccaggatcagctgggtgcagcggctcacacctgtaatcccagcattatgggaggctgaggcaggaagattacttgagcccagaagtttgagaccagccatggcaacatggtaaaactctgtatctagaaacattttttttaaattagctgggagtggtggtgcaagcctgtagtcccagctactcaggagtctgagacaggaggatcacttgagcccaggaggtcaaggctgtagtgagctatgatcaagccactgtactccagcctgtctc

SEQ ID NO: 169352 - DNA, 606 bp, Homo sapiens
tggtgtgacagagcatgagatggtcagtagcacctagaagatcggtaggtgcagggatgtccatggggcaggatggacagaggacacatgggccacggcctctgcctggctgagtggacagaggccgctctgggtgggggaaacggtgccctcactgccctccagcctcagtcctggttggagtgagatgcccaagaggcaggggaggtcctagggctctgaagggctgctctctagggcttcctggcgccagcctccactgggtccttccccattgacacctgtgcccaggaaggtagctaagaatggaggagctcgggctcgcctggctgcttctgatgctggcgtgcgtgtgcatgcctgtgtgcgtgtgtgtgtgtgtgtgtgtgtgtgtgtgtgtgtcagaatgggaggaggcactgtcttcatcctccctcttctccgtgtcctcactcctcagctctcatttcttcctgatggcccaagtcactgccccacccccaggctgtcatgcagtgattttccactaccacttgtatctctttcagattgtcaaaagaggtcagaagttcttcagctttttaggagctgtcaccaaacacattt

SEQ ID NO: 169353 - DNA, 532 bp, Homo sapiens
tggtgtgacagagcatgagatggtcagtagcacctagaagatcggtaggtgcagggatgtccatggggcaggatggacagaggacacatgggccacggcctctgcctggctgagtggacagaggccgctctgggtgggggaaacggtgccctcactgccctccagcctcagtcctggttggagtgagatgcccaagaggcaggggaggtcctagggctctgaagggctgctctctagggcttcctggcgccagcctccactgggtccttccccattgacacctgtgcccaggaaggtagctaagaatggaggagctcgggctcgcctggctgcttctgatgctggcgtgcgtgtgcatgtacatgtgaatgtgtgcagatgtagtatgtgcatgtaatgtgtgcacatgcactgtttgaatatatgtgtgtacctgtgtgtgtactgtgtggttgggtgtgtacttgtgtgtgcgtgtatgtgtgtgtgaacgtgtgtgtgatgtgtgtcttaagtggggtgcttatctgct

SEQ ID NO: 169354 - DNA, 317 bp, Homo sapiens
tgttgtctgacacttagcctgactcctgtcctgaaatcagctcatccattctggttcatccagttcttcagactggaaggctgacagcttcagtggccaagtggggtgaggctgaagatggaattaaggttgttaatcagctgagcttgagatgggagatcatctgggtgaacccagtgtcatcacaagggtcttaaaatgaagaagacggaggcaggagagacactgtcagaatgacaaggtgggagaaagacccaactagccactgctggctctgaagatggaggaagggaccaggagctggagggtgcaggcag

SEQ ID NO: 169355 - DNA, 644 bp, Homo sapiens
gaaatacacagtggcaaataagagatattgacactaacctgcccgttgaagttgcatgtaagtatctcaagggaaatggctttgaaggtcccctggttgagcccccagccaagggcaggaagagagtagagaagtgtccaggcaaggacgtgccccagagccccttcatggggcacccagttctgagtttggtccaggactgccaagcacctcctccattcccagaacatccccacttcccagctgcagaggccagaagctcagctgggcattgacagccatgtgggctggcaccttcccatgcatcccctgaggctccttcaactcagaccaaaggccatgtagcctgagtggcttgtgaaacccctggtgtttatgcttctcattggaagcgggtagaacaactttctaaaaccacattgacaggttgtaagttcgcatcagcttcctgcctggcaaagccatggaactctggaacagtggtcagccggcagcatggatggggataaagggtgatcatgatgacaaagcctccccgggtttcattagcgagggaggttttataatctctccaaagtcacattactcaattcttacaggagccttctaaggcttgtaagattatttagtctttattttataat

SEQ ID NO: 169356 - DNA, 318 bp, Homo sapiens
ccatgttgcccagactggtctcaaactcttgggctcaagccatccacttgtttcggcctctcaaagtgctgggattacaggcatgagccaccatgcccagcccctgtacatttttaaatacataatgcttttgcacacttacagtacaatgtaaacataacttttatatacactgggaaacaaattgtgtgacctgctttattgacatggtctggaactgaacccatatatatctgaggtatgtctatatgtgaaatgtgcacataatgttttcttgtgctaagttccccagcttttgaatttttattttttttttag

SEQ ID NO: 169357 - DNA, 490 bp, Homo sapiens
acttgtcttgtttagtgtgacaagctggcaggtaaatgcaaatgatgtgacattttctgcaggaaattgttattgtcatttaccaacatgccagtaaaagttgatcaagtctgtaattgaatcctcctggatcattttttaaaggttggattattaggggaaaacattaggatttatagctcaacaatcaagttatcaaataactctactatttaactgaggccatatatgtagaagcaagaatgtattttcaagcaaacagcttctaggtgcaggagaacccacacagaaaaacttatactttgcaggagaaagaaaggacttcaggtacattttctacacaggtattcccccattataaacttgtaacaatagctgtaaatatttaattattttaccaggcttaagggaaatatttgttgaagaaacaacattcataagacttggttcaaaagcttttctagtacttagcagttaggccatgtcagat

SEQ ID NO: 169358 - DNA, 673 bp, Homo sapiens
tttgtatttttagtagagatggggtttcaccgtgttggccaggctggtctcaaactcctgacctcaggtgatccacccatctcagcctcccaaagtgctgggattacaggcgtgagccaccacgcccagcctcaactttttcaaagagcagtttatacatacgattttaaagtcttgaaactgtagttagcctttaacctagcaattacatttcaagcaattagcattaacgaattcatcacaaaaaattgtctccaacgaattaggggcttatccaacaatggagaggaaattaagttgtacatacacatgtatatagcaatttataatatagaataataatttttaaaaccatgtccttccaacaggggagacctcaaaaaggaaaggtagatcaagtatttgagagatccagtctcacttcatccttgttttaattacggtaccttcacatttttgtttgtacattggaagaaaagtataaggttttatttgaaaaataggttttactacttgaaaaaaatgttagctcttgcaataaaagaatatttgatgtcatgaatggttctttaagaccattggtgtaaaaattaagactatgtaacctgggtataatcctgtttttgcatataactaacaggattaaaacagcaggatatcactacagatactg

SEQ ID NO: 169359 - DNA, 587 bp, Homo sapiens
aaactttctttcctgagtatggaaaagtcttgatttcctatcttctattttttctgttctctcattttagaactccccattatttggatattggaccctgtagattaaaagttggcaaactttatctgtaaagaaataagtatttctgccagatagtaattattttaggctttgccggccacaaaatctcattcggaactcttcaactctgctgttgtgattggagagccgtagtgaatgagtgtggctgtgttccagtaaaactttatctactaaaatgggcagtggactggatttagcctgggggctatagtttaccaagatccctactccagatagatcctcttttcttttttttcctaattcccatctttcctgggaagcacagtattaactggcctgcctaccaggagccaagtcgggagggcccaggagcccatcgtttaggaggtaaactgactctccctgtcttcagtacagtactcccacccttggcttcctgtgtccagaatctccctcttgagcctctccagtcttctgcccgtggagggaaagatcatttcctagatgtgggcagtataattact

SEQ ID NO: 169360 - DNA, 416 bp, Homo sapiens
aaaacatttaaaaagtaaagagaaaaagaaaataagataaaatcaatatgcccactttcctcatctttaaaatgagagttgagctctagaaggtctccggttccttcagtctctaaaattttatgttctaagttaagtttttatttgttagttcccttttagccggcacattcccaaataagtatagccagatcagctttttttccccccgaatgacattatgaaagattttaaacatataggaaaggtgaaaagacaatacaacaaatacgtgtgtactcagcacatagattcagcaattgataacatctaccatatttgctttgtccctatgtgtatgcctgtccttgtcaaatcattttaaattaagttccagacatcctggccctttactccccgagatctcagcatgcgat

SEQ ID NO: 169361 - DNA, 371 bp, Homo sapiens
gacgcacacgtccgaccacacactgcacaagttcccgcagtgtaagaggcagggtctgtggcgctgggaccaggcagaagtgtggccccaaacagcacccctgggagcccctcggcatcatgctctggccagcaaagcccctgcggcagcggcagcagctgtggctgccatcatcctggacaccatgttgccttgagaggcaattgttccttcccccattccatgggcactttcccagttatgacacaggatgatctggtcccagtgctgtaatggggagtggggatcacaggtggggcaatggaggagctctgaaagtggctttggatatctcactacccaaaaggaaaggcattagccaccatggcccc

SEQ ID NO: 169362 - DNA, 176 bp, Homo sapiens
caatgaacctcaatagaaaccccggtcaccaagctctgaggggctttcttgttggcgaacacatggctatggcaggagagttagcaccctggccccattgggaggggtatggaagcgctgtgttcccgggccccacgggaaggggtatggaagcgctgtgtccctgggccccatgg

SEQ ID NO: 169363 - DNA, 296 bp, Homo sapiens
cttacagtattgcccaggctggtctcaaactcctaaactcaagtaatcctccctccctgagattacagacgtgagccaccatgcccgactgacagtgtttttatttcatcttcattttgaaagggtattttcttgccatagagaattttagtttcacagttttccagcactgtgaatatgtcttctcattgtgttttagctagtacagcttctaatgagaagtctgtgatgtcttatctttgttcctctgtgtgcaatgtgtctttttccctctggcaacttaagatgttttcttt

SEQ ID NO: 169364 - DNA, 452 bp, Homo sapiens
aaaaaccccaaataatccaaaaactcttgttcagatttccaaactggttcaaggtcaagatggaccaaaatttactttggctttatcttaaccaaagtcttcccaatcagtttcccaatatgtaaatgacatttttggtaaaagatgagcaaacatttcagaaatgagccaacaatttttttcttatccccatcataacttttaactgcaaaacctcaggacctggttcttttccaggctctgctgtctccatatagctgtgagtgtttttggtacaccaacacatctctgtatctgggccagtaaacttttttttttttttttggtgtagggccaagcctacaatgcatatgtccttattgttcatctgttgtaactttttccacaaaaagtgtgtgaaatttagattgtggacgttccagtctccacttctgagccttgagaggttgctg

SEQ ID NO: 169365 - DNA, 424 bp, Homo sapiens
agccttgtggtatctgatggactcttggttgtttctagctggtgctaaataaaccccttgacaagaagtatttgtgtaagaaagcgctggtaggcaaagtgagaacatccggaagtgattcatattactgtggttgtttgcttaactcaggacttggttgcctagagaccatatcgttgagttagccgagtgaagtgccagtggaacctggagggcctgtggcctaccggatcaaatcagggctctgctccttaatttttctcctgaagtctcctagcaatctgattgatctctgtggtttgacagtgcgtgaattaaaaaaatcttaaacatattaatgtttaagaaagatctggttaatggtttattttgaagagtaagagtttacttgctgaagtttgaatgttgggttaaaattttttaa

SEQ ID NO: 169366 - DNA, 325 bp, Homo sapiens
ctgccatttcctggcccatctcttcctgagtcgaaagttagtgcactggttctcatccctcactagatagaagatttgggctctgcttctgtttttatcagtttgttattaatacaaatgtcccatgccatctgtgggatgccctaagtctgttgcaaagttcaaaaacctattttaaaaaaaaattgtaccaggtgatttggatacacagccaatggtggagaagccctgttggaagctcctatttggaaatgcacaaataaattcacgtcaggtcctagaagggcatactgttgagtctgctatcaaaaagttttcccctcca

SEQ ID NO: 169367 - DNA, 373 bp, Homo sapiens
gcaagaattccatcagaagtagttaccttaaactaagtgtgactttctgactcacatttatgaatatacccagttagattatagaactgcaacatcatacttattaccttgaaattacatttttgttctgaatgaccaagccttgtaaacaatgtaagtactacctaacacacatattctgaaacaagctccacgttaagcgttggtttgtaatgggtgatatttggatagctctgattaaatatgtaaattatgaaaattagaagtggaaaaaaagttacctttgtacttgaaccagctacatattgatctttgactcaataatggatcattctctctcttatagatcttggtcttacacaagttttttctt

SEQ ID NO: 169368 - DNA, 479 bp, Homo sapiens
ttatgcctcctttcctatccaataccacttcttgtgttcaaattctccaatgacccctactttctatgttctatctcgtgctcagaggccttcaatagggactttgagaatagaaatcgagaaacggctcagaaccacaagagaccaggaaaaaaatgacccagaatgcatctctcttactttcagaagagaagcacactgagctacatcacttatcaaagggagcactctccatcatgctcagttgacatgtttcttttactgaggctttgatttgtgactaaataattatctaaaagttattcctgggtgaggccagccatggtggctcacacctgtaatcccagcagtttgagaggccaaggaaggcagatcacttgaggccaggagttcaagaccagcctggccaacatggcaaaaccccatctctacaaaaaatacaaaaattagccaggtgtagtggcgtgtgcctgtggtcc

SEQ ID NO: 169369 - DNA, 101 bp, Homo sapiens
tgccaagcctttatcttctgccatctgctcccactgtacaatgcagaaaagtttgtggtctgcacacatgctgggttagttcctgcctctgtgcctgtgct

SEQ ID NO: 169370 - DNA, 870 bp, Homo sapiens
tcaaagaggagttgctctgggtttacatgatacagaaccccatggtttatattaagtagtaatgatagccgtttttctggactcgcttaaaagccatacacagtgtcatggaaaagagttaagaacaaggtgaaattcagggtatggtattagagctcaggaggaatcaccttcagccttaaaactcttcctttactctcctggatcacttaagtgataggtcacttttaatataaatgttgcaggatgagttaagtggagccttgagaaatatgtgtagattgtttcagtgattaaagcaagtgttcttttcctggcctttaactcgctttatgctaagaagtgtaataactaaatagactcctaattgaattgacattcagatgtgtttgcagtttagggggagtttacctcttctaaattttcatttggatcccattactaaaagcagtattgcattagcatggtgcacaattatgtacaattcaatttgcaaatgaagttaatacttggagtatcttgacttcctattcccctgctgccccaatattcaagaaaggagaagttataatttgtcacatacaagatggtttcttctttaggtttattcttaataactatgtccattttcacatggatgacaccactgagatgatgaatacctgtattgattgattgatgaagaacatttatctttttctacctacttttgggaagctagcttgcaaaatctactgcaacattcactcttcatgtatccttctattaccttgggtaccctgaataaccttttaaaaatttttgtacttttctaatatgaagagaagtagcttcatattctatgctagttttctgaggtgcttgtgctga

SEQ ID NO: 169371 - DNA, 253 bp, Homo sapiens
  misc_feature (15)..(15): n is a, c, g, or t
gaggactccaacatngaggcacggattctggactcttctctttatcacatatcccacactgaaccctcagaaaagtccgtgtggttctgtcttcagaatatccagaacctgaacacttttcatcaccgtcatcatcatcattgtcatcatttgtctggattcttgctaatgtgcttccaactctgcccaccttgcaatctcacccacacggcaccctaaccatttctgcatggcctccgtgggcctctatgat

SEQ ID NO: 169372 - DNA, 416 bp, Homo sapiens
acgttatagagtcttagctatggaagagctctagggggaggggaagaaccctgaggtgtagtcctgggttgagtctaaactctgttacttcctatctgtgtgaccctagagaaaactttctgctcctcagttgcatcatctgtgaaatgtgactgataatacccaccttaaggctgtgagccttaaacaaggtaatgtgggaaatgcctagcacagcgtctggacatactaaatgctcgatacaatagcatggacctcagaggcagctgtggtgtcatttgttagtattttatgccgaacctgcgacctccaccattctctttgattgggtgagagtgaataagggtgtctgaggcagtgttgctgacttcttcccttggaagaggagaagtcatggggtctgggagctctttgac

SEQ ID NO: 169373 - DNA, 343 bp, Homo sapiens
aatgaatatttgactaataactttcaagtgatgccccttgcatcctgaggtcatcaaagaacacaattaacgagcgcattaatgagcgaaacagctaattttggagagggccattcattccctttcctttgattttattacactctggagccttcagtccaaggaaagttgcctgaagagaaaggaagtcaatgatgatttcatgttgaggcacgttttttgatcctgtatcaggaatagccccaaacccaatgagtacgcaggtatctttagtcactgcaaagagtaatttccacatgttttcatcagggctgccacttctcttatttaggaaccagaaact

SEQ ID NO: 169374 - DNA, 238 bp, Homo sapiens
gaaatcttttagaaggtacaggggagccccaaccctgaattcagtgtttctttgccccaacgctgtggtcactgcatctgggacggggctggactccgccaccacctcgctgacaaaggctgacaaatggggttcctggggttaggcctaggtcgctcattcagccttcagtcagatatgttgaaaggacgagaataagactggacaggaggcagggccgcttcatgatctcagtgtg

SEQ ID NO: 169375 - DNA, 424 bp, Homo sapiens
ctccttgtggttttcctcttcctctggctgctttttctatctcctccttttctagttcctcctactgtatccaacctctaaacactgaagttgttcagggatctttctggccccttcttctctcacctcacattgtctccaaataattgcatatttcccacagctttaatcattgtttgctaagtctacatctgcagctcaaaactctcctctgagctgtagacccctatatccagtgacccatatgtccagtgaataatgtctacgttcacgtgtctcaggctcacaagttcaacaggaatggaacccgtcttcctatccttctcccttcctacttttggggtgggggagatgctctttcagcaaatggtagtgccaaatatccagttgcttaagccagaaatttgggagctattctttgtca

SEQ ID NO: 169376 - DNA, 352 bp, Homo sapiens
tctgaggcaaggatgttttaaatagtcttataaaggaggagggacaccgccatttgatcatctcaatagatttaaaaataaaacagttttatagaatttgatataataaaagctgtcaaccaattaggcatagaaggaatgtatctttataccatataggcagtaaatgaaatacccacaactaacatcataatcaatgaagaaaacatgaaatattttcttcggaggtaaagaagccaattatgcccactctcagcacctcattcaacctagttcgggatgttctagccagtacagttaggcaagagaaggaaattaaaggcattcagatcggaaaagagggaggcaaact

SEQ ID NO: 169377 - DNA, 590 bp, Homo sapiens
aaatgctgaaagaccttataatgaaacatcacattccccaatctggacttccccactccgctggccaactttgtcgtttctgattttaattctactggtgattattttccacctctctaaataatttttgaactctctttctgggtatatcaacttcggatactattgattggcgtcccattatgagaggtgagctttgcagaccacaacctcccaggctctgatgcaagtgaacagaggatggcaccagctgctgcagttatgcagaggggctttccattcttagcaagagcactgggataaaagagatccttccaagagctcccacctaactgtgggaacacagaagcatcctttaaaagccctgtggtcacacagccttcagcatgcatacaggctcttttcttaactttataaagccccagataggctggtactaacatggtgcaaccctgtctctactaaaaatatacacaaattagctgggcgtggtgatgggtgtctgaaatcccagctactcaggagactgaggcatgagaatcacttgaacctgggaggcagagtttgtagtgagcagagatcacccctgt

SEQ ID NO: 169378 - DNA, 261 bp, Homo sapiens
ggaggttgcagtgagccaaggtcacgccactgaactccagcgtaatgacagagtgagactctgtctcaaaaaaaaaaattagtgttctaattttcacttaaacattaagttaaaaaaatgacattctcctttgtaattcaaaggagacatagtaagagtcatatgaccagaaaccatgttttaaaatttcataatttaccttgtgacatgtgtttatctgtgtaacaaaccttcacatgtacccccaaacttaaaaaataa

SEQ ID NO: 169379 - DNA, 351 bp, Homo sapiens
gcaaagaatcatcagcaaatatcacgaaaaaagcagcactaaaatggactaacagaagaagtagaagagaaccttaaaaatactaattattgtcttcagaaattgttaacaggacatcagattcataagtcaaaaagccaacttccctgaaaaaggaaagggaggacaagaaagtttctggaagttagagcatgattaatcaaaactgaaactcagaggaagggttgaagagcaaaatggacagtccctgaaatcaggtgatctgaaagatagccaaggatttctcagaacacaagaaaaaagagggatgaaaagtgaaaaagaaattagaagatatggataataaatcca

SEQ ID NO: 169380 - DNA, 1595 bp, Homo sapiens
cgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagccaaaaaaaaaaaaaaaaaaaaaaaaaaaaaaaaaaaaaaaaagaaaaaaaaaaaataaaaaaaaaaaaaaaaataaaaacaacaaaaaggggcgcggcgcgcccgaaaaaataccccccgctggggggcggcgccgacacatcagacgcgccaccccccagcgttgtctattgtacaaaacaagaggcggccgccccactaagaaggagcgggctattatatataaagaacgagagcgagcgagcgaggccgcgcgataaacacaaccgggagaccggacgtgtgtggagacacaacacgctgcccgctaccgcgagcgcttaggactctattcctttttgtgaagaaagaacgaccacccctctatcctactctatcggtggggggagggagccacaaccactatattatgggtcgagcgaacagacacacaccctctcacctatccaagagaatacattattttatatcaaagctcgcacgctcagttgggggggctaaatatattatactataaccaactatcttgacgagcggcgagactatctcatatagcgtgtgtgtgtacataccaccaaccagccagtcggccgactactagtatagaatcgagcatgcgaccagtcggttgaatacagaagaaaaattattttggctgcttgtccaacgctggaagtgacaatctatgattcaatgtcaagcacaacaactatctattaatacc

SEQ ID NO: 169381 - DNA, 872 bp, Homo sapiens
cgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagcc

SEQ ID NO: 169382 - DNA, 892 bp, Homo sapiens
cgccgacccgggaccgccgctggctggctgctggctcactcgaccgtcatggagaccctgggggcccttctggtgctggagtttctgctcctctccccggtggaggcccagcaggccacggagcatcgcctgaagccgtggctggtgggcctggctgcggtagtcggcttcctgttcatcgtctatttggtcttgctggccaaccgcctctggtgttccaaggccagggctgaggacgaggaggagaccacgttcagaatggagtccaacctataccaggaccagagtgaagacaagagagagaagaaagaggccaaggagaaagaagagaagaggaagaaggagaaaaagacagcaaaggaaggagagagcaacttgggactggatctggaggaaaaagagcccggagaccatgagagagcaaagagcacagtcatgtgaagattcctggctgcctcttccaggcagtcccccagagatgcctcttctgccccctaaaagcagtgccctggacttgaagcccgtgaaatgactccatctgggattcagaatacagtgttctcaagtgaagaaggcttggaacccaccccacctccctcattgggggctctctgggcaaacatggttttcatgcacccctcttcctgagcttggtccctgcctggtgattcttcttatactcggagagcatccctggttgaggagacacccgcaatcctccacgatctcatggctccacctgcttctccccactgcctgatttcttttctctctgcctgatgtctactgaacagaacttcccctctcccatgcacccactgccagctgagagctgcttcccaatggcctgcattaaagcattcgtaacagccctttggaagggctcctgtca

SEQ ID NO: 169383 - DNA, 434 bp, Homo sapiens
tcgaagataagatggcattgaaaggaatgtgtagcacatttaaagttgaatctgtgagcgatctccagtgactgtagttgttcacgtggtatatgacaaatgcagatgctcctcaacttacgatggggttacatcctgataaacccatcataagttaaatatgtgtttttgacttgaaggatattttcagcttacagtgggttcattggaacgtaaccccatcataagttgaggaaggtactgaatgtgtattgcttttgtaccatcttaaagttcaaaaattgtaagtctaaccattgtatgttggagaccaactctaatgaatatttctgtgtacttctgcatatataatatccttagaaaattaaaattatcccacagtaaccctcggaatttactgtggtgccctaggtactttcatacctagttctgca

SEQ ID NO: 169384 - DNA, 273 bp, Homo sapiens
taatggccccaccatccacacagttacgaaagctagaaatccatatgtcattccttctttctcacaatctgatcaatcaccaattcttgttgacttgaccttggaaatgtttctcaaataaatctggccttctccatccctgccaccacctccctcaccaggtccttattatccccaacacaaaccacagcacctgcctcccaatggtttatcttatttcaaattttatcccttcaaatctaccctccacagtggccacatcactacctccgc

SEQ ID NO: 169385 - DNA, 371 bp, Homo sapiens
aattacttaacagcttaagttttccgtgacaacttggtgccatcattaaattataagcatcaatcttactgtgttgctggaatagtctcctccttaatggcttctatcactccagcctttcttgttcctgtctggcttctttctaaatatttgttttccttagtgtgttgcattgagggcctttcatgcatcattgtcctggtgtaaatgttaatagcactcacaaactgtcccactttggatgacaaattaagtggctcctccaagagatgaaagaggatagataccatagggtttctaaaccaccttgcatgaaggaaaagacactccttcacataatcacctcaccattgccaccatcaccatcatca

SEQ ID NO: 169386 - DNA, 367 bp, Homo sapiens
gagagaaggactctgagggtcagagtggagagaggttgattcctgagctagtcttaggggtatggacaggtaggaagtgattaagttcgggaaagaggaatggccatgctggggacagaatccttagcagaacagctcagccataaggaaagagcagctgtattttggggagtcagtagacagcctggcctggttgccagagtcttgtgcctggacggcagatggggatgagatggttgtatgtgctgaatggttcagaggacctggaaaggtcctacagaggacctggaaagtcaggcagaacattgtaacttcatacaacaagaaagaaggtgctagtacagttttgtttttttaagcttgggga

SEQ ID NO: 169387 - DNA, 119 bp, Homo sapiens
ctctcctcacaggcaaacactgttataagtttcttgtttttcccttctagaaatattccatgcatttacaaacacaaaaatttgttcatttttagttttagtttttactcacataattg

SEQ ID NO: 169388 - DNA, 190 bp, Homo sapiens
agctggtaaggaatttggaaaagcgtcttccaatttccattagcattgcaatccctaatccctaactcgtatgctcacacctctgcaagggtattttcaaagccacttgcaggagcccacccggcatcgccaggggtgtgtgccggggacgggctaaggtgggggactggaatgtgagatgcgccgcagg

SEQ ID NO: 169389 - DNA, 427 bp, Homo sapiens
gtgtgtgtgtgtgtgtgtgtgtgtttcaatgtattttatccatatcccttgatatacactttggttgtttccacactggctattatgactaatgctgcaatgaacaagagagtgcagatatcgttacaaagggtggtttcattacctttgagtagatacccagaaaagggccttttgggtcatacagtaattctatttttaattcctataggcacctccgtactgtttttcacagtggctgcacctatctacattcccaccaacaatgcacaaagactgccttttgtccacatccttgtcaacacttattatcccttgtctttttgaaatagtcatcctaacaggtgtggtgtgatatcttattgtggttttcatttgtattttcttgatagtgatgctgatcatcctttcatatacttgttcacca

SEQ ID NO: 169390 - DNA, 402 bp, Homo sapiens
ggcagcagcattttaatacacatttgggataaatattctctctatcacctccaccgaagattcacattcttctcagttatcggttctattcaaatttctatgcttttctcaagccatgtcctttgttttctttccctctgtcaactcacgaaggtgtccgtccttaccaagactgtgatttcctgcagaatctccgaatcttgcttttcaggcacctctccctctagtctcacacatcttccattgctcccttctcacatgttctgcttatgtggttcttttattcctccaaataggctcatgtctcccctaaaaagggatcataaacatcttcccttcttatttccatctcatttcttttctattcccaacaaaatgccttgaaaaaaatagtctctactc

SEQ ID NO: 169391 - DNA, 350 bp, Homo sapiens
ggcatcattggaaaaactggtaaaactggaatttgtattgttgattaaataaaagtatcatatcaatgttaaatttaatgaacttgataactgtacaagggtttttatcattgttcttaggaatatacattaaagtattaaatactggcagagtgcagtggtactcccaaaatcccagaactttgggaggttgagctgggtggattacttgaggtcagaagtttgagaccagtctggccaacatggcgaaaccccatctctactacaaacacaaaaaaattagccaagagtggtagcacgtgcctgtaatcccagctactcaggacgctgaggtacaagaatcacttgaa

SEQ ID NO: 169392 - DNA, 604 bp, Homo sapiens
aaggtaccgagaacagccttcttttcacagtgatgagagagccaggggacatgtgtgtatgtgtgggggggtgacctgatagagttacatttgaggacatcaggagctgcccagagaagagagtgagaactcaaagcttggagaacaattacaaggggccggattaattgatggactaaagatagtttaaacttctggaagtcagctcttaacaaagctccatgtgggctatctgtgaaggaaaggagtatgtcagacctgcttagattaagttttaaaatctttgtgtatgcctatatgtatgcctatctgtctatcttgacaggaaacacaggatttctacatcagagacagattgtgattgctcagagcatcttgcctcagttttcccatgcctccgtcctctttggggcaacacaatgagggcaggtgttatctacatgaataatgcagttagtaccacaaaaaaggaacactggatttatgaatctcagaacttaagtagggcattaggcacatttccccctcctccgctgcagggagagagagggaaaagaaagagaaagagatagagggaaagacagaaggggagggaaagcaagtg

SEQ ID NO: 169393 - DNA, 207 bp, Homo sapiens
tttcacttcacctccctgtctgtgtacagctccactgcaagcactgctcacagatgccgattcgctcacattgaaaaggtcctattccagctccaggatcctccttttctgaagagcctgtccctgcatctctttggcagtcatgttctgactgcggcctggtgctcccctaacctgcatggaataaatttaaagctaagagataac

SEQ ID NO: 169394 - DNA, 320 bp, Homo sapiens
tgaaattatacaaagagaaagtaaatttaacagtgcctacaatcatgtttttctagtaaatttcttcatttccattaataaaactccacaaaggtaacataaaagtgaaagagatgattggttacattctgaacccaatggtgagtttggtgattttattgagtttatttttgaaaataacatctccatgaaattcttaatttttcccactctttccagcctaaagatgttggtcattcattactgtgatcttcaatctgtgtgatgttcattgacactgtggtttcagagttctaatttcccccttttgtcctattttc

SEQ ID NO: 169395 - DNA, 340 bp, Homo sapiens
aactgaaatttcaccaaaagtcccatatctgaagcaaataaaaaaatttagttcccatattctttccaatagaaataattccttcgtggagaatttatgcctatctcgttcctatgacaaaaaggaatttggccagcctggccaacatggtgaaaccctgtctgtactaaaaatacaaaaaaatgaactgggcacggtggcacacacctgtaatcccagctacttgggtaaaagaattacctgaggtaaaagaatcatttgaacccaggaggtggatgttgcagtgagccaagatcgcaccactgcactctatcctgggtgacagagagaccttgtctca

SEQ ID NO: 169396 - DNA, 999 bp, Homo sapiens
tgggctcaagcaatcctcctgccttagcctctcaaagtcctaggattacagtcatgagccactgtgcctgttttttttgttttgttttttgagacagagtccctgtctgtcacccagggtgactgagtgcagtcacaatcttggctcactgcagccgcaacctgttgggctcaaatgatcctcacacctcagcctcttgagtagctgggacttaaaagtgcatgccaccttgcctggctaaattttcttctattttttgtaaagacagggtctcagtgtgttgcccaggctggtctcaagctctctgggctcaagtgatcctcctgcttcagcctcccaaagtgttggcattacgggtatgagcttccacacctggcctccaagttttggtatagtttttttgtgtgtccatttttgaccagattagctaacctagggaagacatgtctgatgaaatacacacacacacacacacacacacacacacacacacacacacacagagagtctgtgtgtagtcgaagacgagagggtatacattcgtgagagagtgtataagtgagggcacttgcgacgatgagagtgttgtttatacacatcatagaagatatagctctcatacacatgtggggtgtgtagtggcaagaagtcgtgtggcgcgtggggtgagaaaaatgtgtgacgagtgtgctgagtgtgtgaatacgtggagggcaaagttgtaactatatgggaaggtataatgggatgagtgtgtgagagagagagagtctcgacatgtgtctcacagggtggagagcagagagtggcgtgatcagtggcatcagcggcacctctacaaatctccggggctccacgagatccgtccattcgcggcctcccccgggtgtctgaacgtggagtagtgtgaacacacagacgccacagacagtgtgcgggacaacgaggcacaagacacgcggtccggccgagacgccgggtaggcccccacacccggga

SEQ ID NO: 169397 - DNA, 539 bp, Homo sapiens
tgggctcaagcaatcctcctgccttagcctctcaaagtcctaggattacagtcatgagccactgtgcctgttttttttgttttgttttttgagacagagtccctgtctgtcacccagggtgactgagtgcagtcacaatcttggctcactgcagccgcaacctgttgggctcaaatgatcctcacacctcagcctcttgagtagctgggacttaaaagtgcatgccaccttgcctggctaaattttcttctattttttgtaaagacagggtctcagtgtgttgcccaggctggtctcaagctctctgggctcaagtgatcctcctgcttcagcctgggcgacagagcacgactccgtcttaaaaaaaaaaaaaaaaggatctacttgagggtggaggtaggcaggagagggcgaggatcaaaaaacattacctattgggtattgttgtgcttactaccggagtggcgaaatgatctgtacaccagtccccttcgacacaccatttacctatataacaaacccgcccatgtactgctgaa

SEQ ID NO: 169398 - DNA, 808 bp, Homo sapiens
gcgggaagatcagttgagcccaggagcttgagaacagcctaggcaacatgacgaaactctgtctctacaaaacacacacacacacacacacacacacacaaacaaacaaaaattagccggttgtggtggtacgtgcctgtacctcccaaagtgttggcattacgggtatgagcttccacacctggcctccaagttttggtatagtttttttgtgtgtccatttttgaccagattagctaacctagggaagacatgtctgatgaaatacacacacacacacacacacacacacacacacacacacacacacagagagtctgtgtgtagtcgaagacgagagggtatacattcgtgagagagtgtataagtgagggcacttgcgacgatgagagtgttgtttatacacatcatagaagatatagctctcatacacatgtggggtgtgtagtggcaagaagtcgtgtggcgcgtggggtgagaaaaatgtgtgacgagtgtgctgagtgtgtgaatacgtggagggcaaagttgtaactatatgggaaggtataatgggatgagtgtgtgagagagagagagtctcgacatgtgtctcacagggtggagagcagagagtggcgtgatcagtggcatcagcggcacctctacaaatctccggggctccacgagatccgtccattcgcggcctcccccgggtgtctgaacgtggagtagtgtgaacacacagacgccacagacagtgtgcgggacaacgaggcacaagacacgcggtccggccgagacgccgggtaggcccccacacccggga

SEQ ID NO: 169399 - DNA, 469 bp, Homo sapiens
gaggttcagaaccagggaaaagataaattagatttggaggcctagatatggttaaataattaattagacatgaaaccctatggctgaacagttcagttgaatgttgattttagtagtgatatgatacagaagctaagctttgttatagtcacgcaatgttgaggcatggttaatatatttagcaggattatgaagagttcaggcattttttggaaactcctatgaatatgtcatctagaattggttttgtaaaatggtagtgcttgtactgtttagttacatgtgttgaatatcagatggatttcagtatttttttaaaactttgcttaagcctcttaagcctcattgagtggggagactgcagtgtaagtatccaggctgaagactgaacttccaccttatttttatgtggtaatgagtttttgtttagatgatatatatgttttaatgttgagatggaaaaagtaga

SEQ ID NO: 169400 - DNA, 300 bp, Homo sapiens
aattaaggatgatgcaggagacagacctataagaatgacaaagctgagagtaaccttagagtctcccttgtccatcctgtgcattgaatttaagtggagagactgaggcctagaggtaggaagagactgcagtaggttcacacagttcatcagtgacagagcaagatgagacttgaactcatgtcattgacttccagtacagtttacacccctggttttacagatgaagaaactggccctaggagggataaatgacttgcccacttcattcaacaactgtgtaccaaacccatttccata

SEQ ID NO: 169401 - DNA, 427 bp, Homo sapiens
tcagagtgggtgttcaatagaactgctgaattgatgaacattcagagactgtacttttgcattctattttgcacagctattacctacataaccaaaacttttatcaacatcaattagtgtttcttagcattaaccagaatggacatagctaaccttaaatctacactcagttcaacaaatacttactgaatatctctatgtgccatgctctgtggtaggtactgggaacatcacttttgctttccaggtgttctctcaaaattctaatacaatgacagagagtacaaaattgggtgggtgcactaaagaatgagaaaagaagtctttctgacaggatgtctaggccaagtcttaagttagaatgagacaaacgcaggtaaatgaagtacattctgcattgaagaaagagcttgagcaaaggtgctga

SEQ ID NO: 169402 - DNA, 438 bp, Homo sapiens
gatgccgtatatagtgttctccttccagtataaggtaatctggcagtttaccttagagtttaggaaactaccttggaatagagtcctcttttaaaataatggtgcagttcttccaaggtgacaattactgttagctttttcctgggtctgtaataaatgtagcattaaatttttttttttttgcgtttttaagagcagcataagaatgtcatcctttgagcttgattttaaatgaagatatcagcagataatatactcgaagaatatttatagtggctccaaatgagacagtctaagtcattcaatagtaatagctaccaattggttttgtgtttcctattcacctgtagcagtttgttagacattgtgatatatatctggagttcaaaccgtcccaacggttacatagaagggcatgaagaagaagagatagcaaaa

SEQ ID NO: 169403 - DNA, 348 bp, Homo sapiens
tattagttactctcttcaatcttgttgaattggtctaaacatctttttgtttttttcattaattaatgaattaaataaaacttttgacatatgttcattacaaaaacaattaaaaattatttgttgaactcaatatctgaattagcttaaaatcagaatggagatgacagggaggaattagcaatcttaaagatggatcagtagaaattatccaagctgaacaacagacagaggaaagataaacaaaacaaaataatgctcaaggacctgtgggaggctactaaaaggtaaaacatttgtgtcattggaattatacaaggaaaaaagaaaaagaagtatagtgcagaa

SEQ ID NO: 169404 - DNA, 336 bp, Homo sapiens
acttatccctgtatctgcacagaggggagagagagggatagctctcttcctcttcttataaagactctagagccattatgggggcacaactccaacgacctacttacctctcctcataatactaccttgttggggtttagaatttcaacctatgaatttggggggatgtaaatatgcagttcttaataataatgaactactattagtgtataccaatgtttggaccccatcattttcctaatgcccaatttcacctgtcacccaacagcttggtattgttattagacagtttgatattctgtgtgatgcttaattaaaacaggacacatagatagt

SEQ ID NO: 169405 - DNA, 488 bp, Homo sapiens
ctccgcctcccgggttcacgccattctcctgcctcagcctcccgagtagctgggactacaggtacccgccaccatgcccggctaaatttttgtatttttttttagtagagatggggtttcaccgtgttagccaggatggtctccatctcctgacctagtggtctgcccgcctcgacctcccaaagtgctggaattacatgcatgagccactgcgcctgaccctatttagtcttaagtaactaactgaattactagtaatttttaaaaggttggaatggtgggccaaacagtaagatgaagtttcgacgagtaggtcagttcttttccttgggtccaggaaactattgagcagcaacagaagatcagagcagagatgtggctaaacagtagcaggtatgaaaagacttagaggttctggtttctgtaagcttcaaatatctgtgatgcttgtgccaaaacagcttaagtagactgtattgtttgagagt

SEQ ID NO: 169406 - DNA, 203 bp, Homo sapiens
tgtgtgtgtgtgtgtgtgtgtgtgtgtgtgtgtgtattctgcatgttttgcttattgtatcgtttttcttggatgttgtgtatttgttttaatgtttagaacttgttcttttatttcagaacaatatgaacagaacacaatgttgaagaaaatacatttactttgtacccaattctatgcatattttcttctgctttccagtc

SEQ ID NO: 169407 - DNA, 360 bp, Homo sapiens
cttggactatgctcttgaacattgtgcttaatagttttatgtatagtactgcaattgatgaattaaaattatagaagtacctacttcattcccctcccagagatgcttatatcagtaagtaacatgctggcagaattaaggtgtctgcttccagttcagccctcttttatttcttgttgctttctgtgattcggcagctatggaatttgcctccctgcatgggcctctcaaaagccagctctcctgctctccccaacatgctcacagtcagcagaacagggaaatcacactgatcagcacaccactcagttgatcaaagtaagccggccacttttcttcaacaagacccagtggtattag

SEQ ID NO: 169408 - DNA, 356 bp, Homo sapiens
catccatatggatacaaatggatttagcaataatgtttttgttagctcagtctttggatcagatgcggctgtacacaaatagaatgtgctggatcatcctgccagcatggataaaaatgcatatatgcaacctttggcgtaaacagatgtgtttcaacctgtgtttatccagaaggaaggagtaaacactaccttcagctcagcttgattgtgctctaaagtgatcggtcagtaaaaggacgtggattagaactacagtgcaggcagttgggtaatgcttgtgaaaataacaaattctatctggttccctagctaagttccttttattttatttatttgatttggctaattggctg

SEQ ID NO: 169409 - DNA, 613 bp, Homo sapiens
gtgggctaagaggtaaaactgagattgttatgtagatacttaaataactagagagaaataaaatttgcacgaaaattttattgacaaaattcaaaacaataatttagaacaattttttttgtaatacgggtttactaatgaaaagaattaaatatttacagggaggatcaaagttaatgtttcgtgtcattaaagttgattgtaagtactcatttgttaatgctgatctgtaataagattttatgtattttacttctgaaaattccttgcagataggtattgtcaaatacttacattaatccatgagaatatgatttttgttgagcatattcatcacttgaaaggttacttcttctctggatattttccttttagcatgttattacattgcagcttaatcacttccaattgaagactaggcagaagctcctcaattgcactgttaaattgattttgaaaaatggaaatttcctttacatttgcaaactccaaaaaatactgcaggcactatggtgtgagctacaaatttgtgtgagagtggagatctcgcttctttgtcttaccttttgatagcacaggaaatgtgtaaagcagcttgttgttacttgtaatt

SEQ ID NO: 169410 - DNA, 280 bp, Homo sapiens
caacagtgaacacaagaagcaactaattgtaggcaaagtgacagagactgataacctgatacataaagatggctttgtttctttacttggccaatgattgaggcctgtttagaggggaagtgatgtctcattcaagcaacaggatgatagagcttcagagacagagattatgaacaatttaaaaataaaacatacaatggccaaaagaagggagtttggatttaggcaagtctgacctcaagtgtagctttttcactcaaatgccttggaacactaggag

SEQ ID NO: 169411 - DNA, 192 bp, Homo sapiens
gcatttaactgcctgtgcaaaatcctccagagctcttttttccctctggcttagcaactaatattttatatggtggtcaagcatagtggctcatgccagcaccttgagaggccaaggtgggaagatgacttgaggccaggaattcaagaccagccttgggtaacatagcaagtcctcatctctaccaaaaaa

SEQ ID NO: 169412 - DNA, 258 bp, Homo sapiens
gccagtattcagtggaccactccacatcatattaaataaaatttaaacacagcattttgaagccgacagtatgggtcactgtgtgtcctgtgtgccctgagcgtattgtagagtagttgttgagtctgctgccttatctgtgtgttatgaggtcaatgcactgatcacttgcttttttcacttctatactaactctaggcacactttactcccagtcaaaagtggactgtatacttcctctttgatgtgatggtccct

SEQ ID NO: 169413 - DNA, 562 bp, Homo sapiens
attcaaaacatttttgttcccaaacattttcgtaaacaaaacaaaacaaaacaaaaaaactggctgggtgcagtggatcatgcctgtaatcccagcactttgggagactgaggcgggtggatcacaaggtcaggagtttgagaccagcctggccaacatagtgaaatcctgtctctactaaaaacacaaaaaattagtcaggtgtggtggcgagcatctgtaatcccagctactcaggaggctgaagcaggagaatcacttgaatccgggaggcggaagttgcagtgagctgagatcacaccactgcactccagcctgggcaacagagtgagaccgcatctcaaaaaacaaacaaaaaaaactcaacctgtacccaaacaaaaatctcaaatttcttccgtcttaaataaaaattttttttggctgggcgcggtggctcatgcctgtaatctcagcactctgggaagctgaagtgggtggatcacaaggtcaggagttcaagaccagcctggccaagatggtaaaaccccatctctactaaaactacgaaaattagctgggc

SEQ ID NO: 169414 - DNA, 374 bp, Homo sapiens
taagtgtgtactatgccagacactgttctaatcattaacataaaaagctctcattcaatcaatcctcccatggttctctatgaggaaggtcctattcagagccccattttacagatgaggaaactgaggcatgaaggtgttaggcaggtgatggagtgggctctcagcctccaagatccggtccctcaacctcgggctgcacttggcactggcctcagagccggggctccctgaggtccggcgggagggtcggaggacttggggacagccccactcagtgcatctgcaggcacagcatggctgaatgcagacctctccaagatcactccaggttggacagaaggtggatttatctgctgtttttctgttgtgac

SEQ ID NO: 169415 - DNA, 259 bp, Homo sapiens
cttggttttcttttgctgtagcctcaggcctcagaaccttactctgagattggtaatgtgttttgaatgtgtttatcacagccagatggggcaaggctcagtttgttactgcccattattgcaagggaagggagtccatccagaaaacaaagctttgggagtttcagttagttgggtgacactaccctggtatcaaaggaaagatggtttgattggatgacattgtattttctttaaatcaatcaaaatgatacaatta

SEQ ID NO: 169416 - DNA, 230 bp, Homo sapiens
cttggttttcttttgctgtagcctcaggcctcagaaccttactctgagattggtaatgtgttttgaatgtgtttatcacagccagatggggcaaggctcagtttgttactgcccattattgcaagggaagggagtccatccagaaaacaaagctttgggactctcccgctatgcttggcgactcccccttgtatccgacgcccgatgttgccgtctccccatttgcggtc

SEQ ID NO: 169417 - DNA, 190 bp, Homo sapiens
aggcgtggacagtaggccttgggaatatgtaatgcatacagaggttgactcctcccattctttctttatcttccaggatgtaatacttatgcatgcatattcatattcccaggcccttcatgatctagctgcttcctctctgcccacctttattgctggccagtctttcacagtcaccttaacttgcagc

SEQ ID NO: 169418 - DNA, 141 bp, Homo sapiens
tgtgtagtaagtagtaagtaggaactgctacagaacattttaagcaatgattgatggtactgtatctcctcatgaatagaaacaattttttttattattctctactatctatcttcagtcttctttcattctaatctattt

SEQ ID NO: 169419 - DNA, 665 bp, Homo sapiens
acattcacagcacgtgggtctctccattaggcacattcagtccatcttgcattctttcttcccaccctgactgctcagagaaatgtaccccacctccctagccctctgtgcttcaagtcttcctttgacccccttcgctctcccacagcagggctctcagctgccagccaaccaagcagatggtgcaacaaccagacctaaaggaaggacctggggaagaagagaaagggagcctggcaagtctgagcttagggagtgggtctggacctcgtgaccattactccatctgctaccccacgcttccttaggcccccaccctctggctagcttgagaggaaggacgatggtcaaggtacatgtctcttctcctctgactctgggaatgagatttttctactcccacaggcttgaactctccttataggagtgtctccacatgccaaaatcagaggaagtcagaataaaacctcccaaggctgaaaactaggctggtggaagggagctcccttccaccagcccttgaaatcactgtttgtctccacactttttccctttttagaaatttcatataaatgaaattagacattatatagtcttttgtatgtcttacacttggcataatgtttctactattcatccatgttgcttcatggatcagtacgcca

SEQ ID NO: 169420 - DNA, 204 bp, Homo sapiens
aatatttgtctcctcagcaataaaggactgcaaaaatttaactatttttttggtcctttttgaactacctcttcaatttctgctttgagtagcttcagattttgactaatgtcttcaggggtagactgcatgttctttagaggtccctcaagtttcagattttgtcacaccaacccttgttccattgccaaaagctctgttttt

SEQ ID NO: 169421 - DNA, 360 bp, Homo sapiens
cacatgaaaccatcaatgacagcaaacaagaaatatccataaaaatttggaagccataaagcagttagacaatggtgactgacttagcaggctagagaaagctaagtgcctaatgaggatgaaggcaagaaccaagtttatctgtaaagaacattggttgagactcaggaattagaagcatcaggtgcttgtgaatgcatgggtgtaggtgtattgggccattcttgcattgctataaatacctgagactgggtaatttataacgaaaagaggtttcattagcttacagttctgcaggctttacaggaagcatggtgctggcatatgcttggcttctcgggacacctcaggaaacgtacc

SEQ ID NO: 169422 - DNA, 450 bp, Homo sapiens
accatcccccctagcgggctagcgggtgagtgagattgttgcatgtttactagacagatgaaaatatcagtgacctaaagatcttctggaaacatttaaaaaatcagcttatcttttaactaaccaaaggttattttcttatcaccttttaaagccattaatggaaagatttttgggaatctccatggcctcataatgaacgaagatacaatgacaaactggtatttgttagggataggaagtgaagtggacatacataccatccattatcatgctgagagctttcttttcaaagtaagtataaggaaagtgctttgggaaagacgtttttgaactaacaaattcaatgtatttccagtggaaaataagagttacttggcaataatgcttgtgaggataggtgagaatggaacagaataatgtgattgtaccgtttccctggtggatatt

SEQ ID NO: 169423 - DNA, 2784 bp, Homo sapiens
gctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgactcctccttttttagtaaggaagaaatgagctccatgcctgatgatgtctttgagtcccccccactctctgccagctacttccgagggatcccacactcagcctcccctgtctcccccgatggggtgcaaatccctctgaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggccctacttcacctactggctgaccttcgtccatgtcatcatcacgctgctggtgatttgcacgtatggcatcgcacccgtgggctttgcccagcacgtcaccacccagctggtgctgcggaacaaaggtgtgtacgagagcgtgaagtacatccagcaggagaacttctgggttggccccagctcgattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggagactttggccacttttgtcaagtggcaggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacatggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggcaaaaaaacaacaaccacacaaaaaacagggggggggcagagattcccgggggccaatttccgtcccgtttgtgaagggcccaagggcgcaaaaacaggggggcggtaaagcggaggaaaggggctggggagcccctggggcgtgccccgaaaccggatg

SEQ ID NO: 169424 - DNA, 392 bp, Homo sapiens
ggacaaactgtgatgtcatgtgcaaaggccctggggctggaagggcaaagtacatcccaggaaatgcaggcaaagaggccagagaggtggtcggtcaggcaaagctttgcagccagcaagagggggtgattctggaatttgtcccaaggccagtggaaagctatcaaaaggttttaagctaggagagagatgcttggaggctcgtcttaaaagttcctctggtttgagatgagttgacggggcagaacagggagcccaggcgagccatgtgaccaggccagggtggccctgtggccgggactgggggttgggataggagctcggctcagctgacccgaggtgtctctgcacaggccctacttcacctactggctgaccttcgtccatgtcat

SEQ ID NO: 169425 - DNA, 2626 bp, Homo sapiens
gctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgactcctccttttttagtaaggaagaaatgagctccatgcctgatgatgtctttgagtcccccccactctctgccagctacttccgagggatcccacactcagcctcccctgtctcccccgatggggtgcaaatccctctgaaggagtatggccgagccccagtccccgggccccggcgcggcaagcgcatcgcctccaaggtgaagcactttgcctttgatcggaagaagcggcactacggcctcggcgtggtgggcaactggctgaaccgcagctaccgccgcagcatcagcagcactgtgcagcggcagctggagagcttcgacagccaccggccctacttcacctactggctgaccttcgtccatgtcatcatcacgctgctggtgatttgcacgtatggcatcgcacccgtgggctttgcccagcacgtcaccacccagctggtgctgcggaacaaaggtgtgtacgagagcgtgaagtacatccagcaggagaacttctgggttggccccagctcgattgacctgatccacctgggggccaagttctcaccctgcatccggaaggacgggcagatcgagcagctggtgctgcgcgagcgagacctggagcgggactcaggctgctgtgtccagaatgaccactccggatgcatccagacccagcggaaggactgctcggagactttggccacttttgtcaagtggcaggatgacactgggccccccatggacaagtctgatctgggccagaagcggacttcgggggctgtctgccaccaggaccccaggacctgcgaggagccagcctccagcggtgcccacatctggcccgatgacatcactaagtggccgatctgcacagagcaggccaggagcaaccacacaggcttcctgcacatggactgcgagatcaagggccgcccctgctgcatcggcaccaagggcagctgtgagatcaccacccgggaatactgtgagttcatgcacggctatttccatgaggaagcaacactctgctcccaggtgcactgcttggacaaggtgtgtgggctgctgcccttcctcaaccctgaggtcccagatcagttctacaggctctggctgtctctcttcctacatgctggcgtggtgcactgcctcgtgtctgtggtctttcaaatgaccatcctgagggacctggagaagctggccggctggcaccgtatcgccatcatcttcatcctcagtggcatcacaggcaacctcgccagtgccatctttctcccataccgggcagaggtgggcccggccggctcacagttcggcctcctcgcctgcctcttcgtggagctcttccagagctggccgctgctggagaggccctggaaggccttcctcaacctctcggccatcgtgctcttcctgttcatctgtggcctcctgccctggatcgacaacatcgcccacatcttcggcttcctcagtggcctgctgctggccttcgccttcctgccctacatcaccttcggcaccagcgacaagtaccgcaagcgggcactcatcctggtgtcactgctggcctttgccggcctcttcgccgccctcgtgctgtggctgtacatctaccccattaactggccctggatcgagcacctcacctgcttccccttcaccagccgcttctgcgagaagtatgagctggaccaggtgctgcactgaccgctgggccacacggctgcccctcagccctgctggaacagggtctgcctgcgagggctgccctctgcagagcgctctctgtgtgccagagagccagagacccaagacagggcccgggctctggacctgggtgcccccctgccaggcgaggctgactccgcgtgagatggttggttaaggcggggtttttctggggcgtgaggcctgtgagatcctgacccaagctcaggcacacccaaggcacctgcctctctgagtcttgggtctcagttcctaatatcccgctccttgctgagaccatctcctggggcagggtccttttcttcccaggtcctcagcgctgcctctgctggtgccttctcccccactactactggagcgtgcccttgctggggacgtggctgtgccctcagttgcccccagggctgggtgcccaccatgccccttcctctttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggca

SEQ ID NO: 169426 - DNA, 473 bp, Homo sapiens
gctactcccacctgccacgccgcaagagaatgtctgtggcccacatgagcttgcaagctgccgctgccctcctcaaggggcgctcggtgctggatgccaccggacagcggtgccgggtggtcaagcgcagctttgccttcccgagcttcctggaggaggatgtggtcgatggggcagacacgtttgacttctcctcctacctctgccctgtgagcccatccataaggctctcagatgggacattgtgggaaaggctttggccatggtctgggggcagagaacaaggggggagacacaagtagacctcaggtagaacgacactgggcggagccaccccagggcctgctcccagggagtgctcgaggcgcatcaggcccgttttttaccagtttatatcacggtcttcatttttaaaagtaacgctaactttgtacggacgatgtctcatggattaaataatattctttatggca

SEQ ID NO: 169427 - DNA, 452 bp, Homo sapiens
ttttggtttgtttaatcatatctgtctgattcagcggagataaaacgtagataaaataaatgcccagattttaagcattcattaagttcagtgagttctgacaatcatatacacttatgtaactactatccaaaggaaaatataggccgtttccatcatccaaaaagttcccttgtacccttttccactgggctcccatcctctaccagctgaggcaaccgttttctgatgcctgtcaccacttttgcatgttcttgagcttcaagtagatgtaacttacagtatgcctatgtctggcttcttttactcatggtttgagattcatccatgtttttctgtgtattggcaatttgttcttttaaaaattgctgattagtattccactgcaccaaaatatatagcagtttgcttatctatttccatgttattaaatatttgggtgatttccagtt

SEQ ID NO: 169428 - DNA, 256 bp, Homo sapiens
tctctacaaaaaatgcaaaacttagtggggcatggtagcatgagcctatggtcccagctactcgagaggctgaggtgggaggatggcttaagcccaggaggcggaggctgcagtgagccgagatcatgccactgcactccatcttgggcgacagagcaagaccctatctaatacctttctgcagttgtcagggagagctgcttgggagtttctctgtggtctacgcccttccctagatgagtgcatcagaggaagg

SEQ ID NO: 169429 - DNA, 112 bp, Homo sapiens
tccaagggctgcacccccagtgaaaaggaaaaccatactactatgcccatgcccactcccctgtccctccaagggcagtaagcaaaactgccacctctagcattggtgttgg

SEQ ID NO: 169430 - DNA, 468 bp, Homo sapiens
taaaactagaatgtgcaaagctgcaggagactggagagtgttcggcccagcctctcattttacgaaggaggaaactgaggcccaggagacagggaattgtctagggtctaacagccagtgagaggcagagtaggtcccaagccctcatctgcttttcctgcccttgtcccaccgcaccaagttgcctgtcttccatgtcatatggagagtgataaagggacaggactacacctggaattacccttgggcttcttgctgaactaagtaaatttggcttcactctttgtgactcaaggtataggaaggatgagccagaaggaatgctgtgttttttcacctttttttccctcgagagagccggtggctgcccagagtaactgcagcattgcatcccctactttttcagaatctgacttggccttctccccagctgctcttaagcctggtgacagagcgagattcccctca

SEQ ID NO: 169431 - DNA, 875 bp, Homo sapiens
tgggctcaagtgatcctctgggctcaaatgtgatctcactggattctctcaagggaggaataggacaaattgtcagcttctgttgagaagataatactctcactatgataaatgccaagtttctattgaaaaccaccatcttaatggtggtgtccccaagcactcagtgcttgcctggcagccgagaccagaggagaagcagaggaaagcagatatttgtagggggttgtttgtttgcaatgagaaatcagttcaaagcaaaggagatggtgcattaaaaatgttcttttaaggcagctttaaaaagctaactggagtgctccagtgtggcctgatcttaaaacacacctatggggagacttccaccctcaataaatatttcttgcatatgacttgaattaaaggaggcacatggggctggaagccgcccgaaataattttccctcccataggaagcagccgctgtaattcacttgcaagttatttcaaaaggcctgttctgatagaaattgctgccttctcgtggactgggatttttctcgtactgtctgtgacatcccttcttgacaagggtgtgtccgcccatattttacaatgcaccactccctcaaagagcgtctcggtttgttgttgcccttttttgggggtgcttatgctggtttctcttagacacctgagtgtggctgatctgcctcacagcctacactcagggagaccttcaggttagttaagggagttcctggggtaggggggctggacgacagtacattcaggagctctaagaatgctggtgatcatgggaacaactggagggggaggaagaaggtctcttatcagctgctgttgaaaggtcctaaggtggttgtgcttgtcca

SEQ ID NO: 169432 - DNA, 269 bp, Homo sapiens
agggaaatgatcaaaaataggggtgggttttctgggcctggggctgcctccggtcctcagtgctaccttccctcattctgcccctctgttctcttgctgtcctccttctgccccctgtggccatgggactgcccccacaggttctggggacattttctgagccccctgcacctggtacagccagcccagggctcagtgggggaagtgctccatcagtatttttttgatggtggtaaataagattcatacagctttgcagtgtttgattg

SEQ ID NO: 169433 - DNA, 549 bp, Homo sapiens
cacagcttagtctgtttagacactgcattaaaaattccaaattaggagagtaaaaacaaatgaagttttcgccatcgtggggcaaacattacccactctcatgcctccctcttcatagctagctactagagcagccttcaactgatgacggatgaaatgggtagatcaatgcatcagcttccttgttccttaggcatgttctactgtttcccagaagtcttcaataggattgagctctagtcgcccatgctgaagcttgctcattatcacaccttatattggcttttttctcttcctgctcatgtacctaccctgcagtggtgcttcctggggtcacttcccaatgaagctacttcacctcaaatccttctcttagtgcatgccttggagggaactcaacataagacaatttgaaataaaggccttgaccaggctctgtggctcacacctgtgatcccagcactttgggaggccagggtgggcagatcgcttgaacctaagagtttgagactagcctgggcaacatggaaaaaccccatgtctaccaaa

SEQ ID NO: 169434 - DNA, 194 bp, Homo sapiens
atagtcttcacaaatagctcccccaatgagctgtgcctcctatgattcaccccttgaatctgggctggccttgtgacttgcttttgactaatagaatgtgacagaagacacactgcatgactgctgagtccagaccatccaaagccttgcagcttcctcctaggactgttgtaatgtttacttttgtgaagtga

SEQ ID NO: 169435 - DNA, 159 bp, Homo sapiens
ttggccaaatggtgcaaactccacagatccagctgaaaacaacatggcaatggctactaagccatggggctcccaaaactgaagtagatgggtcagctgtgagaagctcactgcctggtacggagcattggatggattgaaaatcatggaacagtccct

SEQ ID NO: 169436 - DNA, 178 bp, Homo sapiens
cattgtcagtgttattagggaaggtaaatgaggttaatggagattaattaatgcaaactgggtagaatcatagaaagcgttcaacaactgttagttatcaatcccatttataccagacactctggccctttttaacttcctgacaggtattatagaaaaagtgcatttgatacaaaaa

SEQ ID NO: 169437 - DNA, 374 bp, Homo sapiens
cactgaattcccacatgttttctgatctacttatggacattctctccttctccagcaccaaactattttagttcttaaatcttcatggtacatttaattatcttttaaggttaatttttcacccttcctctttcttgtcagtatttccctggcccttcctttcccgtggagttttctagcagcctgcctgatgctagatcatgatgcttttgttaatggaacatttcgtctttaatctgcttctttacttccaagcctgttgatactactcattggccaggtcgttgagcctcgcttttgagtattataatcagcatttaattagtctctttgcctttatgcttattttatcttgtgaatgttatttggctaat

SEQ ID NO: 169438 - DNA, 151 bp, Homo sapiens
gatggttttggaaaagttgacacggattcaaatcgaggggagcatttgatgtagatctgtcttaattctgtcccagggaccacaaggatggcatgtgacgtacactaagtctagcagagtgaatttctgtcccattactgggactgctgag

SEQ ID NO: 169439 - DNA, 99 bp, Homo sapiens
ggccagccaggcctgtggagttggctgttacagacagaggggcgtagagtcgtggctgggagcccatctactgagagcaagttggggtgagcagtgagg

SEQ ID NO: 169440 - DNA, 398 bp, Homo sapiens
tctaccaccagtcaagacatagaacatttccatcaccactagatcccttgtgttactcttgttaagccacacccacctttctccagcccacccccttccctaacctctggcaagcactatcagggattgatttgacatggaagatagctttccagcatcatctgcttgggccactcactttagaaacagatgtgcgatggttggcaggccttgtaagagcactagagctctcaacatgagcattctgctctcctgctgctgtccctctgtttgggtgctgttttcctctgaatctgctgatagagttgcatctttgcaactgctgacctgcagtctctggtctgatctcatgcaggcttggggctaggatgtgtgactgtgactgttaatgccaaaag

SEQ ID NO: 169441 - DNA, 406 bp, Homo sapiens
cattgttctaatcagaacatttcaaccatctgatctgaatctctctcattgctcaagttttaaaaattgcattctatgtacagcaattcatccctgaaagcacaaattattgaaacaaacacttatccttttctaatagagtatcaaaataatgatgttaatgaaagattataattgttcattattattcaagcattattatttctatcacaaacttaagctggacagagaggatttcttatcatagctgtagccagggtacaatcccacagagaggggagttattaccaaactactctacagattaatgatgacaggcaatgtgttatttggagaaaaacacagatgttgaaattctgcattaaacccctaattcaacattaactgtatgacttgggcagattac

SEQ ID NO: 169442 - DNA, 494 bp, Homo sapiens
atgtatgacaacagtggtacaagggatagaaaaaggaaatggaagtgtactgtgttgagactctcatgcctttacaggaagaggaatgagctcactgggaggtagacagtgataaaggtgtatatcgtaaatcctagagcaaaggcacacaaataagaatgatatttaataagctaatggtggaaataaaatggggtcaaaaatgactcaggtcatggtgcagcggtttatgcctgtaatcctagccctttgggaggctgaggcaggtggatcacttgaggccaggagttagagaccagcctgggcaacgtggtgaaaccctgtctctactaaaaatacaaaaattagctgggcgtggtggcgcatgcctgtggttccagctactcaggaggccgaggcaggagaatcacttgaacctgggaagtggaattggcagtgagctgagatcccatcactgcactccagcctgagtgacagatcaagacgctcaaaaa

SEQ ID NO: 169443 - DNA, 500 bp, Homo sapiens
gttggcctaaatgatctctaaagtcttttctgtctcctccttcattgtagttcccatcttcaatacttccattgctccgaaggtggaagttcagcattttagcccccaagtcctagccctgctgagtgtgacatgcaaagcttcgacccacagcaggaagtctcacagttctgggctaggactgcagctctgttttcaggaaagttatctggaggctcttcttcctttagcctctcccatggctttcaatgtggggcaggtgagttaattattcaagggggtgtctctgccaagagaaagtcacctgtggagaagagttctgtgtctggacttggagcacagccacgatgctgtcatctgcttcctcttggcacacacccttgatccaaggcttgccattttcacttctaaattactaggttaatagaaatggcatcaaaacattaaataaagtgaggcatataccatggatctgcaattctaattgacttgaaatttag

SEQ ID NO: 169444 - DNA, 384 bp, Homo sapiens
tatgcaatagaacaccagcacttattcctctcgtctatagctttgcacccattgaccagtctctcaccactgccccctgccaatcctctggtaaccactgttctactctttctttctatgagagtgacatcttagattccaccagtgagtgagatcatatggtatttgtctttctgtgcctggaatctttcacttgatataatgtcttccaggttcatctacgttgctgcaaacaacagaatctcacttttttatggatgaatagtacttcattgtatgtaagtaccacattttctttattcacgcatccactgatggacacttgggttcattccatatctggtctattgtgaatagtgctgcaataaacaaaggagcacagct

SEQ ID NO: 169445 - DNA, 387 bp, Homo sapiens
ttgggcagtgcggtccggtgtgtcatgaaacaaatctgtcatatttaaaaatgggcctgcatagaatatagtgtgtatgaaaagtggtggctacagaatccttgtagttaaagctcagaaagttttgatagccagtggcacaaagggggccagatgtccacgggggtgattgtttaaagggatggtagggaaaatgtaaagtgaatgtgtagaatgaaggggtgcttatgaccagggtgaacttctaatttattgtgtaaatcaggatgctttgaagataaaagttgtaacagacataaactgggactgcccacgcaaaccctacctatatataacattgccgacacacctcagaattatgggtaggcctggttggccttcatgatc

SEQ ID NO: 169446 - DNA, 260 bp, Homo sapiens
cccactacttgacattctggaaaagacaagacactaaaaagatcagtacttgcaaggggttcaggtggggttaaaggaagaggggtgagtagatggagcacaggtcattttcaagtagagaaactatttttttgggttggttccaagtctttgctgttatgaatagtgccgcaacaaacatacgtctgcatgtgtctttatagcagcatgatttataatcctttgggtatatacccagtaatgggatagctgggtcaaat

SEQ ID NO: 169447 - DNA, 343 bp, Homo sapiens
tgggaggtgaggccaaagaagcaatgaaaaataagcaagccattgataccattttggcttctaagtaaagcacaggaccttacaaggtttagagcaaaggaatgacacactctaacttaggttttttgttgttgtagtttccgtccagctttacagaagtataattgccaaaaaagattatatacattcaaggtgcaaaacttcattacttgatatccatatacactatgaaatgattaccacaaccaagttaattaacacgtccatcaccacacttagttatctgagtgagtgagagtgtgtgtgtgtgtgtgtgtgtgtgtgtgtcgtaaggatacttaag

SEQ ID NO: 169448 - DNA, 432 bp, Homo sapiens
ttgttttattgccatcctgtttggaagcagcacaatatcactttcagacgaagcctctaggagatgttctgtacttttctccactctcagttctcagtcttgtaagcagttacgagtgtacctttctcctctaagtaaagaagccatagatgactccccgagacttttagcaaaactcttggccttaaaactatgctaccatatattcttagaagtcaaaggatgcaacacagagaatacatttttctatgaagattaatacaagtgatattagtggatataaccattaattgtttggactcagccttatcttacaaatgcaaggtcatttatctagatcagtacttaaaaacataaaatttaataaaatgcaatataaaagttggtttaattttgatatgtgctttataggagtgaagctgaaaatattta

SEQ ID NO: 169449 - DNA, 628 bp, Homo sapiens
cgcttccggttgcgcacggcattaagtgtaggggccgagccccaagagctttggaatgaggatgatgtgaagctgagagaagagctggggccacctcttcgacacgcgtacagaaaagtcccgttttctcgcatcccaggtggaccaggatccagatcaatctgtcgatattgggaacgacgccggaccaggaaacccagcgccaagggccgggttggaggcggggactggcgcagcgggcggggcacgcgtggaggcgtcacctaaggcttcgattgcagacagcgggatgctcatcgagtgcttttcttttcttttttaatttctctttttagttttttgagataaggctccggtctgtcgcctaggctggagtgcagtggctcggtcatagatcattgcagcctggaattcctgcgctgaagctatcctcccgcctcggcctccggagtagcttggaccacagttgggcccatcacgcccagctaagttatctttttctagacacttgggtctcactgtgttccctaggctggtctcgaactcctgagcctaaaggatcctcccccctcggcctcccaagcagcttggaccacaggtgtgtgccaccacgcctggctaatttatt

SEQ ID NO: 169450 - DNA, 305 bp, Homo sapiens
gactaggagagtccaaacatctgtattttgtacacagtaatgtaaaggtaatgtggctgaaggttaggagatccaggttcaagttgtaactccatttctaagttaggaggcagcatggattctggagccaaattcacttaggttaacattcaagatctgccagggcatagttttactaactttgggtgtgttatatgaattccctgctcctctttttcccctttgtaaatgggagagagtaatgcctactatctgtgactgcaggaaggatgatgtgtgtaaagaacttggcacattgccaccat

SEQ ID NO: 169451 - DNA, 309 bp, Homo sapiens
gaaggtccttccagccccccatcccacttatctagtaagatgtcatttattatcttaacaggtggcatcatggcttaggctttggttggatcagcctgagaaaatagctggaatccaggtaataatataaacattgaaagagacttcaaacctcatgtaaaatcttgccctccagccactcaaactgtctcctattccaaaatacttgagcagagttgctgtagttcacatccctcatcatagatggtcctgagcagtctagatggtggtcgggatactctgggccccactctgccttagccttgtgtc

SEQ ID NO: 169452 - DNA, 222 bp, Homo sapiens
cctcactttgccccatggttgagggagatttctctttcaggggatgataccctctttttaatctttccttccccgaccttcaactgttcctgctgagagaagggcagggtctctctgctcccttctgccctggttctcttggccgggaccgcagggctgtctgagatgcagcaggtgtgtgttttcagcatcgcccacccgctcctgatgtgcagcctgagg

SEQ ID NO: 169453 - DNA, 131 bp, Homo sapiens
aaagtagctaggacagcaaagccatgggatgtaggacaggaaggtcttactctaactcttgccacttctaattttagctgggcaaacttggacaagtcacttatactcattcaatttcctcatctatgtaa

SEQ ID NO: 169454 - DNA, 262 bp, Homo sapiens
gtacagactacaaatttgagttctagctccaggagattagtgctttaagttgcagctttatagctaggtagtggaactatatatgacaggtaattgagaacttgagtttactcttttgtaaaatgaacatattgtattatatgatatctaattctaaagtccaatgaggcaggaccctgtgggtgattgtatatacatatacatatgtaaaatgatacctttgtcaatatgaaatatatagggcatgtaaataatatttata

SEQ ID NO: 169455 - DNA, 483 bp, Homo sapiens
atttggacacattcaagaagctaaaaagcatattagtagtacataacagttgcagatagaaaataaaatgttaaaataacaagaattttaagcaaaagtgagttaatcgtataattttaggttagacagagtatctatcaggagtataacttccactctgagtaatgtcctgtgatgcttaatgaccataggtcaccagaaacctgtacagagtaatcgagaaatgtgtttctaaggagattctggtaggcattcaatttttcactgaaatccttctgcttgtaattagccataggggcagaaattagcctgcaagtaattgcacttgtaatgggttcactgagtaatacctttgttaccttttaactaaaatgaaggaacttctttccaattgtatgtgcaattgcctcattatgaagttcattactttcagcctcaatttgacaagtgaaaataatttttgggtcatattgtgaatgcgtg

SEQ ID NO: 169456 - DNA, 508 bp, Homo sapiens
ggaaagggtctctaacggccgtttcttggttaatcttaaatcctctttattattgcgagcttcagaccgcttgggggtctggatctattaataagattattcggggcctagtgtcctgtagtatctgtcagccgttctgatagttaaatgtttcaattaaaacgaactcaaacaaaaaaaaaaaaaaaaaaaaaaaaaaaatttggggggggctggggccctggaaaagtttttaaaaccttgggtggggggcgccgggggcgccccaaaggtagggatatgggagaacccttggggcccatcagcgagggtcccctaagagaggacccggggccaggagacaaggcggcggggggttctcacaatattaaaaaacgcgccgggggggaaaaccggaggcggttcttagaacaatcccaagaggggaggtcaggagggccatcacgggggttcttatcaccagggagctcaggagagactgagaaattcaaattaaccgcgggctgtg

SEQ ID NO: 169457 - DNA, 130 bp, Homo sapiens
tgggaaggtaaagatgtttgctttgctcataggtttcctcactgacactggaagtgagatttctgtctgtcaaaatatgtcctgtaccagttgtgactatactggctctcaagtacaaatccacactcct

SEQ ID NO: 169458 - DNA, 410 bp, Homo sapiens
caaaattagaagaaaagaaatagtaaagattagagcagaagtagataaagttaaaatgacaaaaataatgtaaagaattaatgaaagaaaaagttgattttttgaaaagtgaaacaattgacaaatatttaaacaggctaactaaaaaacagaaaagatacaaattagtaaaatcagaggtgaaaaaggagacattaaaagtaacacttcagaaaagcaaaggatcattagtgaatactatcagcaattgtatgccaacaaattagaaaacctagaggaaattaattcttagacacacacaacttaccaagattgaactaggaaaaaatctaaaacctgaacagaccaataacgattaacaaaattaaaaccttaataaaaaagtctgtaggaccagactgaaaactaga

SEQ ID NO: 169459 - DNA, 300 bp, Homo sapiens
atactaatagaagcaagcaaatagaatcatatagaatgctcagttaaaatgaaagcagaaaaagtggagaagttgaaaaaacagtcaagtataagaatagaaaacaattgacatatgtacatattaatccaattatgtcaataccactttgaatgtgtatatctacatataccagttaaaaagacatggactggctgaatagaattaaaaaaacaaggctggaagggcacagtggctcacgcctgtaatcccagcattttggaatgctgaggcgggcacattgcttgaggccaggagttt

SEQ ID NO: 169460 - DNA, 390 bp, Homo sapiens
ctccccttcctaatgtagaagctctgatttttaactgggcagatgactacatggattcaaggtattttcctagtgtctcttgaaattaggtgtggtattgtgaccaaattctagccaaaaagatgttgaacagaagtggtatatgcagcttctaggaagtgttcttaagggggaaggcgtcatcccccacctttcctccttcctgcactctggaatgtggaccagatggctggagtaggagctgccacctggggccagaaaatgatcttaggcgtgaaggtcaagtaaggcaggacaagagagaaggagcctgcctccccgaggctgtgaagagccatgccagtactgtcacctgggagaattaaactggtcaagtgcctgttcgtttag

SEQ ID NO: 169461 - DNA, 229 bp, Homo sapiens
  misc_feature (20)..(21): n is a, c, g, or t
tgggtgatctagcaggatcnngagattggggatacaagcaaacaaaaatccctgcttttgtggaactgatattctactggaggcagttggcagtagggcactagtactctagtggtagagggtacccaaacagcagctggaggatgactgggaggcagggaggctgaactgggaggtgcagctaagagcctgtctctggtcagtcagctgacgaaagaatgagacaatc

SEQ ID NO: 169462 - DNA, 491 bp, Homo sapiens
tagaaaagttatgacattattatacaggataaattagaacagggaaacttgatagctgctaaaatattaagcatgtaagtcgtcaatgataaaggggtatcagtagggttgggtattagttataggaatggaagcaagtagtaaacccaaagaacattgcaaggtagaaaattaatatgtctccttgaaagtatgtgagagtgttgagggtgtcgctggcatgtcttctgctttgatttgttttggatggaggtaaatgggtaggtggaggaaagattgatgaatccagaaggaagaataagtgtaactgaaaaaagagtgctttttgaagctgtaaattccccatctatagttgttttcctgcaaaggtagacgacatcctttcattatggatgttgggtggaattttcagcatcgagtagaagatttaatttggtgacattttccatctctttcaactcagagatagtatgaatctaccactcacgaaa

SEQ ID NO: 169463 - DNA, 609 bp, Homo sapiens
ttctaaacatacatagaaatcagaccgctacctctgcagaacattttactggtaaaaagaacagcccacatgagggaaaactgatttggtggaaagacaacaaaaacaaaacatgggaaatagggaaggtgataacatggggaagaggttttgcttgtgtttcaccaggagaaaatcagcttcctgtttggatacccactagacatttgaagttctacaatgaacccatcagagatgcaaatgaaaatgcctccgcagagacagaaaacccgcaatcgagcatcatcgactcgcagggtgaacaaaatggtgatatcagaagaaccaatgaagttaccatccaccaagaaaacggcacatgtggagagccagggagaagaatagaaagaaaaagagacagagatcagagacagacacagaaagtgagactggggagagagatagtataaaagagagagactgtaagagaaaggagacaaagagataaaaggtgcgagtgaacaggtgaggagaaagaccgaaaactatgagaaacagcaactaagacacaaaggaggtgggagactgcctgggtactgcagcacccacaccgtcctcttgccccctgtc

SEQ ID NO: 169464 - DNA, 218 bp, Homo sapiens
ttagggagggcatgatcttagtttccaaatatctgagttgtagaaaaagaactatatcaatatactttcaagatgatttcctttataatccctagaaatagtaaaacaagagcaaatggtgatgtctacagcctcaccaaaaagtgagctcctcatctctggaagtagctaagtgaaggctggatcaagctctaccagggaagtcatggaggagagca

SEQ ID NO: 169465 - DNA, 507 bp, Homo sapiens
gcaggatgttgagagtttcattcattatcgtatgccccctaccccggccccacaatacctagtgcgtgggatctgacacgtggtggctggtcaatgaatgaatgaatgaatggtcacaccatctgaggttctgcactgagtagccctgaaggcttgaagcagcataagtgacaggtcctcccttgaggggcctctgttttaccaataagccaagacctaagctcaacaacactgaaagggtggccaatacccaggacagcctgtgggaattccagagaaagggagattcccagggactgggggcccaggctaaacactgaaaaatgcatctgtaggctcaaggaggaaaagcccatgtctgtctgtcttgcccaccactctctcccagcacccagcactgccccaggacagagagcacttgacacaagttggttagattaatgaatgatttagagttcagtggtccccaacctttttggcacaagagactggttgcatggaagacaa

SEQ ID NO: 169466 - DNA, 378 bp, Homo sapiens
acacctatgaaccagcatcaaaataaaaatcaaaccttacaagagatgctgaaatttctattgcatctcttagtccttaaccaaagataatcactcctggaacttctcttactatagtctcccaaattctaaaccttataaaacaaatgtgtactcttctatatctgatttcatttactgaagaacactgttgcgtgcaaaaaaaaatctgtaatattcattgctgaagggttcaattgcattactctgaaacaatttatttatctttgctactttcatgagtgctacagaaagtttctatgaacattcttgtacatgactttcattgtattcatgaacatgtattgctcttgggttcatctccagggataaaattga

SEQ ID NO: 169467 - DNA, 178 bp, Homo sapiens
gaagtcggaatccgctaaggagtgtgtaacaactcacctgccgaatcaactagccctgaaaatggatggcgctggagcgtcgggcccatacccggccgtcgccggcagtcgagagtggacgggagcggcgggggcggcgcgcagcgcgcgcgtgtggtgtgcgtcggagggcggcggc

SEQ ID NO: 169468 - DNA, 246 bp, Homo sapiens
ggtttcttctgttactaatgtattttgttgtgatttcttggtcttaattgcaattttgtagttcattcatctaacatggcattcttataataaataaaaatgtgtaacttccttcctaattatagaagtcatgcatagttattgtaggtcatttgaaaaattcagaaaagtccaactaagaagcaaaatcaaccatcatcccacctcccagtgttatgtattgtaaagatttggtgtttgtcttgt

SEQ ID NO: 169469 - DNA, 4958 bp, Homo sapiens
gcatccccttgattaaatgtttttcctcctatgcaatcaccattagctgtttggctcccattctgtattcttctgaagcagccctgcattgcaaatcaatatctttctgaaaagacagtgtgttgtgaattgccttgacagcatatgcacggttactttggctgcaatgctgctgcagagcccggttactctgccttcgtgggaactccacagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctagagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaaagtttggtgtctctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 169470 - DNA, 5005 bp, Homo sapiens
  misc_feature (2)..(2): n is a, c, g, or t
  misc_feature (5)..(6): n is a, c, g, or t
cntgnncgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattgctttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctagagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaaagtttggtgtctctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 169471 - DNA, 5208 bp, Homo sapiens
  misc_feature (2)..(2): n is a, c, g, or t
  misc_feature (5)..(6): n is a, c, g, or t
cntgnncgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattgctttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctagagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaaagtttggtgtctctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgtaaaaaaacaacaggatccaaaagggcgtcagtctggtgagtgtccggccccagtaccagtgacggaccaagaaacttcgggaggtcaaaactgggggagctgccaaggtgggatccttgatgcgggacttcagcctagtggccattacggagcgtcaacagaggttactacggtatacaacaagtaccatcatgtgaacacagg

SEQ ID NO: 169472 - DNA, 4543 bp, Homo sapiens
  misc_feature (13)..(13): n is a, c, g, or t
  misc_feature (16)..(16): n is a, c, g, or t
  misc_feature (43)..(43): n is a, c, g, or t
caactctccaggnttncttattcgtgtgcctccacccccactngccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctagagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaaagtttggtgtctctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 169473 - DNA, 4750 bp, Homo sapiens
agcgggttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctagagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaaagtttggtgtctctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 169474 - DNA, 1458 bp, Homo sapiens
agcgggttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacaaccgcttttccggagtctgggggccagggcggggggagggtccgaagaggtcttaccggcactgcccccctccgcgtggggcacgggggtgcgggcgtccgggcgaacggagacgctgggacagagacgctccgtccgtgactgcagcgactgtcaagctgggaagggagcgaccgaccgcggccgc

SEQ ID NO: 169475 - DNA, 4845 bp, Homo sapiens
agcgggttgctgtatgagcctggcctggtgcaaacacattgctagagacatgttaaagagttccaggtgaatcaagcctgagggagacaacagcaaaacgatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctagagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaagtctgttttgttacagagacatgcctctcagaaggtcaggaggttttgagtacctatccttgccacccatacaggaaatccaaagtttggtgtctctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttcattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 169476 - DNA, 219 bp, Homo sapiens
tgggctatttccacgtttccaatttgcgctggataaagcaggatggccaaattatgacagagttttctcttccaaatcaatcaacttttaatacaaagatttcctcaagagtcaaagactctaaaagagaaaggtttaaattttggatgttgcaagctcaaatcaccaagtgaaatttgatccttgaacatctaaatcaatgattaaaatgtttcatag

SEQ ID NO: 169477 - DNA, 178 bp, Homo sapiens
tgtgtttaatgaggaaggggagtagaagagaggagacaagtgaagtaaacagattcctggcagaaactcttaaagatgaagtgctatgaaacaaaccactgtcttttaattaagagggttcctatcgctcagcacttggagaggaatagtagcttctgaagaatacatgctattgaga

SEQ ID NO: 169478 - DNA, 386 bp, Homo sapiens
tgtgtgcacgaatgtaaatatatgacaacaacagcacaagatctgtaggtggaaaatggtattatcataaggtgtttattactatacattcagtgatacaatgtggcttgaagatagacatattatacattaaatatgtatactataaaccctagattgagaactaaaatagttaatctaataagccaacaaaaaaggtaaaatagaatgattaaaaaaattcagctaatccaaaagaagacagataaaggagaaaaagaaaacaaggaacagacaggacaaaaccgaaaacaaatggcaagatgatagagttaaatctaaatacacaaatatccacattacgtgtaatggcctaagcacccacattcgtgctaaaaattaaaatt

SEQ ID NO: 169479 - DNA, 500 bp, Homo sapiens
cgcgtatgagcatgggcagaggcggggcatggttatacagtatgggggacagttgtacagtacagggcatggctgtacagtacacagggcatggctgtacagtacagaggacagttagttgtgtaatacagggcatgtttatacagtacagtggatggttgtacagtacagggcatggttgtacagtacaggagacagttgtacagtacagggcatgattgtacagcacagggaacagttacagtacaggacacagttgtacagtacaggacacagttgtacagtacaggggatggctatacagcacagggcacggttgtacagtacagggcatggttatacagtacaggggacagttatacagtacagagcacggttgtacagtaccatcctgctggttgccagatgacttggatgtaccacttcccctccctgggaggaggttacaattggtataggacttggacatttgccttgtttaccaaatggagtgaaaatag

SEQ ID NO: 169480 - DNA, 572 bp, Homo sapiens
catcacttgcttagatatcataatgtgcattttactattaaaacgttatgtaaatatgtgcaaattataaacaaaaaaaagctgggatggctatactaataacagacaaattagatgttaagtaaaaacatgttacaagagcaaagatggacattttatgttgttaagtttcaatttatcaaaaagatataacaattataaacatatatgcaccatatgacagccagaaaatatataaaacaaacctttagaaaactgaagggagaaatatacagttctacaataatagttggagaccttaatgcctcactttccacaattgatagacaagtagaaagaaaaccaataaggaagtaggaggcttgaacaatactacaaaaccaactagaccccagagacacgtacagaacattccactcaacaatagcagaatacagtcttctcaagtacacatgggacattcttcaggatagactatatgttcttccataaaacaattatctataagcttaaaaagactaaggtgatacatactatctttttgaaccacaataaaatgagtaatcaataca

SEQ ID NO: 169481 - DNA, 388 bp, Homo sapiens
cagggacctgtaggaaaatttccgaagatcaaaaataatgtggttggagtaccagaaggacaggagagattgagaaggaaaattgtttgaagatacaatgctggaaagctttccacatttaatcaaatccataaatgtacagattcaagaagctcagcaatacacaagcccaaagaaaatcacacctaaacacatcacagttaaactggtgaaaaccaaatataaagaaaaaataattgaaaacagctagaaatatatgcctcattacacagacaggaatgggtggaaatactgaagatttctcatcagaaatcatggaggcctgatggcagacaacttctttacaggctgaaagaaaagaattgtcaaccccaaactctatacctag

SEQ ID NO: 169482 - DNA, 286 bp, Homo sapiens
agttatagccaaaacaaaaaagaaagtccaagggaacacctatctaaacagtagtggtgagtccactctccaagccaccccaaacatggtgccactctcattatatggaacttctgctttttgccaataatcagaaataggaaagtgcacacagtatgcacaatgacctaattgctcatatggaattcaacagcagtcatgctgtccccactgtaaaagatctagttctccaattaatcacaatctgttacgatgagtgaggaggtttgaggtgttggttctcaaa

SEQ ID NO: 169483 - DNA, 376 bp, Homo sapiens
tgttaagcagacttttataatgtacttagatatttgatattagaatgacaccttaggtaacatctatgctattgttttatgtatggtgtgatgaatttgggtaccaataaattttgttttattaggagagaaaatatagttatatacatacatatcccccaaatcagttttagttcagttatgttattttagaaataaagtataaatctgaagagttcttatattactttacatgaatttgctatatagagataaaatttttaaaaaattgttgaaatagatttatttcttcaatagtttcctttagagaacaattttctgtcatatcatggagtattacaagatgacaaggccaacaattgtgctggcctgacat

SEQ ID NO: 169484 - DNA, 365 bp, Homo sapiens
atatgctagaaagttaagatctgcctacataaaggtaaagaaaaccccctttttttctgtttttgttttttaagagtcttgctctgttgcccaggctggagtgtagtggcacaatcttggactcactgcaactactccacctcccgggttcaagcaactctcctgctcagcctcctgagtagctgggactacaggaatgtgccaccacactcagctaatttttgtatttttaatagagatgggatttcaccatgttggtcacgctgatcttgaattcctgaccttgtgatgcacctgcctcggcctcccaaagtgttaggattacaggcgtgagccactgcgcccaaccggaaaacctattttaa

SEQ ID NO: 169485 - DNA, 443 bp, Homo sapiens
  misc_feature (169)..(169): n is a, c, g, or t
ctgtcgagatatgctcttccagtgcttccaaagcagaacagaccatctgtgccatggggacagtggccaccactgccacctcgccgaggcttgcatcaagtagagggcacctcaaaacatccattgaatttctgtgaataataggttcactatgtaatcaacacctcantaagtccctaacataaaattccccatttaattctcacaaccacccaagatgttgatagtgttatctccagttattttttggtagagatggggtctcactatgttgcccaggctggtctcgaactcccgggcccaagtaatcctcctgcctcagccttccaaagtgctgggattacaggtgtgagctacagcgcctggcctaaatggaaaactggtgtctaggtgccatattctcaggcttgccctcaccataacacattgaaccggatagcttg

SEQ ID NO: 169486 - DNA, 314 bp, Homo sapiens
tggaagtggcccaccaccatcttgggagctctgtgagcaaggaccccccggtaacattttggcgaccacgaagggacctccaaagcgcctccatcagagagctccatccagacctagacttggacaataggcagttgtttgcttgcctctggctctgctcactctccatgggggtctatagctggtgatcatcttgtatacctaattctggcttcatcttcagactcggacaggtaggcaaactgagctcctgaatcattaggatggacgcgccatcaacagaatctgcttttagtggaatgggtcttcggata

SEQ ID NO: 169487 - DNA, 272 bp, Homo sapiens
tattaaaaatacaaaaaattagccgggcatggtggcacttgcctgtagtcccagctactcaggaggctgaagcaggagaaacgcttgaaccagggtggcagtgccactgcactccagcctgggccacagagcgagacttcatctcaaaaataaataaataaataaaataaaaccaaaaatgctttttggagaatgtatgtgcatctttaaaatggtaaatgaagacattcacattttattcaaatatatgtatgtaccaacttaccctactt

SEQ ID NO: 169488 - DNA, 338 bp, Homo sapiens
agtggagttggcacgatgtacataaacttcatgatgacaagaaggcaggatagttagtggcagtttgacaagtctctctgcatgaaaacaaattaagatgccgtgacagctctgaaaaaaactgttctttttggcatttccttttttccaatgttctctgagcatgctatctcaatttattataaagctacacatacagcccaggaatttctttagcagccaagtcacacctcagagttctgtcagttgtgaataaccctcaagaatttttactccctcgtcaaatgtgcttgtgtagtattccagccatcagtcctttcatttcaataaaactttta

SEQ ID NO: 169489 - DNA, 231 bp, Homo sapiens
caaagggtacaagatggtgagacctggggctccagacagagaggaaggaaaacatcctggtcgctgatggcttcatttctccttcacgaagccagactacacttcttgcttcgatttccatgaaatgccaatttcttataaaaaaaaatctcccattgctgggaagctaaaaaaggagaagtgcttgagcctaggaattcaagggtgtagtgtgcagtgactgcgcctgtg

SEQ ID NO: 169490 - DNA, 482 bp, Homo sapiens
ctcggctcaccgcaacctctgcctcccaggttcaagcaattctcctgcctcagcctccccagtagctggggttacaggcactcaccaccatgcccggctaacttttctatctttagtagagacagggtttcaccatgttggtcaggctggtctcgaactcctgacctcagaagatctgcccaccttggcttcccaaagtgctaggattacaggtgtgagccactctgcctggcccctgtcttgtttttaacagatgaggaaacccaggtctagaaaggttaagtgatttcccaaagctcacacagtgagtgagtgctcaaactgggacagggaccctgacaatctgaccgcacagtcccatgttattgcagttggtcaggatgcagcctgcctaatgcggggcctcatgttgtgaatgatgagcacaggaagggcagcaacgggattggctgttgcccacatcgaaggatgcagagatgcca

SEQ ID NO: 169491 - DNA, 395 bp, Homo sapiens
gtataatatctaatagtatctagcatgttatgtgaaaccctataaccagccctttctaaacacctcttaccaagacaccccacaattatcttgaaatgtgggcttctttgctgcagaaagctacaagcaactgtctctggctacaggtatgttcctggtggtatctgggtgatcagcaagaacaaagcaaacaggaaaaatgtaaacatttggcaaatttgggtaaagagtatatgagaatttctaacactatttttgcaatttttctataggtttcaaatgatatgaaaataaaacgttaaatattttttttttttgagaccgggaggcagaggatgcagtttcgctcttgttgcccaggctggagtataatggtgcaatcttggctcactgca

SEQ ID NO: 169492 - DNA, 450 bp, Homo sapiens
gcgtgtggcattgggacactgaagttagcaaatcggccagtgactcatcagtttcctctccataactggggtgtggttgggggatggggcaaaactggcacttggcaggaggccttggcacagttcccaggcagcattccttctgacccgtcagtgaccatgtcctacccattaaggaatattgtaatgatcagccctggaggaaggagcattaagatttctgctctgacttcagatgttttgatacaatttgggtagctcgagttctccatccctgacaatgaaaatgcccaggaatgtcagggaagcgcgttttctggaaacctacctccctgagacctgtctggcctgcacaggggggtggaccgtgtgggagagaggggattgtccctctctccccaaggtcagctctggcttgcggagtaatggctcgtgtgagtgatgtgtgtg

SEQ ID NO: 169493 - DNA, 218 bp, Homo sapiens
ataacacaaagctgtagccagactgagttttggacatggataatcagaacagtctgtagcccgtctgtggctaatgggatgtttctcccagctttgtcaccatggcaaatactttataatacacaaacatttgtagcgctaaaaatccacccactctttttgaaagatggccaggttttgtaaaattacattccagctagtgctaccctgctgatttt

SEQ ID NO: 169494 - DNA, 304 bp, Homo sapiens
agcacagaacttagaataccaagatctattacactggtcaagaaaactgaatctcttctattaataaagtatctcctcccaaccctccccctcccatatgaaagcatttaccaatttttgaaatatgcatgcagagtccaagaatatacatatatttcaaccatggtcattcctaactacctgtgcagtttaaaaccacaaagcctccttgaattaactccaaaaatctaaaatatatttcacatactattaatgctccaaaggaatttactttgacaatgaatgtaactttttaaaaggctat

SEQ ID NO: 169495 - DNA, 82 bp, Homo sapiens
ggcttgagtatttctgccgtgaacatggccgtcgaggaggactcatgaagactctaaatctctctcgggtaaacctggcgtt

SEQ ID NO: 169496 - DNA, 237 bp, Homo sapiens
cccgctcagagccagtttctcccgctcagagccagtttctccgctcagagccagtttctctcctactttctcacagtccctgggagagtgtgacaggctgtgtgtgtgtgtgtgtacacctgaaactagttgcaaatcgatttaccattactaccacagtctatcccacaggttcagggactgtgagaaagtaggagagaaaatgacggtgagccggacggagccactgacatggtg

SEQ ID NO: 169497 - DNA, 143 bp, Homo sapiens
ctgatgaattcctggctcaaaagaatcactctaataatttctgagtcctaaaagcctcaattattggacaatattgcatagctagagaaggaaaagaattcacttaccccgtagaatgacttagttgtctggaacagaaactg

SEQ ID NO: 169498 - DNA, 349 bp, Homo sapiens
taattaacttgaactcaattatgcccttgaactggtgaaagaagtaatgagaatctgtgacccccccatccctccccaccttcctttccatttaccactaccccgtctctttcccactcccaactcgtggcactatatagataccagttacatctttatttttgtagttttggactagcttatcagcctttttaatctctgcaccataggcaatagaaagcatactggatgttctattgtacaagatgtaagatctcctcaaaatttaaaacattttactttaaagaaataccactaccaagaaaataaaagacagcccacaggatgggagaaaatgtttataaatcat

SEQ ID NO: 169499 - DNA, 449 bp, Homo sapiens
gttgcgctggcgacagctgctactctggatttcgtagtgatcacaggcacgggtccaaggggtgccgaaccagggaccccagagaggcaaacataggtggggacggctcggggacacgttccttcgctggcctccaggcagccccgcaggtgcaggccgccactggcgggcccgggagcgccagaggacccggccaggcccctgcccggaggagggagggggaggggaaagggactccgggcaggagccatttaaactctgcgaggcgcggggaaccgccaggatcacacgcccacgccggtcccggcgcccaggcccggcaggtgaccccagcagacgcgcgcgccagacccgggggcgcgagcctaccgcccctcccgcgcccctacctcgacgcgccccgcagggcggccagctcccggctgtcagcgcccgcgccccgcggccgc

SEQ ID NO: 169500 - DNA, 111 bp, Homo sapiens
atctcttttttttattacaacttcctttttggacactgtatattattctcttgattattgttttgaacctgtggcctttctcagacttaaccaagattaatatctctttct

SEQ ID NO: 169501 - DNA, 280 bp, Homo sapiens
aaccctgctccccagcctcgcactcaccttccaacccacctggctcctggacccatctcagcagtgctcaaaccaatgcccaaactctcctgcttaggacacttctccactggccaccctgaggccaccacacctcactggccactcctcctctatcttctctgctggctcttcctcctctatggccacctaaaggatgggtgttacacactcaatcctgagccctctccttctctgcctgccgtcgacgcggccgcgaatttagtagtagtagtcgacc

SEQ ID NO: 169502 - DNA, 180 bp, Homo sapiens
gaccgcctcacacaccatgggtcattcagccctcataatgcaggctgagcatcctgaatctgaaaatccaagatccaaaatgctccaaaatctgaaattttctgagcactgacaagaggccaagtggaaaattccacagcagacctcgtggtgacagtcacacctaaaattgtttcatgc

SEQ ID NO: 169503 - DNA, 167 bp, Homo sapiens
ttctctgctcatgccttcaccttccaccatcttcctatactgtggttctgggtcacacagtctcccagcagagatgagactttcgacgagagggtagaaattgctgtaccccaccatcttgaaattcacactccaaggagtctttcaattggtgttggggaaaactg

SEQ ID NO: 169504 - DNA, 537 bp, Homo sapiens
ggaggaggaagaggaggaggaggaggagccgggcagcctggagagggtggagaaaagcagaaaaaaaaaaaaaaaaagaaaccaaaacaaagaacaaacaaacagaaagaaccaaaatgagaaacccgatggcagaagcaggtatggcatgaaaatgtgtgcacggatgagcagagagagggacacaagaagaaggggcaggaggagagagaggcggggcagtgccaggggtcacgtgggcaggtgtgccgggcaggaccggcgctgggcccaggccgggtgggaggcagcggaggaaggaggctggggctgcgctgctcccgctgtggctcagagaggacgggcccagggtcctctcccggaaactgacgcaaagggcagtgccagggaggcgggaggatggcgggaggggcctcgatgacccagtcccacagaccagctggctctgctgcacgccagcctgtcctcctcggaggccgcgtgccccggaccttctgtcccaagctgcacccagcggtgctgggctttgggagtggg

SEQ ID NO: 169505 - DNA, 338 bp, Homo sapiens
tgagtgacagatgaggctctgccccaacagccccgggctctcgtctaaccgcctgggctagctggctctgtttctgaactgccagttatccaacacaagggatgctgaagagcataacagcaaaatagtttggtgtcccatttatctagatgtcagatgcatcatggctttaactctctagaaaatggctacaaaccctaactaggtgaaaaagcctgctcagcaacccaaacagctatgagacagctgctgcattaaagctgatgacttcacgcagctcattctgtcaagtaagcgttatcattatttaaatgacagagtggtatgaggtacgacca

SEQ ID NO: 169506 - DNA, 199 bp, Homo sapiens
agacagcatgacatcaggtatagctttaaaaggagttagctgaatgcattacaaccagactccattaatgaatctccacaggttccagaagcactctgagggccctaaagaactaccctgctgacaaaattaatatgtatggaagataagaaagctgaggatatcaggaattaccagcagcagtttggggctatttcca

SEQ ID NO: 169507 - DNA, 439 bp, Homo sapiens
ttccttttgcaggagctcgtcctaggtgctcctgggtggaacaggcggtgcccagctgaaggacgttgctggggtctctccttcctacaggggcatcttatttccttcttggatccaatattttaatgagaagactttagtttgagccagtctttggagacttgggtcctaaaaacttctgtgattccttttctattaagaaatgtatttggaaaatatttaggaaggatgccaggctcagccacttcagtccctcattctgatcctgcctaattctgccaccctgcccctttgcttgttcaccaccagagcaagctctgaggatgtccctgtgagaaagaggacatgagacaaggacctggggccccactccattgcttctgtttcacccttttttcctactcctacctatctccccttttatactaataatctttta

SEQ ID NO: 169508 - DNA, 289 bp, Homo sapiens
tcaccaaccctcctcactttccctccccgaccaacagacgcacctactaaattctgggtccagctcaaagatcccttcatatttgctactttccctgataaacactaggcatgatcccttctcgctctggactccaacagcacttggtctgttctgcttaggatcacatatcctacagagatggatgataatcttttttagggtaggtctttgtcctaatctagctgtgcatactggagcctgaattcatggtagatgaacctacagaagttcataaagtcagagaagc

SEQ ID NO: 169509 - DNA, 414 bp, Homo sapiens
ggcaggtgtcctggggctgccctgagccctgctccctgtagtcggggaggagctgcggtcccatctcaaggaaccacgacctgaggaaatgcacagaggctctggtgggcctgatcctgagggctgcccagccagtggcccccaggcctcagctccttccttgaacaaactcgtatccaccaactgtgagaagccatggctgagagtgtcatgcccccagaggcagaatattgctcacgacagcagctatgatgataaggatcctgagtgcccagccccagccaggcatgggcaactcgcctcccagcaacagcccagggaagtggtgactaacccattttcctggtgaggaaactgaggcacagaaggcttatatacttgtctgtacagctaataaggataaaggcagtgttc

SEQ ID NO: 169510 - DNA, 180 bp, Homo sapiens
gatttgtcctctctgcccgggcccctagttctgatatttggattgtctgcaatctggatactacttaggaggtagaatcaaagccttgttgatgggattgggagtttctaacttcctattaaaggcactgattaagcatctattgtataaagtaagtaagattatgatccagtaagaaag

SEQ ID NO: 169511 - DNA, 542 bp, Homo sapiens
atgtggtacagtcatacaatggaatattattcagcaacaaaaagaaatgaagtgctactgctacagcttggataaactaagctaaaagaagccagtcacaaacgaccatacattgcataactccatttatatgaaatgttcagaatagacaaacccatagacaaaccagcagtctgatggttgcccagggctgggggagattaagggaaaatgagtgactactaatgggtactgagtttctcttggggtgatgaaatgttcaaaaattgactgtggtgatgactgcacaattctatcaacgtactaaagtccactgacgctgaattacctgatacgtgaattacgtttcaattaagttgtcacaaaaaaccttcatgacattatctattaaagcttcatatatgtgttccctatggccataactcctctccaaaatgtatacctaacagaaatgcacatatatgtttttaaccaaaattaaaaattcatagaagcactatttacaggccatgggcagtggctcatgcctgtaattcccaaca

SEQ ID NO: 169512 - DNA, 661 bp, Homo sapiens
atcagacaaataggaaaaagacaatcattctggttctatgacagacattaaagtgatggaatggctggtgccttactaaaaaaaagctttcaaccacatgtatgtaaaagctaatcatttggtgaggtagtcataagcatatataattgacctcataacaatacaacttttttggggctgtcttatcaatagcaaattgacctaaaaacttgataaaagtttagtattcatgtttttaatcagtattcagtctcaatagaggagagtttaacatttctatggaatttattgcaccatacagagtgataaaccgttcaaatataatgttggcattttcttaaacattatttaattgactaaaatagttgaagagttatgaagatatatcctaagacttttatttctaataacatgagaccacaatctttttgtggcacatatttaaagtgcattgtgtcttttatatacagattatgcttagagagattatagagagagggattttttccctactcagaccaattcacatcagataataattccagaaactagcattttgtaacttacttaacctatcccagaaaagcataaactatgtgctaatgcagatgttcagaggggaaaatgttgtattttttctgagtgaggaggaggaagcgac

SEQ ID NO: 169513 - DNA, 187 bp, Homo sapiens
aattacatgaatatgaaaggacagaaaataaggaaagtcaacatgtggaaatatgtggaaaacccaggggctaggaaggacctaaggattcttttacaacagagaaggtcgttttaagaatggcattgaccaatccgtcttcactttcacaaaagcagaacccgactgaatgaatttaaattacact

SEQ ID NO: 169514 - DNA, 242 bp, Homo sapiens
agaaggaggacaatgcaaggccacatttggcgccatctagtgcttaatgagtgccatcttggatggcccccaaaagcaaagagtcaagggctccagcgtgatattttaaaagtttctctgacctggccgggcgcggtggctcacgcctgtaatcccggcactttgggaggccgaggcgggtggatcacgaggtcaggagatccagcccatcctggctaacacggtgaaaccccgtctctact

SEQ ID NO: 169515 - DNA, 210 bp, Homo sapiens
ccctactgaaaatgcatgataagcactaaggccacaagagcttactctgttgagggtgaagttaaaacgcacgtttctcttagaccggtgatataatagaaggtcggttcttttttatctctacgtgattattttgagtgaaaaatttaaagctctttcacataccattggcttgtcttctggagaaaggaacagcatatatagaggatg

SEQ ID NO: 169516 - DNA, 511 bp, Homo sapiens
gcgtaagacacaggtctaaaatagcttttgggtttaaactggcccctatattacaactgacctttattcctagggtttataaactgaaggaatcagagaattatagagatttcatagccaaaagaacttagagatcatctgccgctgtgtagatgagaaactgaggtccccagggtaaaggtcttctagccagttagtggtagaagcagaactacagtgacaagccctgttcttctccattccagaatcagaatagagtgccacaatctccaagcaccctgtaagtgcatccctctccccttcttcctttccactgcttctggtacctgtctgcccacctgtgtctaaagccaggcaattctttgtccaagaagagtaatggtattgtctctttctatgtgtctcggtaattcaggcaaaaggactggatttttaaaagcagtttgaatttctttcatatcactagtgaagcttagtatgttccagaattcaaggagcctaaattgtatgt

SEQ ID NO: 169517 - DNA, 276 bp, Homo sapiens
tgatgggcactggtaagtataggagccagatgtggttggggggccgccaggggctagctgcaccatcgcctaccctctcgggcttcccagacaatcagggagggcaggaagggagcatagaccattaacccaaagtgggaccactctgtacaaggccaccctgggcaggagtgggtggctggcgtgagccaccgcgcccggtctggttgttcttttatctctgacaaggcattgttctctggatgcttaagtttaggaagatccagcgtggtaaat

SEQ ID NO: 169518 - DNA, 138 bp, Homo sapiens
cctactatgttgcagatactctgcctaggtttttaacccttacaacacatccctaaaacattgtacagatgaaaaagcagaggcacaaagaggtttaaaacatctccaaagtcacatagttactataaagccagtaag

SEQ ID NO: 169519 - DNA, 463 bp, Homo sapiens
gacctcaagtgattccccctacctctgccttctgagtagctgagattacaggtgcttaccttgcccagccattattttcttcttaaactatcaaaattctttccattttatttcatagactccatttagttattctttcatattttagatttctttttcagtttattcaagtaatgaatatttgcaagtacagcaagcagattacttcccattctttgctgttgtattattattatgaagtttacattgccttggctttcttcattttcaaataatgaccttgagtgatctttttttcatttaggtttatagatacctgtgcacatgtttttatgatattctttttttttttttttttgagacggagtcttgctctcgcccaggctggagtgcagtggtgtgatctcggctcactgcaagctccgcctcccgggttcacgccattctcctgcctcagcctcct

SEQ ID NO: 169520 - DNA, 438 bp, Homo sapiens
ttcttgaatattgaatgtgatttttacctagtaagtttacattccttttggcacccactttgatttagttttgttttagccatgatttaaggttatccatgacatctttcccaactgttacctaaataatgacaattgactctgttagaaataatattaagacaagctttctagaagtttatgttttctaattgtgagtggtagtttaagaaggcagaatcagttaaggtccttattatggattgagttttctaattctaataattctatgtaatatttgattttatttaaatattaccatgtaataatttaaagtctcttaagcacaggcagtatggaggaccaagacaaaaaatctttataaacatttaatcttgtagattaatttgaggattttaatctatcttacttgttaaatattgttatgtgatttactga

SEQ ID NO: 169521 - DNA, 169 bp, Homo sapiens
tctatttgtagacatgctaatcattacaccaaatgcctccagaacactgctgtttcagttggcatgctttttagactctgtcatagtggtagtgaaatgtgctgggcttagtctgcccctccctcctcctcagtgctctcagacttttctactctattctcattcattc

SEQ ID NO: 169522 - DNA, 568 bp, Homo sapiens
taaaatgacagtgttgcccaacactctggtactaaataaccctatgattcactgatttcacttatgcagtgggtatagcacagtcaagacttatttggttgacagcttcaggactaaggaaaatatctcccaaatagaagcagctgatggcagaaaggagacagaagccaggaatctctttaaggggcttgagagaagaggatgcctgagccagtaggcctcgtcttcacaaaatcacctggcagctgggaccctcaggaggtaacacaagcttgggggtggtgctggagcttgtcgtgttgaaaaacacagagactctcttgggatataagtttttcaagcctagcccatctctgcctcacttctagattggtttcttctgcggtgctttcccactcccccaaaatgactcaatctgaagatgggagaaagttggcagagaaacccatgactgttccctacaaaatctgcacatcctcatcagttcttaagagcttgctttcctgcccagatgactgaattaattgaattcttcattccatcctatttagatcagggaggaatccta

SEQ ID NO: 169523 - DNA, 420 bp, Homo sapiens
taaaaattaagatatgtaagacctgacagcatatctttatttgaattccaccattttgttaatccaaaggtataaaataaatttatagtttcagttatttgattgaataaggattctcataaattccagcttttatcatatgatcagatttttcctggacaaataaagatgtttgctgttgccaatagagtttggcccactagcatgctagctagatactagtgattggtttggagctaaggacttggcttgtcctttcttatccctcccaccaacttaacctcagtggaggattgagaaagatttggtagttgagaatacttctgtgtgcctctgtgtttcctgggcttagccagaactttgcatgcacagctattcttgtggtttttcaagccaggccaaaaccaaaaggtattggaa

SEQ ID NO: 169524 - DNA, 698 bp, Homo sapiens
gtctttaaaattgtatttatatttggcatttatgcctctcagcactatgtaatttcttattagaagtacactttaacttgagaattccattagaatcattaaattttctgaatagaaagcttaacagtgtttaaaaataaatttttagtggcttcatgatgtcaaaacaatcacttgaaagctgaaaaatatgttaaacctacttttgtatttatgtcccagtttgcttttttcaattcacaaaaaaagatttgacttgattacaaagaagaaaacacagaaagagcaaaaaagaaaagaaagatgaaaggaaggaagaaagggagacaaaaaaagaaacaaaaagaaaaaaagagaaagactgattatctagttgttttgtgattaggtagacataactcgagaatcttggagccatccttatctcttccctctccattacctgccacaaacaaccccccactaaatagtaaattcttactccaaaatgtctttgatattccttctttcttattcatttccatgtcactgcctgacttcaagcttttatgaagcttgaagttatatatcaaattgtaactgatctcctaattctcattttgtgtgtgcattccccaaatcattcttgacatatctgtgcaaatctcagcatgtcactttcccagtagtaggtatccatcagctccctgttaatctcc

SEQ ID NO: 169525 - DNA, 221 bp, Homo sapiens
atataaagctagaaaaagactatataaaacctgaactaagtggaaaagaaagaaaataaaaagcagaaattattgaacattttagaataaaataaattttgaatgaaatcaaaaataatgttgcttcagtaaagctaaacatcggttctttgaaatgcaatcctatggtttgggaggccaaggtgggtggatcttctgaggtcaggagtttgagaccagcc

SEQ ID NO: 169526 - DNA, 396 bp, Homo sapiens
tattccctatattagcatatatacatgctactaaaaatgaaagtttttcacttcactgaaaagcaatatgaacatagagactattactttgccttactaagcagaggaattaccagaaccatccttgtaaaaacatgaacattctgcttgagctgccaacttgtttcaaaaagctattaaaagtgggcaaacattgctgctacatgatgaatgaatgggagtgtgttgtagtattgctactaggccacgtatgattggaattttccacataaaagcattttaaaaagcagtgttatttacgatgcttatcattagggaatgatattgagaagaggagtaaggaaacctcaacttctaaattttacacttagatttctgtattttgttgtcatttta

SEQ ID NO: 169527 - DNA, 398 bp, Homo sapiens
tggcactctgaaacccattctgtagcagacagaaccagcagtaaagcaaaaggagacatagagcaaaggaaggtacctgcctacagtggggttttcctacgtggctggcttgggtctgactatttcatgggacagaagaagaaaagcaatagggccatgtggaggagtcccagttgacttatcactgatgtgcacttattaccttcacatctaaaaaagggcccagaatccttgagtttcatcttcactgatccttttcagggaaaatgatagaatgaagaggtcattgtggagagaatgtatttattcttagaggccaaaaaattccactagataccattctaaaacacagatatacttatgccatccttttgcttctaatagcttcagtttttcaa

SEQ ID NO: 169528 - DNA, 234 bp, Homo sapiens
ggacaaataaaccaaaagaagaaaacacaattatctttacactgatatttagattccttacagggacttagtgtttataagtgatgtaagtattattctaatgcaaaacattcttttcattctgatcttggagtcagagcaagtggtattttggtttaaagtgatgagattacccctagaccatctcactaagggttatctttctattgagaaatatcttttgaagagatttca

SEQ ID NO: 169529 - DNA, 445 bp, Homo sapiens
catttccaaaactggcaagagtggttcattgtgcctcaactgtttgtgcaaacaatatagtttatgctaaacacttgttttccctctgagagtttggaattttgctacatgatagccagagggtagctatgtgatcaacccccagtaaaaatcatgaatactgagtctgtaatgagctttcctggtagataatatttaacatgttatagctcacttccgagttgagggtattaagcgcatactgtgtgactccaccgggaaaggactctgggacaccgcaccgggtttccgcgggacttcacaccatgtgccttttgcctttgctgatgctctgtatgctttcactgtaatgaatcttactcatgggtaagattcattcatatgctgagtcatgtgagtcttactagtcaataattgaaccggatagcttgacttggggaccctc

SEQ ID NO: 169530 - DNA, 367 bp, Homo sapiens
tacacacacgcatgcacacactttatctcacacactcacacgcatgtgtgcacacacacatacccagacatatgtatattcatgaatatattcaattattttaaaacaatttgttgtcattgccactatgattttctaaatgttgagacctgaaaaaaaagttgaatgaagtatttgatttgtattttttaaaaaaaaccatatagatttggccaaggagtaggggtgtaaagtgtttttccaggtgaaaagaaatcagaccagggagggggctttctatagatgcgatagagcattgctgtagaggaacagcatctctattatagaggactcccttgtggattgctaagtcttgttagctcagtac

SEQ ID NO: 169531 - DNA, 358 bp, Homo sapiens
tgtaatgactcagtgagttaatgataatagctgataaaatgggtactgcgggcgggtcccgtgctgtgctctgtgcgcgtgctgtcccacttcaccttcacaacttcatggtggctgcaccaggtcacaaagctggaaagtggcaatgtgcatggctctcaatgcctgaagctgccagccaggtaattgaggaggtcagcaacagggacggtactatgtgatgttggagaaataaagaggcgaagctgtgtttacagaatgcgtttcagcagtgtgtaaaacactggaaataagatggaataggaaataacacggaggaagtttcttatgatattgtgggtcgggttaggtggtgaga

SEQ ID NO: 169532 - DNA, 147 bp, Homo sapiens
gtgtgagcctggcccaactctgctcttgttatgattatgagtgtcctcttgactgacaaatcaatgagattttattatttaaaatttccatgattctgctcattctcttttctgtgaaactgagttttcactaggctactgtgacat

SEQ ID NO: 169533 - DNA, 269 bp, Homo sapiens
actgaccagaaaatcaaacaagcagaggacactgtccccaaactgcagaatgccatgaacttagttaggactttattccaaaggtcatagacaggcttttggtcagaggtacatggtccatgctgtgcttacaaaagtttcctctagcagtgtcttagtacattttctgttactgatagcagaatacctgaaactgggtaatttataaagaaaaggaatgtatttcatacatctgtggaggccgagaagtccaaggccaaggggctgca

SEQ ID NO: 169534 - DNA, 493 bp, Homo sapiens
aaaccaccagctaagacagataataacttaaagctctagagcattgcttctcaaatcttcatttgcaatgaatcagctgtgaatgctgttaaaatacagattcggatttagcaggtataggttaagtcctgagatgcaagtctagtaagcacccaggcaataacatttctgctggtctggggaccacactttgagtaacgaatcataagaaaaccttcaaattggacttgccccaagagttagaaaataggttcaagtaattttaatccctttctttctatagccctgaatttagctttgaaatggttatttaaaagaaacagagaggggaaaaaagggaaaacgtaattgtggggaaatactttgactcacatgggtatggaatggctcacagtatttactgactgaatgaaaacttgctaatcattggtcactacaaatttgagtaaattaatcactattttcctcatttccatttaaagaacaaacaaag

SEQ ID NO: 169535 - DNA, 288 bp, Homo sapiens
ggaaagggaagttagagctagaaatgtttcctatcctgctagatgggagaccattgcaaggcttcatggactcagagtttggactcatgtgcccattgcaggatggtgatccttctacttgtaatgtcaaatcatgtggaatagaaaagtacctcctgacacaaagaaaatacaggggaggccgggcgctgtggctcacgcctgtaatcccagcactttgggaggccgaggcgggcagatcacgaggtcaggagattgagaccatcatggctaacacagtgaaacacc

SEQ ID NO: 169536 - DNA, 109 bp, Homo sapiens
cccagggtcagggagggcaagtgagttgtattaaaccactgaggctaagtagctaggaattggcacattggggcctagaattagaaaagtttagaactgtgagtagttg

SEQ ID NO: 169537 - DNA, 285 bp, Homo sapiens
ccagaaattccccagctccaaaatgttccatttccagaaatgctccatcttatctccagaaatattccccgtcatcttcaaatgtaatccatctccagaaatgccagtggtctactgaggctccaccctaactccaagaatgttccacttccagaaatgccatatcccatctccagagatgttgcatttcagctccaaaaatacctcatcttcagaagtgccctattttatttccagaaatactccagcatcatcttcaaaaacacaccacttccagaagtattc

SEQ ID NO: 169538 - DNA, 394 bp, Homo sapiens
acaaatttattttatttcacttttaagggaacagaaaatcaataggccgcaattttttactgtcagttgtaaaatttatctgtacatttgtgtttattcaatctatttccagaaatatttgaagactctttaaagatgtaaattaaatgttctagctttgttagagcactgataactcaagaaaatagtaaaaatttactaatgagtttgaacttgaacacaagtttaatctccaaatgatgaaatctcatttaatatacagacaaaaattatgcagcacacagctataagatagtaaaattagcaagtggaaaacccaggttcaaatcttaatgtagaaacttccaagctatgtgaatttaggcaaacaattaaccccctacggtatttacaa

SEQ ID NO: 169539 - DNA, 272 bp, Homo sapiens
cagaggacccgaattccgacaagtgtgcaggttgttgagataatgcagagatccagaggagggactcctgacccactgaagtactcaaaaagtaagagatgtgactagcagtagcaaccataaaaaatgatgtgatgatgtgatctctgaaaacagatgtcaaaacagatgtcttctgacatctaaaatttgggtaatactactgacaaagcaagttaatttttcaaacaagaacagaacttatctaatagggtgcacagctgaccttactg

SEQ ID NO: 169540 - DNA, 524 bp, Homo sapiens
ctccttgatgcttttctatcttggtgaaatacttattgggaggactcccagtactgctaccttccttattgtgagtagaaaaaaactgaaaaagtcaaagtgttttttcaattctctcactcaacaataatcaccactgaagactcctgtgaccaactctgtggggatttctcctcaccaacaagcagtcagttctgtagcagacaccagctgggtaccctccaatccaattcaattctgatgttacctacctggaggtagcgtcagatgccacaggttgagggctcagtcccacgtgactgcccctaacttatgataccagtcaaaagccccaggttgttttatttgtgcttctgactgaccgtctataagtcagggatcccctgaacccctttttgtgtgtgattaatttactggagcagagcttacagaactcaaggaaacacttaacatttactggtttattattgtattagttcgttttcatgctgctaataaagacatacctgagacttggtaatcta

SEQ ID NO: 169541 - DNA, 210 bp, Homo sapiens
ggtaggcctactatgcccctaggctgtatgctgtggcctgtggctcctggctacagacctgcgctgcgtgtgactaactggatactgtggccagctgcagcacagtgacaagtacttgtgtgtgtgaatgaaacatgggaaagctgcagcaaaaacacggcctgctcctctcacaggaccaccctcgcacccgcggcccctcgctgacca

SEQ ID NO: 169542 - DNA, 281 bp, Homo sapiens
atttctattgtactttaacaggctcaagccttacaaagaaagaaagtttgctcatctcttaccacaataaaaatctaacttgatccactctcaagcttagaaagctttatttcagaagacagaattgcaatagttctatctctaatttaagtgagagcagggtctgggcacagcggctcacacctgtaatcccagtactttggaggtcgaggcagggttttgccatgttgcccaggctggtcttgaactctgtcgacgcggccgcgaatttagtagtagta

SEQ ID NO: 169543 - DNA, 189 bp, Homo sapiens
ccatctgtgaggctgagtctggagtttttgtgggcttagaatgggggagtgcatgcagaatagtccatgggtcttcttggaaaaagaaccgttcagttggttaaaaggcatcatccaaaaggaaccaatcaagagacagagggtaagacaaagatagaagttctcactctggtcgtggactctgtccag

SEQ ID NO: 169544 - DNA, 452 bp, Homo sapiens
tgcatacaatagttaattacaaggttctgggagaaaataattgtctcattactcttcccaatatagtgatgctaatttgtcatgtgataaagtgaattctataaaaaagagttcatcataatgagttatcagtgaccaaacttcttaagagaaatggaactagaactcagcattaaagagtaagcaggagttgaatacacagaattatgggaggggattccaagtgggaaaatgtagtcacataaatgcttggaagcagatattcatttgatacattgagggttggctacataatttacagagcctggtgcaaaagaaatgtgcagagccacttgccctaaaagaaggaaaaagtcattgtcctttcctctgtaatctctctcccaacccaacaaagtgggtttctttgtttttttgtttttttctgtttaatgttgtgctcccattacaaa

SEQ ID NO: 169545 - DNA, 393 bp, Homo sapiens
ttgattgtgttactatatttgtttttcccttggagtagccaaagctgccgcagaagctgaaacagttgagctcttgttaagctatctgcacaatgcctaaacagttattgaaaagctaaaaaaaaaaaattgtgtattcaaccagtttctgcctcaggacaaacgaatatttagctcatctttagtatcacattactcccaaactagagtagaatctaatcaattgcagaaagctgagtataatatataaattatctccaaagttatttaaaacaaaacttattactgattcggaattgcatatgcattcatttaattgtatatattggacaaagtttccttagaaaataaaagaaatgatttatttaaaaataagtttgtattaggttgaaa

SEQ ID NO: 169546 - DNA, 307 bp, Homo sapiens
tcctccccatgtttaaattgttcctcctggatcagtagatagcatgaaaaatgaggtcaaaagaataactcacctcattataaatcactaggggtaatggaaagtgattctgaaggatgaccaggattccttccatctgttaagaatcatttcacctgttgaagagttcctacagcacaaggactctagtggtgagccgcatccattccaacttcacaattgccgtacagggctagtattaggagaatttgactgctagaactctaagtgcttaacaggtattttttaaagcaggcaacatctttat

SEQ ID NO: 169547 - DNA, 484 bp, Homo sapiens
ccggtgcagtaggtcagcaatgtctgtaatggtgaggagggcacatttaggcattcaccaatatgtttgattggtagatcatgttcctacaaaattttccaaggaatgaaggaatgtttggaaaatgattttttttttttgagtcagggtctttctctgtcacccaggctggagtgcagtgcactatcatagctcactgcagcctccaattccagggctcaagcaatactccagcctcattcaacctcctgagtagctgggactattggcatgcaccacaatgcctggctaatttttctttatttttagtagagacgaggtcttgctatgttaacccaagctgatctcaaacccctgagctcaagtgatctgcccacctaggccttccaaagtgctgggattacaggcataagccaccatgcctgaccttgacatgctttttttttattttttaaatatctctagtcacctaatttgctgaaag

SEQ ID NO: 169548 - DNA, 124 bp, Homo sapiens
cccctagccagacttgacacactgtggggataaccactttgggatgctcccaaatcaggataggcagtactacaatcatttagcagagccaaggtgaacctgggctttaggtaccacctatatc

SEQ ID NO: 169549 - DNA, 201 bp, Homo sapiens
gactctgcacctttagaaaaaaagcagttggacctccatttgcaatttatttcaatatttgttcactctctataaatttgtcctattttaaatgatttttcctttgaagtgattataacatttgcctggttccctcattgtgtgagtagactaaaatctttaatatatatctactttatcgctgtgagtcaagactttatc

SEQ ID NO: 169550 - DNA, 252 bp, Homo sapiens
tgtttctggaaactgttaagctgagtccagtacttttaagcctgacagtatctgaggatcctaatatggtgctaagccttcaggggtggagtggggaaagagtattaaaaaaggagtgttaaaaaatccctccaaaactcaggaatcagcatcataaatttaaccattcaaaatgtggtattatagaaaccaaaacattcattttgaccaaagaaaatctgtgagtcatttcctaagcctgggaaacaagcc

SEQ ID NO: 169551 - DNA, 654 bp, Homo sapiens
ctagaggaccctgcgcttcaactgcggttaggaatagacaaatagctcattacaactgtacagaaaactcagagaacagaacatttaggatcaagtcttcatttcaaattaattgagaaatgattatttctatagcttataattagctatagaatttcacaccaaacaggaaaaattaaatctgagatgaattaaagagctaaagtcaaaaaataaaaacaaaatattagaaaaagggtatcttagtgtatttataatcttagggtggtaaaatccattttcagcaagacaaaaacagaaaccacaaataaaaagataatcttaaaaattttttttgtggtcaagtatgtgcttggaaataaaaatctggccaggtgtggtggctcaatcctgtaatcccagtgaatttaggaggctaaagcaggaggattgcttgaagtcaggagtttgagcccagtctgggcaacatagtgagaccctgtctctacaaaaaaattaaaaacgttaactggggggtagtaacacatgcctgtagtcccagctgctcaagaggctgaggtgggaggattgcttgagcccagaagttggagtttacagtgagttatgattgcaccactgcactccagcctggaccacattgtgagacccaaaacc

SEQ ID NO: 169552 - DNA, 345 bp, Homo sapiens
gtacataggcctggactcaggtaccatgctcgacagcttttgctgctggacgtgtagttgggataggcattgctagagcaagcttctctgagcttcttacttggctctgccttttgggtaactctttagtattttagcttctagttcctcctctctgccctgttctgctggtactttcttccaagaaaaaggaactcttaagaggatgagagttggctaaaacaaaaaataatctttctttcaactgtggcactaccctgggttgcccgtctgtgttttattttccaaaggcaaaaaaaccattatgctatgttaagctaatttcaatacaaggcacacttactt

SEQ ID NO: 169553 - DNA, 476 bp, Homo sapiens
ttccacttcacagagaatgcaacactcagagcatttaagttacttgcctgaagacatagatcaagttagtggcagagccaaactcaaatccaaagcctatgcatgtacttcgcacaacaccaacaatgccaagttgtttcgcctcagttttaccatttgacaaatgacatcatccatccctgcctcttttacagagttgtactgaggtcaagtgaaatcactaatacaaacatgacttgaagtttaggagtttactacttaaactcaaaaactgcatgagtatccctgaccgtttgcagagaagatgaaggcagagccccagtcatctccctgtgcttgggtcaagctaatgaaagaagggagccaggttgcagagctggctccaagcctccctcagaccttgggtattcactaaggtgcaactttctcaccaaacaaaccctgctcttcccaactcacaggcctattatacaaaa

SEQ ID NO: 169554 - DNA, 234 bp, Homo sapiens
gaatgatcttttcccattcttttttattccttcatttcttattatgtaggtttttggaacaaaattcatttttcttcccatgacatgacttttatgagtaatttagaaaatgcagttgtcaaaaattgtagtgctgcccagagaaaaagtaagatggatctcattcaaagaaataaatctcatgaacttttgtcataaaataaagaaatatagacaaacctgcactgagaaagc

SEQ ID NO: 169555 - DNA, 193 bp, Homo sapiens
acaaaaccaccataggaaaaatactaaagcagttgccaaagatctacattctcaaaaaaaaaaaaaaacaaaaaaggtaccagtcctgaggcagtttcatagaagttcaaataaataattctcactctaagtgacttattccacagcacagagaggttatagaaaattattttagctgaggttcactttaacc

SEQ ID NO: 169556 - DNA, 896 bp, Homo sapiens
cgttaagaaatttggatattttaaactttgtttaaagtaaaaactttggatttatttaggggactggatgaaggtgtttcttgtacgtcaatttatgaaaagcatagtgcaggactgacaaaggggatgcatgcctacaggtaatttttatccaactaaagttagatcttctcaaaattcctaaaagcagtagtatacataatcaaccctttaccatatagttgtacatattaacagatacttaaatattacagacatagtagttgagaatttattgatgttttatttgggtaagactgtcttagtttaagaattataaaaatgtgcaagctgatattttgaagttggtatccctgaaattataccatatttcatcagttcccaggtgcacgtttttccacctttaacatctctgagattgcggtgttcatagagttggtgaagtgtcgttcttgatagcatttttatctttcttgatcatataataatggtatgccttacaattgatagcaccttagattttctgaaatacaagcatgagttcaaattcaccgtaatgaaagattgtaaattgggagacataatctccttcattgtgttattccttgttaaatcataaaaatacaccagtgtattgcgtatgttaaagataaatgccactttgaaattcaataagaaattttcttatagttctgtaacatgttctttcaaaggggtagaacataaaattcactcatttagacttacatttcataaaagtctagaattactctatcatatagaaaatactattgtaacataaggaattaagtggaaacatttaaactttaaaagcattttcttttaaagtcgaatgtacaatgttttgaactaaacactgttagtgcaatattaaa

SEQ ID NO: 169557 - DNA, 300 bp, Homo sapiens
gtcaccagcacttcctcagcatccacaggtgacaccacccctcttcctggcaccgacacttcctcagtatccacaggtcacaccacccctcttcttgtcaccgacgcttcgtcagtatccacaggtgacaccacccgtcttcctgtcaccagcccttcctcagcatctacaggtcacaccacccctctacctgtcaccgacactccctcagcatccacaggtgacaccacccctcttcctgtcaccaatgcttcctcattatccacacgtcacgccacctctcttcatgtcaccagccct

SEQ ID NO: 169558 - DNA, 211 bp, Homo sapiens
tcgtagaacggagctgcgggcgtgtcacgcaggggacaggaccgcggtttcacgatcgccagtgactgggtcagcatctacaggtcacaccacccctctacctgtcaccgacactccctcagcatccacaggtgacaccacccctcttcctgtcaccaatgcttcctcattatccacacgtcacgccacctctcttcatgtcaccagccct

SEQ ID NO: 169559 - DNA, 395 bp, Homo sapiens
ttgaaataatccataattggcccatatagtcaacttaactttgacaaagatataatggtaattcaatggagaaagcatagccttttcaacaaatagtgctgggataattggatgtccatatgccagaaaataaaaataaaagaacatatttttgtatgttcttcacaccttatacgtcacatacttcacaccttaaataataattaaaatacttcacaaacttaaatgtaaaatatgaacctatcaaacttctagcagaaaataagggaaaatgtacccagtcttgggtttggcaatgaagttttagatatgacaccaaaagcatgatccatgaaaagagaaattaatgttagattttgtcaaaattaaaaacttttactttgtgaaaaactgtt

SEQ ID NO: 169560 - DNA, 397 bp, Homo sapiens
tgataccctggtatggccagcccctcgaattgaaggctagagagggaatggctggggaacagcagcgctgatccagagatgagcctttgccattaaattgcctcctgctgccatggcaactctgtgacaagactttttggagcaaaaggtggcaagcagatactagatctgctggccgcctcctgccgaatttggctgcctcctgccgaatttggctgctctcctctccaatcaggatggaagcactgcagcactaaagctggaaagcaggctgaaaaatccctctgtcaccttctgctttagtgattcctgatatgtgtcttccccagaggggaataaaaatggagtctgatcattttcccaattattacctcatatcaatttacaatttatagcc

SEQ ID NO: 169561 - DNA, 397 bp, Homo sapiens
caagcccggctcccgcgcgcacaacttctgaagctgacttggcggggcccggggatgggccgggggtggccctcgcgcggctgccccgtgtcccgagcgccactcccgccgccccgccagtgcccccgcggtgccccccggccgcgcgcgccccccgcgcactcacccagtgccgcgccgaccactaaggccagcagcctccccatggctgcgcggcgcgtgctgcgcccccctcccgggccgccggtattaatagcggggcgagaggcggcgggacctggcggcggttagaatgtccccgggagcgcgcgggcgcagcagctgcggctctggttccggcgaggggggaggagggggggcgcggcccccccgctccggttaccgccgggggcccagc

SEQ ID NO: 169562 - DNA, 502 bp, Homo sapiens
cttgtctgtttcttatctactgagtacagttttcacgttaagaataagagcaacccctgaagatcagagagtgagatgctgaaaggtgttcacactcgccactcctcctcccttaaagatgaaccttaaaagggtcacacagtagtcctctatgttggaagtgaagggagacaagtttattttgggatccatgtgttaaacaacgagtgcaaagccgtgtgagcacacatagggtttgagttaggtgtcttttttgctgggaggaaggaattttctattgagtcattttctccccacagaggttgaagtatagctcttacagtggagacatggttgatgtgttaataccaccaagatagcaggactgaaggcatggaagaaagagtgttggaatgctatttaaggctgttttggcttttttggtgttgcaccatgcctgttaaactaaaaaaacttttccagtgacccatctaatggtcttaggtcctttaaggagagtcag

SEQ ID NO: 169563 - DNA, 822 bp, Homo sapiens
  misc_feature (1)..(1): n is a, c, g, or t
ntaaattgttcacgcagcaagcctccagcccgttttcatcccatcctctcctctctctgcatttctgccctttttcttaccttctccttctttgagctcccaaacagctgtaccctataagccagaaaagtctagttagagagaagctgagcctcaaccagccaagttagaggcaggtagaagggaccaaagatatgtgtttactggagtttccgggcttctctggtggtgaactgaaatctaaggtattcagccaggatgcctagacctaagcggaatacccaggcagcctcactcaccccagctttccagccccacaacactctcaggtgctatccaattgacccgtaattccctgacctgtggagccacacctacttctgcaagacccatctaagtttcctaatttcacagctccccacccccacctctgcttctaacctccaggtctgaaatgctgagctctgttcctatgatgtctggagctactagccctccttcccagaaaaatggtgggtccaggattgatttttcctcctatctgtgatccagactagtgcatccttcaccccttcatccagtccaggcccagggttttctttcctgcagctcttcctctaaagactaagctgcctctttaggaagaggtgagaacgcaaacattgtaacaggggcaaaattgctttcagtccctttgggcttcagtggtgttgactggccaggtgatggagctgtgggcatgtgggcttgtgatctgggttttctgacctggacgtcgccacaactttacaatgggtgatgctgggcaagtctatgccctct

SEQ ID NO: 169564 - DNA, 918 bp, Homo sapiens
tgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcaccatgaccacctggtgtgacctctctgtgccttactgaggcacctttctagagattaaaaggggcttgatggctgttccaaagtgttgatggctgggagaaggggccagaggaggagtgaggggtggggtttgtccagccctgggctttccgggctctagagatagcatggtgtaggctcaatgacagttctggggacagcaagttggaggttcaggggcagcttcaggacagcaggatggaggctcagggacaattcctgggaggccagtgccctcgttcctccttgtcctcatcctcccacttgctccaggaaactgagagctgagcctggagcttccagacagtcagtg

SEQ ID NO: 169565 - DNA, 586 bp, Homo sapiens
gatgtgtctgtggttgagaatgccccaacagggacagaactgttgatgctcagggcaactgacggggacctgggtgacaacggaacagtgcgcttctccttacaagaggcagagactgaccggaggtccttccgtctggatcctgtgtctgggaggttgagtactatttcctccttggacagagaagagcaagccttctactccctgttggttctggccacagatctgggctcccctccccagtcatcaatggctcgcataaatgtgagtcttctggatataaatgataacagccctgtcttctacccggtccaatactttgctcacattaaggagaatgagcctggaggtagctacatcaccactgtgtctgccactgacccagacttgggtaccaatggtactgtcaaatatagcatatctgctggggacaggtctcggtttcaggtcaatgctcagagtggggttatttctacaagaatggccctagacagagaagaaaaaacagcttatcagttgcaaatagtagctactgatggtggcaatttacaatctcccaaccaggcaatagtaaccatcactgtat

SEQ ID NO: 169566 - DNA, 360 bp, Homo sapiens
attaaatgagacaagcgtgcaatgttcttagtgctgtggcgggggtacagtcagcactcagtgattccagccgactggaactgactgtaatccagccttgctgcttggccacttgctctgctttcagacagggtgatctgtgggttctgaggcttgtgggctacactagatgggctgcttccatgccagactaatacagttcccgaaacatccaggttacctcccggggtgtagactccccatctgccccagtgagctgtgcccaggcccctcttcttgcccctcttacctgaattggctgttggagcttccaggcttgggaagctcaagccaggctgggttggtggtgtagccatagga

SEQ ID NO: 169567 - DNA, 375 bp, Homo sapiens
agagaatgatcttgtagagataataaaattgagaataggtgaaaagagcttaaagatacctgggacaatatcaaaagatctaatattcatgtcactgcagtcaaacaatgagtgaagaaagagaaagagattggtacagaaaaaaaatattgaaagaaagaatggctgaaaacttcccatgtatggcgaaagacattaggtactgattacagaagttcatcaaatcccaagcaaaataaactcaaagaaaagaatacccacacaacaatcaaactgccaaaaatcaaaaataaagaaaaacaatcttgagactagccggagaaaatcaacacatgacccatctacaggaaaatgtgacgagaatgagtccaattt

SEQ ID NO: 169568 - DNA, 247 bp, Homo sapiens
acaggttgcggtgagccaagatcgcgccattgcactccagtctgggcaacaaaaacgaaactccaactaaaagaaacaaaacaaaactcctgccacaattttttaaatcttacattaataaaaacacaaagatgctgggattatttacctggggagcgggagaaaaaacaaaaaggtcctctcaacacaggaatggggcaaggcttttaacatatgcctgttacctgtttacttcctgtcttatggt

SEQ ID NO: 169569 - DNA, 261 bp, Homo sapiens
ttgtaaggaatgggaatagaaaaaagcagacctgagccaggtgccatggctcacactgaagtcctggctttttgggaggctgaggcaggaggactgcctgagaccagttcaagacagtctgggcaacatagcaagactccttctccaaaatatttcttaaaagaaaaagcagacctcttgcactcaacactgttaaagatcagaataataatttcctttgaagaggggagatgaagaagcttctatggtgctggccaaatt

SEQ ID NO: 169570 - DNA, 306 bp, Homo sapiens
aaggttcaacgataatttaatgaatagaacaaaagtttagcaaatattattgtaactaagcagctaataagaacatagataatacataatgcataattaataatacacaatctctttgctcacttattaatgcctgtagaatagggttagtgaaaagctaaaataattcacataaagtatttttaacatgcctggtagatagtaagtgagcaaagagtgaagaaacagaggcttggggaagctgagacattttcccaggatcacagcgggtggagctgtatctcagaaatgaagctcacagtctta

SEQ ID NO: 169571 - DNA, 772 bp, Homo sapiens
cagtaaacacaaatattatgtaacagaactatattcatattcttcatcctaaaaatggagaaaattttgagttatttattgattgtagtataggactcattctctatttgttcaaattattccatgtcaagtgcctagaataattgttcatgacatactgtgaaatagaaaatactgatagagatggattacaaaagtaaactcaaaaaacatcctatgaattgtttcattatatatataatagaatatacttatatccacataacaaaaaaattaaatctttttagatagaatagctgttataaactgcttaagttgtacatttcatcaacacttaatgaaaaacatcaatttctcacaaaaacttcaagcagtagaagaggtaatatttcttaattcatctgttagccagtaataccataatacccaaaggagacaaaagaatcacaagatgactatgaaacaacatcctatttaaatttagacacagaaattctcagaaatatttaaaaaaagaatacaaaaaggtataagaatgattacaggtgtgagccaccgctcctggcctacaggaacttattttttctcttgtgtctctagtaccttacacactacctgggcatagtgtatactcagaaagtattgagtgaattaattactcaaaacattgggtcaaagcttcttctaaccttttttctttgcttttcatgtgtttttcatattccccatttaataaacatatttgtcaacaaccaaagatgacttaatctcc

SEQ ID NO: 169572 - DNA, 322 bp, Homo sapiens
gcactgtccgttgctgtttcgctgtcgtgactgtcctagtccgtctgagccaccagctttgtggtgctttgtagcacagccccagtttaaccatggcaccccacagcctcctggaagttgcggggttggggtacaagggacaccccgccatgaaggctggtgctcagccaaggcaacgtggccacggcacctgtctttatgcaagaggattgaacgtggaaacatacttcttagaagagaaaactctgaagactttaaaatgaaactatccctgagtggagcttcctttttgaggacggtgagcaggatccacactcggcgc

SEQ ID NO: 169573 - DNA, 277 bp, Homo sapiens
caaaaaattagtcaggcatggtggtgtgtgcttatagtcccagctatctgggaggctgaggttggggaatcacctgagcccagaaggccaaggctgcagtgagctgtgattgagtcactcactgtactccaacctgggtgacagagtgagaccctgtctcaaaaaaaaagaaaaagaaaatactgggggcgagatgtcatgaaaactaattttattatagttcagcaaaaacaaaactctccttgaccaagattccctctaattgtatcttcattcc

SEQ ID NO: 169574 - DNA, 165 bp, Homo sapiens
ggaggaactgtgtttactcctgtgtttgcagttagaagtgctaactggggtagtatggagcacccttccctgtatttccccagacactcaatggagtaagcaggaaacatctttccctaatacctttaatgttctattatctcctctatgtatctccttctatgc

SEQ ID NO: 169575 - DNA, 369 bp, Homo sapiens
aggcccttcccccaatcccaggagccaataaactcattcttctttgcaattgtacaatgacatgcacagggaagtcttcctttccagggtataaagcaccattaggagaaagtttttggtttgccttggcccttattttttgttttggggattttgcgtgtgacaacatcactcctgagctgtggcagccatcttaccatcatgaggaaaccgccacggggataaaaagccagtcctctgaggacctggaagaaaggacagaacctggctcccaaggcatcactgagacccaaatcaacagtaagtaagcacagcacctactcctgggcttctttttatgagagaaaaaaaaagttcccatttgtgtaa

SEQ ID NO: 169576 - DNA, 260 bp, Homo sapiens
gatctatatctataatagctgtcctacaaaattctgtcacttcctcctaatacaagcttttgtttatgaatagtaccactaatcctttaagaccactgtcagctctcatgaacacacaagtgtgttaacatcagacttggtattgtttttcaacagaaatatctggaacactttgtaaaactgggatcgtcaaaatcaagctctatcaaatcatactcccataaggtctgtgtcctggcaaataatacatatatcaatat

SEQ ID NO: 169577 - DNA, 418 bp, Homo sapiens
ctactatttcctagtgtcaaggatcaaggtggctgtcaacttctaggctagtatttatttgtaccacattgtaggtcatctacaggatactattcatctttaagaaactagtgtgacagtgtgtggccttagaagtagagcttaaggaaaaaaaaaaacttttttagtccaacttgatgtttgtctagtagtactctatgtacttgttttcaagtttcatatatttccaacttggagattccaccttaaaattcagttaattttctgttaatgaaatgaccactctcttacttggcatctggtcacccttgagtccctctctgttccattcagatctcttcatcaagaattactgtaatgtcccctgtctcatccttcattgggaaagaattgcataattgtataaatgagctatcct

SEQ ID NO: 169578 - DNA, 255 bp, Homo sapiens
tgcagctagcaggcagatgtgcgcccagggtctacctgctctcatcctactcttgcttttgccacattaaactgcctctctaaatgttcatccaccaacaagagaattgggctgatccatcaaccccctccaattgagaaggaataataagaataatgccatggagaaaagataccatttgttgagttttatgtgtgaggcatgcatcatcttattctcacaactgttttctaagatgagtagtaatattctctc

SEQ ID NO: 169579 - DNA, 372 bp, Homo sapiens
tgcctttagcagactgagaggaacactgagcccgtcaaaggagagctccccacaggaaggaaaagtcagcttaagtggtagcgaaacatatgaagttgagttgccagtatccctccacaggccacacaaacagtaatgaaattcatggagagaaagaaagaaaagacccacagccatgagcagagccagctgggagggatgttattactttatttttgttttcttaactatgtgtgtgtgtgtgtgcatgtgtgtgtgtgtgcgtgcgcatgtgcgtgcatgtgttttgagggggagggaggattgattgcagaaaatggcttgatccacagcgtcgacgcggccgcgaatttagtagtagtaggcggccgc

SEQ ID NO: 169580 - DNA, 220 bp, Homo sapiens
tctgtgcctcatagcatttttctgtgcatttccaagctaaaatacataaaacccagctggaatctgtcatgctttgtccgcatcacttcaataatttcagagttgctgctacacttgaatgaatggatgactgacattgaaatagagcagaaatttgagtagagacgttaaattgagatatgacataaaaatggtcttcatacatatgaatgagtattag

SEQ ID NO: 169581 - DNA, 387 bp, Homo sapiens
aaaaaaaagcgtggagtgtgcgtaattgtgtttgaggaagagatggtcactgtctctatggtagtgtctttagggaactatctgtgcctggatcctggggaattatgacaaagcagtctgcaggtttggcatgaactctgaactttctccctctgcaggatcttcaatagaaaggtcctgtcctgaggaaacactcagaggcacttctcttgcttgtgaagcctgccagcatgtatgttttggtcagcactgagatgcacatgacaaattgtgcgcaatgcctcagcacagcccaacggggttttttctgtttacacttgactagccttggacagtaggaggaaaccttaaatatttccttctactctcacaaaccctttatctttt

SEQ ID NO: 169582 - DNA, 152 bp, Homo sapiens
aatcaatgtgaaaacagtatgcagagagactggaggcttccacccaggagcacacgtaaaacttctggggtgacagaagccttgatgggtttgagttacaaaggtatgtgtgtttcagaagtcattgattgaaacttaggattttggccagg

SEQ ID NO: 169583 - DNA, 144 bp, Homo sapiens
cctacaagccccctggtattaacgtgtcagggctgagtgttctgggatttctctagaggctgctggccacacagactcaccaagccacagacttgtcttccacaagcacgttcttacaacagccacaaagtgaccaagccactt

SEQ ID NO: 169584 - DNA, 292 bp, Homo sapiens
ccgataaaaatgtgcagctctcccatctaattaacagtaaaggaagggaaacgcaccgacgtggtctcagtttcaccctctccgtgtaggcgctgaggagagtgacaacacccagtgctggggtaggcagagggtgcgtctcctcacaggcaggcaggcactggcttcacatggccagtcatgtggtgccactgaagaaaatgcaagacacacagccccgtgttaatcatcgtactgctgtcaatttgcctggcagaaatagaaacatcagtttgaggatatttactgcaat

SEQ ID NO: 169585 - DNA, 231 bp, Homo sapiens
cgacggctcactactcatacatgccggctctcgtttacactggccagtttacacggtttctccaagccatcacagctgatatctccgggtgctatccccatactgctactcttaactcttgaagtaaataaataatctttgctggcaggactatgctgaatctccttaggcactctctaatctgatgtcctgggtcctcccaattcttagaccttttataccgtgtttttc

SEQ ID NO: 169586 - DNA, 393 bp, Homo sapiens
tttaatattggtgatggggtggaagagaaggtagggaatgcccttatggccaaacctaaaacacagtttccttgagccttctgagcaatcttagaattattcagaagctttcaggaaactcaaattctattaatttgatttggttcctttccaaaatgttaatagacatgtatttgcttaaaacgtctacctattccatttaatttcctgctgataaatgtattttatctacaagcaagtagaatattttgttttggttaaagtcaagtttttataaaaggaggggaagtataagagagagtttcctagagatacaatatcatctctggagcaaaatgttgaggccaagtgtaaaaacagactatttctctttacttcctgcagaatttcatt

SEQ ID NO: 169587 - DNA, 418 bp, Homo sapiens
aaaacttttctgtagagatggggtcttgctcttgcccaggctgatcttgaactcctggcccccagccttggccttctgggattacaggcgtaagccacctgccggaccaattttggtgtttcttttgcatgctgctggtcctcctcagatgcttggcaatcattggtaatgatgggcttcagaacgtgctaccggcacagtgagtgttttaagctgaaggaatttgagaaaaccgcagaagccgaaggatctttcttaccttctcctgcccttcttccctgaaccaggtcatacaacctggaactccctgcccttttcctgaagaagcaaataacagcctcctgcgagaggcgccctccctgcacctgggggaaaggagggtccttatctctgaagacacagggacacagaagaatct

SEQ ID NO: 169588 - DNA, 365 bp, Homo sapiens
taactgtagaaatcagtggttcataaaacatgatagtaatctcacatatataattcaaatgcaatttcatagtaagatacatatttagtatatattgttcatttgctgatttgaatatattaaaatattgatatttaacatgacaacatagccttctagactggttattttaaagttaattaaactcaggaatgtgaaagagaggagatcagtttacatattataccagtaaatgtgggtatgtatgggcctgtaaataagctgttggttaggaaatatggaattttattttgttaactacaaccaagacaacaataacagtaagtctaatactaggctataatatcagaaaatctcaataccgg

SEQ ID NO: 169589 - DNA, 271 bp, Homo sapiens
tggtcatatgagtccttggacccatagcaataactcttaagacatcaagagttgcggcccacagctttgcaaccgctggtataggaaaaagcaaaaatcagtggctgggatttaatctaaactccgctgctattaaataatccctttcccctgtgatgtggtttggctctgtgtctccgcccaaatctcatctagaattgtcaagggagggacctggtgggaggtgattggatcatggggacggtttcccttgtgcaattcttctgatagt

SEQ ID NO: 169590 - DNA, 330 bp, Homo sapiens
cctcctcccacctcctttatcctccaggtggatgggcacccggtggccttgcccttcctgcaggagccgctgctgtatgtggagctgcgaggacacactgtgatcctgcacgcccagcccgggctccaggtgcggctccagggcgagtctgggtgggctgcctgctgggagcttcagtcctgtttaggcctctgtatctgtagagggggtggggatgccagctacctcctagccaaaaaaggcaaggagtggggtacaggggtgtgaggggaggtggatcagggtcagagatctccccaggcagtcagaggagttctgagttctgagccc

SEQ ID NO: 169591 - DNA, 488 bp, Homo sapiens
ggctgagtgcaggacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcagtgtgcacgtgaccaatgatgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgtgctgtgggatgggcagtcccaggtggaggtgagcgtacctggctcctaccagggccggacttgtgggctctgtgggaacttcaat

SEQ ID NO: 169592 - DNA, 600 bp, Homo sapiens
ggctgagtgcaggacaaggcccctgccctgagtcctggcagctgctgcccccgctgcctgcctcggcccgcttcctgcatggccttcggagacccccattaccgcaccttcgacggccgcctgctgcacttccagggcagttgcagctatgtgctggccaaggactgccacagcggggacttcagtgtgcacgtgaccaatgatgaccggggccggagcggtgtggcctggacccaggaggtggcggtgctgctgggagacatggccgtgcggctgctgcaggacggggcagtcacggtggatgggcacccggtggccttgcccttcctgcaggagccgctgctgtatgtggagctgcgaggacacactgtgatcctgcacgcccagcccgggctccaggtgcggctccagggcgagtctgggtgggctgcctgctgggagcttcagtcctgtttaggcctctgtatctgtagagggggtggggatgccagctacctcctagccaaaaaaggcaaggagtggggtacaggggtgtgaggggaggtggatcagggtcagagatctccccaggcagtcagaggagttctgagttctgagccc

SEQ ID NO: 169593 - DNA, 744 bp, Homo sapiens
tattttggaaaaccagtgaaatagtggattggctactggttctgtgctaatagtgtttataagtggaatgggactttttttaatatgaagtcacccaaggaatttgctttttctggaggctgaggcaggagaactgctcgagcccgggaggcggaggttgcagtcagccaaagatcgcgccattgcacttcagcctgggtgacagagcaagactcacacacacacacacacacacacacacacaaaaggagtgaaaaggattgaaagcaacaaaatagtatgtagtcatcttctcaaaggaaccaaagtaatgggctgattatcttcagcttcctgaagaagctgaatgtttgtatgtaggaagtcccatgtgttatcttggcaggaagtagaaaatatgagtaatttggggacgcagaatctttcgtcacttccctccatcgcgtctcatgtccaggatcttcccaggagtcgtaggaaatgtagcatccatgcagttagtcgtttacctcctaggaaacctttgtgctcttaggagacagtggcttcccattgtggttaagtgtaaccctgtttggctgacccctggatagagcttcataccctcagcactgcatagtcacctttgacttgtggttagaaagatcagccatatagtccatcatgatgatatgttatgatggtttatacaagaaactgggactttttatctcagccaaaacgctactcttgctttaggattag

SEQ ID NO: 169594 - DNA, 820 bp, Homo sapiens
tattttggaaaaccagtgaaatagtggattggctactggttctgtgctaatagtgtttataagtggaatgggactttttttaatatgaagtcacccaaggaatttgctttttctggaggctgaggcaggagaactgctcgagcccgggaggcggaggttgcagtcagccaaagatcgcgccattgcacttcagcctgggtgacagagcaagactcacacacacacacacacacacacacacacaaaaggagtgaaaaggattgaaagcaacaaaatagtatgtagtcatcttctcaaaggaaccaaagtaatgggctgattatcttcagcttcctgaagaagctgaatgtttgtatgtaggaagtcccatgtgttatcttggcaggaagtagaaaatatgagtaatttggggacgcagaatctttcgtcactctttcacccaggctggagtgcagtggcacgttcttggttcactgcaacttccgcctcctgggttcaagcaatgctcctgcctcagcctccagagcagctgggatggcaggcacacaccaccacgcccagctaatttttgtatttttaatagagatggggtttcacagtgttggccagactggtctcgaactcctgacctcaagtggtctgcccgcctcggcctccctaagtgctgggattacaggcgtgagccaccacacctggccttcatttgtatatttagagtttaggttgaattaaatggatatattatagatttctttttactcagatgttttaaataatacagtaattggcatggaaagaagtccaatcggtagccagctca

SEQ ID NO: 169595 - DNA, 137 bp, Homo sapiens
gatatggtcattatgctgtcagcttctgcttttcctgtaaaacaagagtaatgacacctatccggaaggattgttgtgggccttacacaggataacgcacacacaagatgtatggcagaacactgtatcaggtctat

SEQ ID NO: 169596 - DNA, 282 bp, Homo sapiens
agttagattatttttacaacagcaatgaaaaaagcactaaacctctcatagaggaaaatcctgagtgtcagagtgggtaaatggcctgttcaagaaaactggcaagttgcagagccaggttttggaccagggtatctgtccagtggcccatctgctctattactgctgcagatggactgctgcaatagttgcaatactctataaagttcctgaccgttgacagagagcttttacagaagtcttaggcagtacacacaaatacgaacattttcaattttccta

SEQ ID NO: 169597 - DNA, 129 bp, Homo sapiens
ggacagaatcagggtgtggattttaacaagatctccatgtgactggtgtgcacattcaagtttgagaagcaaaggatttaaaataacttatcaaatcagagtagtgatgtctagagaggcggcatccat

SEQ ID NO: 169598 - DNA, 513 bp, Homo sapiens
ttcacctctaaccataggatcttttaaaagactagttctgaggtcctttactctgagtaggtatttatggaataagccattatgtattgacattagaatcagttaaacataaatttttttctctttttatgcactacttgacatcaaaagcaaaaagaggtaagttggctataaacctgtaggtgaacctaatttttcttagtagatttgttcctgagtagctttgcttcaattaaatttctgtgaatcaaatacttttacattaggaagattgtcattggaaattcttattcttttctttgaaaatgaataagcatcttctgtaaacttagattttcaagatatctagtatttaaacattttgcttttcctttaatcaagttatacttacggtttaatttgcttgtgaagacaaggcattttcaaacacttggtttagttttgagataactgaattgtttctcccaccagaaatgtggattacatgttataagtctttcctattttcttaaa

SEQ ID NO: 169599 - DNA, 281 bp, Homo sapiens
ggtgtacccagaaccccccagggatctccatagcctgtggaggaggaagtttagaacttattttcatttgcatggcaccctgtctttttgaagatagattaagatatttgcacacagcctggtcagagctggatgtcatggtgaagttttttgtggcagtggtggtccggagggagtagggagaggccaggaggccaggaggccagcactggcggtgatggggtgtgcctttgcttttgtgtaggggaggtaaagaggtagataatgcagggatgtgaact

SEQ ID NO: 169600 - DNA, 483 bp, Homo sapiens
ataatcacaatactttttccacaaaatcatttgaaatagtttttctctatttgttcatgccaacattgatatagctgctttaattgttcagtttcatttttatattttggaaatttgtgtattattttgttttgtttcatatttgttttgtatacgtaaaacatttagttggaactgaagtcaaaattataaaagatgacacatttgaagattttagcttccattgtagacttctcattcctcttttctccctgacactataggtaacaatatttttatccgttttcttgaactttttcactctgtcatagcgcagtatgtatcaattctatttcaatgccatatttatatttttgttcctatatttggtttttatacattttaatcaatcttatattttcccgtgtctggattgtgtgtcttacttctaaaggtgcacatacttcataagtatgcataaagacgtccatatcatttatttga

SEQ ID NO: 169601 - DNA, 251 bp, Homo sapiens
ccgaatccccgcaggacccatggagctatgaccacaccaggccattcaaatggctctgcattatcttcccttggaaggtggccactcctcggtggcagggcctttccctgaggctgcaggccgtgggctggcagcccgtctcttggcatttcaattgaaggtcaccaggtgctgggtttgaaaggaagtcactggagtgctgccaggggccgccctccaaggttaatgagaggcccacatccaggcaagaa

SEQ ID NO: 169602 - DNA, 242 bp, Homo sapiens
gtttccccggtagggtttccccgatctgagccccggccgccgccgcggagcccgggcgccgaggggagccgaggcgggccagcagggggcgcgcgaaggacggactccagctctgagtccgaacgagagattcgccatccgcagtcccggggccaaagggtttcaggagcctgtgcgcaccaggtccctgaagaggcgtctcggcgccgttgctgtgcggcggggaaagggtggtacatctc

SEQ ID NO: 169603 - DNA, 672 bp, Homo sapiens
tggaaaggcagaagggcactcctccaatgggagccggggagccgtcggtagcggcgtaggcccgtgcccctgctcgcgctgcagcccgtggaagggttccgtccagcgtatccttcagatcttgctgtaggcctctggtgtctgtgcgcgcgcggcaggggcggcggcggcgacggccggaggtgtacgttgcttcctctactgaagtcttgaaacccctgaaagtcatccctgaggtttgaagttaacttcttctacaccctgttaatgttgatattttgacctccttccatgaatcacaaatgttcttaatggcatctagaatggtgagtcctttccagaagattttcaatttacttttcccggatccatcagaggaatcactgtctatggcggctatagccttatgaaatgtatttcctaaataataagacctgaaagtcaatattactccttgatccatgggctgcagaatggatgttgtgttagcaggcatgaaaacagcatgaatctccttgtacatctccatcagagctcttaggtgatcaggtgcattttcaatgagcagtaatattttgaatggaatctttttatctgagtagcaggtctcaacagtgggcttaaaatatttaataaactatgctataaacagatttgctatcatccaggctt

SEQ ID NO: 169604 - DNA, 556 bp, Homo sapiens
tggaaaggcagaagggcactcctccaatgggagccggggagccgtcggtagcggcgtaggcccgtgcccctgctcgcgctgcagcccgtggaagggttccgtccagcgtatccttcagatcttgctgtaggcctctggtgtctgtgcgcgcgcggcaggggcggcggcggcgacggccggaggtgtacgttgcttcctctactgaagtcttgaaacccctgaaagtcatccctgaggtttgaagttaacttcttctacaccctgttaatgttgatattttgacctccttccatgaatcacaaatgttcttaatggcatctagaatggtctggaagctccgagtttatcttgggaactcaagaggagaggatcacccagttcacaggtatttgaggatacaaacccattgctgggctcggctttaaaagtcttatctgaaattccttgtgaaacagagtttcatcaaagccaatccaaaaggcctatgtaaaaataaccattcttgctgcactttatgcaaataatcaggccaaatataagactacagtttatttac

SEQ ID NO: 169605 - DNA, 721 bp, Homo sapiens
cacgctgtggtttccgttttccaacttaccgaaaaattgcttggccgttgtagaatttgttaggagaatagtggccaccctggctagtatctgcgtctggttaacgcagacggagacgaaattgttaacttactgcctcccccagagtatgatctattacttgtattcttaatctacttcggcaaaaatagtgccagcatgagctacaggttttagggaaaactgttgaggaatcaggcctggagaaaatactcaacggggaaaactgggaaccagatgttaggtagggcttggaaggcatggatataaaattaaaaggactggggtgacattttagggcactaaaccttgggtgttagagaactcttggcttaaaaaagaaactctactttgcaacaggtgtaatatagctaccgtttactccccagggttatactagtaactgacacctgaaacattttgaaagttacctaagtatgtttcacgtatgagaaaactggtagctaccgtattctcaaatgatgatttgggtttaaaaagccatttcaaattaattattagaatcgttttctttctgaggacgtctttagtaaagtactgatttcttttacagtaaaaggctttaaaaactactccttttctacagtaaaacgttcagttcttaaggatatattgaagtggcgggtagacgttattgtatacataccatatatgtgaaagt

SEQ ID NO: 169606 - DNA, 306 bp, Homo sapiens
gcctgctaggttaactttttttctgcacaaatatacagttggaccacctggggattttgtcataatgaagagtctggttcagtaggcctggaagggctcaagattttgcacttatgacatgctcacaggtggtacccatgttgattgtccacagctacactttggtagccaggtagttgttcttagggccagaagcccttcttttcattaatgtttttatcctaaatgaccagtcttttattctgaattagtgggaaaattcttcgttgtggttaaattctttgtgttgacaaactatttctgggg

SEQ ID NO: 169607 - DNA, 342 bp, Homo sapiens
tagcccctatttaaagacaaggaaactgagactcagagaagttaaattatccaaagtcatggagctgttaaatagtggaactgcaatacaaactaggtgttctcattattgtctcattttcttaacagtgtcattaaacattacattgacaatattttatgtatagttgggaaacttcccatatttaagaagtgtagaaacagaccctgacacagggatataatctagactcaaactgggggcaacacctctgaagtagtgaagaaagcagcagtggcagaaggagaagatgcatggggagctctggagctaggatgatccttcaaatgtggcccgaactga

SEQ ID NO: 169608 - DNA, 397 bp, Homo sapiens
tgaatgtagccaaagtcataacattttttaggcatcattatattgttttgagttttccatatgactgactttcagcaaagataaatgagggcctagtatacgtgtgaacctcccagaaaaggccatgtgttatgaaaaatgccttacgctatgatgatttgttcctgtgtgacacatcagttgtttctgtttttgtttttgacagtccttcaaggtaggcctgcaaaattgagtatttctttctatagctccttcttctctttactttcttggcttgtaccatataaaaaggtcagtatcacccagttacacctttgtgacttgttgtgtagtgttggataatgaagtaaaaactttacattaaagttcgttatcaagtattttcagctattatatc

SEQ ID NO: 169609 - DNA, 327 bp, Homo sapiens
ctaggaaaaactgataagcattgtaaccactcctgcaattacagccttttgtaaagttgctacttttatgaaacaattgggaacaccaaagattatccccacagctttaagaacactttgaaattttcactatgaaaaaatttgagttcttagtatcacaatactgcaataccacaaattaaaatttaaactaataaatttaattctaaatgtacaattaaggatttaagacataaatatcaatagactttcctaatgttccacagattctgcagttatttagaaatgagaaatgtatttaccaaagactaaataaaacacacaaaa

SEQ ID NO: 169610 - DNA, 425 bp, Homo sapiens
ccttccctaccgcattggatgctttgaggatagagtgagaaacaaatgttaaaaatctataaagttcaaagggttggcaaatacgagaaattatttagcccaaaaaactcactgccttcaagatttaaattcaagggagaaataacactaagaacaaagactgcagagtcccgctatcagctccatcacttaccaactatgtgtggcccgaacagtgatgatgataccccgcttttgcttagctgagaccaccaagcagcctcctggcccttggtatggttgctgcagctagctggcggaaaaggggccagcaggggagtttgctagaagagggtcaggagaggcagtgggtatccctaaaagttaatatattgagaacttagcttgagtctggtccttcccaattccaaaagtaggaggagtaa

SEQ ID NO: 169611 - DNA, 191 bp, Homo sapiens
acagtttacggtttgtctgaatatggatttctaaattaaagatagttttccctaaaacatttagaggcttccattgcctttaggcagaatggggttgagaaagaagctcttctgattcttgattctgtgtatgaaagagtaccagagtggttttttggtttgttttttgttttgttttgtcatgtctggac

SEQ ID NO: 169612 - DNA, 380 bp, Homo sapiens
ctagttgtcaattaccttgcctatctcagtataactaaggacaatcctacagaaagcagcccaattccttacctttatgaacaaaggtcttcatactctttccaaccttatccccctcttttatctcttatagtctagatacactgaacctcttagagctctcagaatgtatcaggctcttccccaaactttaccttctttctaattaaagaaaaaaagagagtgattctatcatttcctactgactattccctccaccttcagtgcctttccctgccccttctccaggctaaagccagcataattgtcacctcccaactagcgaatgttaagcattctccaattccccagtcagcattacttgccttgtcctctatgtt

SEQ ID NO: 169613 - DNA, 433 bp, Homo sapiens
gccaggaagcgcctctcccactgagaaagactaaaatattgagtaaatcaacatactttgaacaggtcttttgagagaaaacactgagagttggcagagaggtgacgcagacaacaggtctgaagagggaggaagctggaacccttgcctggccttactgagcaccttgacgagttcctggccctaaacagctcctaaggaaggtgtgagtgaaggaactgtggcacagcccgctctcaacacgaacctctcggatcttggctacaagacaccccacaacccccatagacgttggaattggcaggcaatctacctggagagtaggcagagacagagattgagcctgcgcagaggttgaggggttttgcgtgcagggcatctgtggcaaaacatagcaatggggacccattccccaaggctctccatcttcttc

SEQ ID NO: 169614 - DNA, 453 bp, Homo sapiens
tggcaaatgcatccagttctgtagcaccagcacaacatgatatagaacagttccttcacaccccaaatttcaccctgtgaggtcagttcctctctcgatttcagaccctgacaaccaccgggactgttttctgtccctagagccttgccgtttccagagtgtcaaaaacagactcatacagtgtgtagcctactcagtctggcttccttccctaagcttcctgcatgtgagcttcctccatgttgcaggtgtcagcagttctttccttttcatcgctgagtagtatcctattgcgtggacgtaccacagtttatcattcaccagctgagggacatttgggtgattcccaggttttggtgatcattggagaattttaaacaggagaaaattttaaacagttttaaccacattttaaacatggttttagaaaaaatcactcactgtactgaatgg

SEQ ID NO: 169615 - DNA, 452 bp, Homo sapiens
gaaacatgtttgtctagaattcacgagaaagtcacatgaactcatgggagggggaagcacagaggcaccaacaaggtcaaggtcaaggtcatacctgctcagccagctttcccagcctgttgggctgacagaggccaaggaggcagcagagtgagacagggaggagacagccacaggaaacacacacagaagcagcagccacatgagaaacacagggaaagagagagcaaaacccacctctgtatcttaaagagcaaacgtgaacatcccattaacatcatttctgcaatcatgtgtggcatccatacccttccgacgtctagcaaggaggccccaggcttgcagacgcagagccgctaacacaaaggccggcacccacgctcagccacagcctacacaggaagcgagctcacaaaaggctcccgcccgatctcctctgctgcgtgacaagg

SEQ ID NO: 169616 - DNA, 369 bp, Homo sapiens
tcctaccccctcatgttgaaatccactgaaatcaaaggttcaactgttgatgtttaattcacactctctttacaccattaaaataaacccaggtgtgctcttcagtgaaatcattgccagcaagtgtaaaactcaattatccccattgctggcttttttttaaagttctaccgcaagactaaacttgaggggagagatgtgccttctttcatcctagtgtctcagcctgtaacatattacaaggtgcccatgttcttcaaagataacctttcgtacttgtttcataatccaaaaggtaattattatggcaaaatatgggcacgttcagcaatgtcgacgcggccgcgaatttagtagtagtagtcgacc

SEQ ID NO: 169617 - DNA, 271 bp, Homo sapiens
ggggagcggcagatgcgcccagcagcggctgcgccgggaccccacgttttccgctcaagatgaagacgctaaaattcagagctcaacacatggcatagtcaagacttgaactcaagtcatcaaactccaaagtctatgctcaaccacagtgccctcctgccttctctgctataatacagtccactggaccttcacatgtcaaaatgcagattccccaaatccatctgctcttgcagatggccaaaaatgtccatatattgtcttggtttca

SEQ ID NO: 169618 - DNA, 352 bp, Homo sapiens
ccctggttatagatctagtggccaggaagggaaatgggagcaaatcaggaggcaaatcatgtgcctacaggaaaagccctctccattgtcttcaagcaagaaggatgtgctaactcttggagagggatggtcacttctgcagaccaggagaattcaaagaagcctaggggttcaaaatcttaaatgacattcacccaaatctccccagctcaagggacagtgtcctgtttttcctaatcttggccctaaccttagcataacagaattgctttaattctgcatttcctttcttgccattattattactaattaagaaaaaagccctctctgtctgtatgtgtacaagtgtaca

SEQ ID NO: 169619 - DNA, 458 bp, Homo sapiens
tatttctccacaaatgtgacatgtcagctcacatttgtaaacatgggtctcgtttttaaaattccgagggcataagcagatggtatagttgcagcctagactatatgatcccgtaatcttttggagatgataaaagagtggcttccttagaggttttagctctgcagagcaggagccgagagcagctcagaagagcacaggaaagcaggtttgacccctgcggcgatttacttccctttcctctttccttttctagtccggcaaagtctaaggccttagaattctagccaaacctactggctgaggcagaagaatgaacaagaagcgtcagccaggccgctggcccaggcaccaactcacagttgcccaataggattgagctctggggccgtttacaagtccacgtcattcctgtataaaccttagaagtttactgaataaaccttagaataaggata

SEQ ID NO: 169620 - DNA, 251 bp, Homo sapiens
gtgatgtgccgatcttgacattgatggctgctgactgcttagggtggtggttgctgaaggttgggtgacagtggtaatttcagtgatttttgttttgttttgtttctttaagagacagggtctcattctgtcactcagggtggagtgcagtggtacgatcatagttcactgcagccttgacttcccgggctcaagcaatccttctgcctcagtctttccagtagctaggaatatcaagaatcggcacacca

SEQ ID NO: 169621 - DNA, 426 bp, Homo sapiens
gaccctcacagtgagtgttacagttcttaaaggcagcgtgtccggagtttgttccttctaatgttcagatgtgttcggagtttcttccttctggtgggatagtggtctcgctggctcaggagtgaagatgcagccttcatggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctata

SEQ ID NO: 169622 - DNA, 332 bp, Homo sapiens
ttcaggtttgtttatattatttctcttcaaaaataacaacacactcagaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctata

SEQ ID NO: 169623 - DNA, 1093 bp, Homo sapiens
  misc_feature (773)..(773): n is a, c, g, or t
ccagcaatctacaaggattctaatttctccacatcctgcatttaagacttgcaaagctgaattaatcacaggatgaggaagtggcttctctgaaacattttcctctttcacattttaaactttctctttcatacatgacatgaaacacagcctacgcacgaaagtgactagggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcattattttgttgcggagttcataatgaataacacaggagaatggataaggcaaaacggaggctgggggaaatggcacaatcacacncctatgctggtagagtcagtggcccacaagaagaggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctata

SEQ ID NO: 169624 - DNA, 334 bp, Homo sapiens
taatctactcccacccatgtcatcaataaacaaacaacccccctttgaggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctata

SEQ ID NO: 169625 - DNA, 1037 bp, Homo sapiens
ccagcaatctacaaggattctaatttctccacatcctgcatttaagacttgcaaagctgaattaatcacaggatgaggaagtggcttctctgaaacattttcctctttcacattttaaactttctctttcatacatgacatgaaacacagcctacgcacgaaagtgactagggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcattattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctctata

SEQ ID NO: 169626 - DNA, 377 bp, Homo sapiens
gatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcattattttgttgcggagttcataatgaataacacaggagaatggataaggcaaaacggaggctgggtatgtgtgatggaaaaattcttcattgttctttc

SEQ ID NO: 169627 - DNA, 482 bp, Homo sapiens
tgctgagattacaggtgtgagccaccatgcccagcaatttttgtatttttagtagagacggggtttcaccatgttggctagcctggtctcgaactgacctcaagtgatccacctgccgcggtcccccagagtactgggattacaggcgtgaggcaccaggcccagcctcccgaatatttccaatctacagttggttgaatccacagatgcagaagctagccacatggagggccaactgtgtatgtttatcttattctttttttcccatctggcttatcgaaagctttgagctggccggcaatagatttaatttcttttactcccagttggaggaaagagcacctataaactgtttactgtctttgacccaccaaaaactcattttgggaaagtcttggccctttctcttgcagcctacagaagagagggaaaaaagccaaaggtgtcacttgggccatgcttttcttcctcattgtagccag

SEQ ID NO: 169628 - DNA, 176 bp, Homo sapiens
gtatctttagacataaactagaagtatatagtttcatgctcccatagattagtgagccgataatgaaatagaactaacatttataactatgtagtttacagagtactttcttatatacttatctcatttgggtagggcagatatttttatcctcattttcaaataaggaaactggc

SEQ ID NO: 169629 - DNA, 461 bp, Homo sapiens
cacccactcctcttcccacacccctaccgagtcccacatgcctcttctgtggctggaaggcttcctggaggaggaggcagggtttggataaggtctgtgctgttgtgttcagaagggaagggaggagagggactggggctggggagggaatttcagggcagtttcctgggtcaagggaagccagccaggatgaggggggtgattcgtatatagatgtcacctggaccccccgcccaggggctgcaggagaaatcaggtcaggctggggtgagttccgtcctcgacaggcctatgccacctcaggtactcttagcttctgaccgccccccttgtctccctctggactgctctgtgcacctgtgccctcgctccttggaccggctagtggggagagaaggaggcccaggggaaagagaaggagagcaacggcttcagccagatgctctcagttacgaggccgg

SEQ ID NO: 169630 - DNA, 299 bp, Homo sapiens
ctaggaagactaagcaaatatagagaaaactcaagcttgcaaacatgagccccgtccctgacacttgaaggtcctcaacaggccaggagaggtctctgggcttcacagggcagttttcaccctgagaatataaggaaggcaggaaacgagaagggccaggtaccacagggagctcagcctcgtaggaccgggaaaggagggtccgggtcggacagggagctcggcctcgtcagccccgggaaaggagggtctagggtcggccctgccagttgctatgctctgtgatacaccagaaggaa

SEQ ID NO: 169631 - DNA, 551 bp, Homo sapiens
ttatttacaggtatagtcatcttggtgtctctgagatttaacttgtcttagcatgattaaacatgtgaggaacctccattactaacatttaaagttgtgagtatagcaaatggtattttcctttctgttctttgtagcctgaaatatgctaagcaccatagttaactgacaccctgataaaattgacacgctcctacctacttagagtgaggaaaatgcatttaaatactctctttaaaattgtgaaaataaacatgcttcaaaaaaatagctgtcaagtataataatcaggcagagcactgggctgcttgtccatttaaaacttcactacagcagcagcatatctaccttctagcacaataagtatacagcttaggtcaatctgaagcattcctagaagtctgtaatacttcagagtgttttccacagttcatgccagaacatgagtttttctaagtaactctacaataatactgtgtatgggtgtatatggaaagaaatggaggaagaaatatttgaaaatgagtataaatgttttctatctgccaaga

SEQ ID NO: 169632 - DNA, 190 bp, Homo sapiens
tgggatggggactgggaaacggaactagagaggagatgcaagatataagaggagatgtgagaagtaagagtccaaccctgctggcccatccccaaggctccgtctgggtgctgtttgcgtgccgtgaaatgttagggtttgtgcagtgaaaacagttcgtgcattcattccatctagggaagtccagttt

SEQ ID NO: 169633 - DNA, 465 bp, Homo sapiens
cttgcactgagccaagatcacccccactgcacactagcctcagtgacacagagagactccatctggaaaaggaaaaaaaaaaaaattaactgtatggtagagaggcctgacaaacactccctccaccaagtaagatcaaggtcatcatggacagtgctgtcacactgatactgtgtgcccttgatctgacaggatgaaagtgacactttacctctgtcttcctccccctaacctcagtctgatcatgagaaaagcagcagaaaagtcccaattgaggaacaaactatcaattcctggccagactcttcaaaaccatcaacgtcatcaaaaactaggaaagtctggccgggcgcggtggctcccgcctgtaatcccagcactttgggaggccgaggcgggcggatcacgaggtcaggagatccagaccatcctggctaacacagtgaaaccccgtctccactaaaa

SEQ ID NO: 169634 - DNA, 382 bp, Homo sapiens
gccttggtgtcttgagcacttcactttgtaactgatggctcattgcaatgtcctgcggtactgactcgggagaagtaccctgtagctgtcttgcaattcccaccccccgccatcatttctttgggaggcatctggagtgactcattgtccttgtcctaaaatatgaccctgcctctgggatcctgaaagcaggcactctgagtgcctgtgtcccctcaccgctgtcacactgtagcacgcgttccgcgccacttgtctcctcagtcccctcctccctcgcagaatttctctcggaaaccttactctctaatcactgatactgttgactggagccccagctccaccgtctccccttctgtgaagtgtcctgagtcaccccttc

SEQ ID NO: 169635 - DNA, 557 bp, Homo sapiens
gggacatttgactagagagctgaatgattgatttttgataaaaggatcggccaaggaaagatctagaataaacatttcctagcacaaggaatagccagtgcaaaggccctagggcaggagtgactggtcatcgccaaagaacagcaagcagaccagtgtggcgggaacagagccggcagggggaaaatgctgccactaacaagaaaaatactggttgattggctgaggcgggtggatcacttgaggtcaggagttcaagaccatcctggcaacatgaaaccccgtctctactaaaaatacaaaaattagacgggcgtgatggcacacagctgtaatctcagctacttgggaggctgaggcaagagaatcactggaacccaggaggaggaagctgcagtgagccgaggtcgcgccactgcactcccgcctggacaacagagtgagacttgtctcaaaaaaaaagaataaaaataagaagcattggggagaagcaattttatctaggagcaagtaggaactctcagataagatagcgtctgccccagtcttcatgcctc

SEQ ID NO: 169636 - DNA, 248 bp, Homo sapiens
caggaggcagtgctgtgctggagataataaacatatctagtgctcgatctatttatatctgcagttcatgaatttatttgtctaccaacacaagtttctttgtttttttttttttttttttttggaagggattctccctttgtcccccaggttgaattgggggggcccaatctgggtcccttgaaaccaccgcccccgggttcaccccaatctcgtgcctcggggggataccccccggggaacccctc

SEQ ID NO: 169637 - DNA, 244 bp, Homo sapiens
ggaaacaagacatttgaagacataactcaaatgacagctttggtcttcaggaaaaaaaaactggcaaaatattacatacctatattttgatatgagtagtaatagaatttgtgcagatattaaaaatactttataacaagacagcatctttaacatcttaaggatagtgccaccttatttcttaaatggaccaaattattgtgtagccattcttcttgatatcagagtataaagtaggaaatag

SEQ ID NO: 169638 - DNA, 521 bp, Homo sapiens
ctgaggcgggagaggctgccctcttggctgtgggaggaaaaatagacatgaactattctattctgttcttccctcccaccattgcctacagtaataagagactaaccatcagctacatgccagtatgttttaaaacaaatgaaataaagttaagagaaaaattccacttaccacaactgactcaagaactaaaaagttgaatagttctataacagttaaagaaattaaagcagttggcaaacttcttgagccagatgatattacaggcaagttctaccaaattccaaagaacagttatccctattttatttatttatttatttatttatttttagagatggaatctcgctatgttgcccaggctggactcgaactcctgggctcaagcagtcctcctgcctcagccttctgtggagctgggacacatgtgcacaccaccacacttggcagattatttaaaacaaatactttcaaactataagaggaataccccccaagtccactctgtgaagccatcgtaa

SEQ ID NO: 169639 - DNA, 208 bp, Homo sapiens
caccaaaaaactattagaactaatcaacaaattcaataaagttgcaggatacaaaatcaacatacaaaggtcattaacatttctttataccaacagcaaacaatctgaaaaagaaatcaagaaagtaatcccattgaaaatagctacaaataaagtgcctaggaataaacctcaccagagaagtgaaagagctttactatgaaaacca

SEQ ID NO: 169640 - DNA, 460 bp, Homo sapiens
ggaactagcccggttgatgagcatgttgatattaacggcctggcttggccaaagcttccggcccagcacgctttagcatcagctggttattctgagaacattcttttcaaaacactctacaggacaaacaggccgagaggttcctttgtccacagctggcctctgaaactgagcagactctcaaagggttgagaagaaccccgaggaggctatcgtctgcactcagaggctgaaacgtttgaaaacaggtgcgggagggggcggggaggatggtcagtgacagcacattcttcagcaaacatgtgtcatttgtgcttttaccagagcggagcttttaattcctaaaatataacagcctggtgcaggggctggaagaagagggcgcgttttatgtgcaactctgctaagggcttggttgctgaatgaaaggtttggttccatggaggttcaggtaccttcg

SEQ ID NO: 169641 - DNA, 266 bp, Homo sapiens
ctgggtctgctgcctgccccaagctccagctcagctgcctcgccttcctggctgcagcttccctggcgcgtgctggggttcctgagccccccagacctccctgccttcttgtgacacggtagggccaactgtgggaggcaccgacacaaacctgggctacacagcagatgagggaggctgttcacatcacaaaagagtttaccgcaacaattctttggaaagtgactctctagggtgcggagaatggtgtgatttacaaaatgaga

SEQ ID NO: 169642 - DNA, 938 bp, Homo sapiens
caatatcactccacaagctctgtgaactaatagatttaagaagtgatcatcaattatttctttatcacaactgagaaaccatcaggaattatctgtctcctgctggaagaatacacttccacctaatgaagtatttttgttgaaaaataattgcctttagatttaaacacaggaggcggaacacactaacaaaaggtaagaaatcaacatccagatggagggaaactataggacaaatgacctagttttttctacaaataagaaacttcatcgaaattgcaagaattaagaaaaagagagacagagatggaagaatgcatggcttaaaaaatttgagacaaatccaacaaattacaatgagtaaattgctaacaatatcagcagaatgtagtatactggttctctcatccaactgttagaccataattaaaaggtgttgacatttttaatgaataaattttggctgtaactgatctatatgcttatgattttacagaaaagcagtaggaaaagtagcaccatataattaattattgaaatcatagactctggagccaaactgcacaaattagaatcccagctttgccacttacttgccatatgaccttgagcaatttacttaatctttatttttaaaaatgggggtgataatggcatccattttaaaaggttgacttgatgataaagtgtgggtacacacttccttttccaaaatccttgggtccctgtgtgtgcctgaactttaaaaaatagaatagatatgcccatcgtttaacttaatacccgccccccattgagtcctgggtgagtaccccataatctcacacagtatttctgcagcaaaatgtatgagtattcacaccaaatgagttaaagactatacatagccctatgtcagtgcagtgcaggctttaccaccgaagtagatttaacagcaa

SEQ ID NO: 169643 - DNA, 923 bp, Homo sapiens
ctcaagcgatcggcccacctcagcctcccaaagtgctgggatgacaggtgtgagccaccacccctggccctgttcactgctttatatttggctccagtacctcatatattataggcaatcacatgtttccggaataaatgaatggattctcccaacccttacctgtctacttcaggtcatctagagtggctgacaggcatggattggagactctaacggtacttgttttcatttttctgcccagcagactagaggacaaagcagcctggagggcagaggcaacctaaacatgcaaggagttcaacagttgtacccccatttacctggccacggtaggcccaggaatgggaggagcctactagtgaggccccgaagtgtctcactttccttatctcttccgttgacttgcactggctctcctcatttatccagccaccttctctgagctgataatccaaagcccatcagtaactagtccactcctgtctcctcttctccaccatgaatcaccaatgaagtcatggtgtcccaaataggtcacattccagcccacctctttgtcgaggccctttgaagatgtttttttctgagttgagcagaggctgtgaaatatgtgactttcggagctgtcctgcagagcttctccttaggggcatggtcgaggacagcaaatgcagagagaagcagtggcccaggcagagctcaataaagaaacaaaagtatattctcctcttctgcctttgcttctccttcgtccccttaaattctttttcttctggatttgaggtagaaagcacattctcctttgctcatatttaacttttctcacttagaaaaaaagtgaagctcgctgccagcactcatttaatttcatataaacatgctctctgagggtgaagcaaatgtgactgattttcaatgtg

SEQ ID NO: 169644 - DNA, 458 bp, Homo sapiens
ggttcatgccgggtgatcaggagaccatgatttgggcagctcactccccagctggcagccgggctaaatctcatcagtgcccatttagatctggtgctccgcccttgccccgaagggacaggctgcctgcagagagagccgggacctccacattttctgctgaggctccttttcccagcattggctcctctgcagctgctgggccacagccagaggctgtcagagatccaagggagtcattgccagtgtccttgtctaaggaggatgggccatggagaagccctccctgcccgctctccacccagatctgttgacagccacccctcacatgcccagggcctggagggtcccagcaaggctgagactatgagcagctgtcctactcacatacccatcccagcatccaggtcagcccctttgtcctggggtcctcaaggtcactggcgcccttccagcct

SEQ ID NO: 169645 - DNA, 433 bp, Homo sapiens
tacaatgacaggcttcatttgctgactctgtaagaaagttgatttctccaaggcaccccacacagtgaagtgcaattcacttttaccccaagtgaagtctttagtctaccctttaagcctttagtttcgtccaaagagagacaagcaactttctcaaggacatgaagatactaccctaaaaagcaacttttactgaaaagtcttatcaattcaatggaccaaaatatccaatagcattatatttactttacccaagccagataatagatgaatcatttacttattcatttattcagtcaataaaattgttttgagcccctactatgtgttaaggattagatcctggtggcacattgataagcaaaaccagacatgatccctgccttcatagagcttaattctcatggaagatacagacagtaatcaagtgatt

SEQ ID NO: 169646 - DNA, 484 bp, Homo sapiens
taaagaagaagccaagtgaaaaaggcatcaccagaagtaacttgaagttgttctgggcttttggcttggtgccagtctagctgaaaatcaggtagctgaggtgtggtgggaagctggagtcagagggaccaaagtggaaatgaatgcccttggacagaatgccacaataggccaagcacatggtaagcacttgatcgatgccagctaccatttttgcttatttgcttttattattaatgtttaaatttatagacagtgaaatggacttccatgtagtgtacagttctatgagttttaagacatgtagatttgtgtaaccacctccacaattaggttatggaagacttccatcccccagactctggcctcaagctgcctttcatagccaaactcttctccacccccaacccctgacaactgctggtctgttttccatccctatggttttgctttataaactcacgcagtaggtaaccttttgcaa

SEQ ID NO: 169647 - DNA, 341 bp, Homo sapiens
ataaggaataatgattaactatttagatattccaaatattgccttagcaagaatcaccacatgttgtcttaagtataaatctgtgtcttttcataaaactgacttgataaatattgacttacaggaaggtctccattaagaagccatgtatgatttatataaatcagtgaaattgaagtgccctttgtagcactaacaattagaaatagccagtagttatttctattatgtaactagtagtagtgaagaaaatgtcaatacagggaaactattctgataactataattatagataggtcagggttagtttgtgttgatgttttcttatgtttttctgatca

SEQ ID NO: 169648 - DNA, 356 bp, Homo sapiens
ggctgtgtctactccctggcatccaacccctgcctccagcctctgagccctcattgaccagaactgggttacatggttgtcaccagctgcaagggatgctgggaagctgagggagaggagggccatggttggcttagatgaatgaggatgcagggccaccccgaagaaaattggggttctatcagcaaggagccaggtggaatggatatcggagaggtaaatagcatctgccagtaaagaaggctgtaagacactgtatggggtgatcccatttgtgaagaaggatgtgtgatgcgcacaagtgtttaggaaaaacactagaagaattagcgatggtctctctgggaatggggatt

SEQ ID NO: 169649 - DNA, 476 bp, Homo sapiens
gcttaaagagggtaaaggagtcagctttagaaaagggaagagcatcctgggcagagcaaatagctagtttaaaggtgtaagcaagaggacttttatctctcctactttccaagctgatcttaaattcaattattataatccggtgtgtgattttatagacagttccacattttggggtcagaaaatatggtcaccgtagatctggggctaattacacacggtgaaacatcttctccctaaaaaaaccacatttatccacttgaaaaagcaggtcaaaatattctcaggggccgggcgcggtggctcacgcctgtaatcccagcactttgggaggccgaggcgtgcggatcacgaggtcaggagatcgagaccacggtgaaaccccgtctctactaaaaatacaaaaaattagctgggcgtagtggcgggcgcctgtagtcccagctactcgggaggctgaggcaggagaatggcgt

SEQ ID NO: 169650 - DNA, 366 bp, Homo sapiens
aggatttagtaaagcattgtggcacatactcaatgtgcaccaaaattagtcttacctgttaaaaaagccaaaatccctcactaactgtacgtggattctgagaaggcaatagaagagcatattcacaatgtgaagtaagacacatcagagttaggtttgttgcagattttacaaatttcaaggacgctaaccaatcagccactgtaatttttcaatcaattttagcagaggggatctactcccatctcctagatagagccacgcaggtgtcacagactagctcacacggcacagagacccccccaaaatctgcagacaggaaccactccttaattaagatctgaagtgactacttacacattagga

SEQ ID NO: 169651 - DNA, 135 bp, Homo sapiens
gtcagtttacttgattctccaccccacagttattgaacaggaaagtgtgaaggtaacgcgtcccataaccagccttcagaagaattacagctgctgtatctctgaactttcaagaagtttgtgcatcaattttca

SEQ ID NO: 169652 - DNA, 629 bp, Homo sapiens
tgagagagtttcactcctgttgcccaggctggagtgcaatggcacgatctcactgcaacctccgcctcccgggttcaagcgattctcctgtctcagcctcccaagtagctgggattacaggtatgtgccaccatgtccagctaatttttgtatgtttagtagagacagggtttcttcatgtttgtcaggctggtctcaaactcctgacctcaggtgatccgcccaccttggcctcccaaagtgctgggattacatgggtaagccactgcacccagccaggttgagtatcctttatccaaaatgcttgggaccagaagcattttgaattttatatttttttggattttgggatatttccattatacttaggttcagcatccctaattggaaaatccaaaatccaaaatgctccagtgagcatttcctttgagcatcaagttagtactcaaaaagttttagattttggagcatttcagattttgaatttttgggttagggatactcaacctgtactagcatatcctctcagttaaaatataataattcctctgttctctttgaaacaaggtagttgggtcatgactacatttttttgatatgataaataatgcttaatatggtttggctgt

SEQ ID NO: 169653 - DNA, 185 bp, Homo sapiens
tctagagttggcagtgcgacagtctcatccatactctgctatgtgcagatgttccgcaatttacaatgaaattacatcctaataaatccattgtaatttgaaaataccaagcaccataacttagcctgccttaaacatgctcagaacacttagattagcctacagttgggcgaaatcatctaaca

SEQ ID NO: 169654 - DNA, 319 bp, Homo sapiens
gtcaggagtttgagaccagcctggccaacatggcaaaaccctgcctctgttaaaatacaaaaattagccagacacagtggtgtgtgcctgtgtgtgccccagctacttgggaggatgaggcaggagagtcgcccgaacttctgaactgcaaaggcagtttcagaagttatcctaacccatttctgtgctgaagctcagaaaaaaggaggaccactcctgccactcagtgaatgtattaaagaaaaaaatgcttcatgacactcgttgaagatagttaggcaaactttattaaaggagggactaggaagatagctataga

SEQ ID NO: 169655 - DNA, 391 bp, Homo sapiens
tgcctcagcctcccaagtagctgggattacaggcattagccaccatgtctggctaatttttgtatttttagtagcgatagggtttcaccatgtttgtcaggctggtctcaaactcctgacctcaagttatctgccagtcttggcctcccgaagtgctgggattataggcatgagcctggcctaatttgtgttttattattatggtttttttcatggcatatacattgtattaagctccagcttttgggggcagtgtcccaaagttgctagatcttcctgtttttcaggaacggctagaacctatattcttaagtgaaatatcgtgggttttcagaagttggtgcctactttggcccataatttggggaaggccaggcagaataaatgtgtg

SEQ ID NO: 169656 - DNA, 415 bp, Homo sapiens
aaaataatggatggagtgaaagtttgcatactgaatagttagattgctgtccctcttctaactcaaggcctaatcctcttggcttcctgaaagctggcagccaagcttatgcttattcctgggaggagattggaagattcttctaaagaaaatgaccagcccaagaaaaattacctactatttggatgttcctgaaacaaaaatcaagatccttgccaatcactacatgtgcattttctgtatttaaaagccctgatgctcatatacagctttcagtcagctttttaatgttaaatatggaagccacatgaccagacatttgaggaaagcccctacataaaggcagaagccaaagtagaaaaaggagaataaaaaggaactggaagaaaaaaaacagataatgtaccatattaaa

SEQ ID NO: 169657 - DNA, 355 bp, Homo sapiens
caaactccccatctacactgcaatgtttcaaggccactttttcatcacctcgtaatgggactagagtaataaccatctaagcgagctctcaatatttatttttgcctttattccaatctaaataagtcatttcaaaacacaaatgtcatcaagtcaactacttgtttaaaacattcaatgatttcttattgatcttggaaaccaatgcaatgttcatattgagacacgatctggctgtgcctgcctttattacctgtctccctctactgcccctgctcctttttatccatctccagccacattagtttttgttcattttctcacacatgctttattagtttgtcagggaagccat

SEQ ID NO: 169658 - DNA, 323 bp, Homo sapiens
taacattttgtcttatgtatttcagagttctctaaagaaacagaggtggaatacaacccccagtcccattttcctccttcctcttcacagaggtaacccctatcctgaatctatttttattattccaattagaaattttaactttattgcatgtgcatatatccacatcaatctacatatttaaaaactttattcaaatagtattactctgtagttatcattctgcaagtatttctaaagctgcatgtatctatgttatgtgtagtctactgtgcttattttaactgctgtatgtggtttcactgtgtgagagacggaaggat

SEQ ID NO: 169659 - DNA, 314 bp, Homo sapiens
taacattttgtcttatgtatttcagagttctctaaagaaacagaggtggaatacaacccccagtcccattttcctccttcctcttcacagagacctgtggattgtaataacactggaaaatctacttcacaagagggaaagaagactgatatatcaaatgattctacagctactcccctaaattactgtatgatgctattacaaagatactctacactgtatttaaaatgactttactaattatgtcagtgggtatccctccagtaactgtgtacatatcttcctgcaattaaaaagattttaaacaatatcta

SEQ ID NO: 169660 - DNA, 433 bp, Homo sapiens
gcgtaatccgtaccattcattaacaatgaaagaaaaacaagtaaaggactcaagaactttccattaatttcttacaagctacatttctgccaattttattgagagatatcacggaacggtaaagatgacaaattttgctgtacaatgctctattccaacctcttcaattttcccatgactgttttacatttcccatatctttttctctcattttacatcacaaatttatacagaggatctatgggctagtatataccatgcctagcatgtgaacagcattattgttaagaaggaaattagagagtcaccacaccttccattaggaatctaacagttatgcttcttttcctttacagagtttccttttaccatattaagtcctccagtcttcctttcatgttactttaagacactgatcaaaatcttttgttcc

SEQ ID NO: 169661 - DNA, 471 bp, Homo sapiens
ctttataataatgtcaaataagcatacctgatatcagacaccctacaattgtgtactttctttttcctgggatatgtttagctcctttacaagaagatgaaagtgaaccaacttttataggaaaaaaatctgaaaacctaacaacctgccccttcaaagaaataatcaaagtaacatttttggttcaatatattttcccaaagaaatctgacaatatgatgcttacacagttttcttggcatttttttcaatgttcattatttgaatgatgctgttaagaagccaaccaaggaaacacacacaatttataaaacttgcataaaggaaatgtgtgctaatgtgacttgagaactccaggaagatctgcttcctcttagaaaactgtactgtgttctctttcattcatgtgttcaattattgaactaacatttgggaaaataggttagtctggctggagatgatgttttgtgg

SEQ ID NO: 169662 - DNA, 237 bp, Homo sapiens
gctctgtggcttccagcctggctttggtttttcatcacaagacattttattttatttaatttcattttatttttaattttttgacacagagtctcgctctgtcacccaggctggagtaaaatggtgtgatcccggctcactgcaacctccacctcccaggttcaagcaattctccctgccttagcctcccaaatagctgggattacaggcgcctgccaccactcctggctaattttt

SEQ ID NO: 169663 - DNA, 361 bp, Homo sapiens
catgccactgcacaccagcctgggtgacagagactctgtctcccctccccctgccaaaaaaaatcaatgatacagttagttctaagagaaggtataatgatataatattttttcttttcgcttaccttcattgtctaaatcgtctataataaacatacagattttttgccccttttcttgagactccgtttcaaaaggtggtatttgtaaatgtggtattttataaaatcaggtcatataaatttcctttaacctccctaccctatgcaattcaaaatattgcctttatctcgtctcctcagaattacagcgttcccattttcaaattttaaatagatgcagcattcctatcaaatgatta

SEQ ID NO: 169664 - DNA, 373 bp, Homo sapiens
gttgcttgttcactctgatggtagtttcttttgccatgcagaagctctttagtttaattagatcccatttgtctattttggtgtcttcttaaacttgaacacaaaaatctctttccgttcatgtattatagtacttccttgattttattacagttctgtagttttcctcaaataaatattgcacatattttgttagatttatgctcaaatttttaatttttttggggggtgctattgtaaatagcattttgattttatttggaaattccacttattcactgctggtgtatagggaagtggttgactttgtatatgtgccttgtatcctgctaccttcctataattgcttattagttccagaatggtttctttt

SEQ ID NO: 169665 - DNA, 433 bp, Homo sapiens
tggccctgggctctctcacttcctcagcaaccacctctttggaactttaatttccacacctttttttaaaacctgcacctcaagctttctccatcatcccagcctctctgcctgattccatcccatgtaaagtaacctcatctgagaacctgcaatcaccttttaccaaacacatgataagccttagcaacctagggactatgataactctggccttggcctaaggttacataagaacatgatagtttgctgaccttgtggagggaaatctaaatgaaatcaatataacaaacaaagctagccaagatcaggtatttccattctgagtataaaagcaactgatcttaagcaacgggcagagatgttaataccggagatatatttgtacaatcaaactcttgtgtgctggtgaaagactttacccccaaagtca

SEQ ID NO: 169666 - DNA, 441 bp, Homo sapiens
tgtgaaagtgtggtgtgagcttcattttctttcaaaagtgccgaactgcaatcaagagtaatttacataaaagacagcagttatttttgtaaaattacttcctaagaagagaccctgtagaagaaaccaccaatgttcatagtcccttatctggagtaagattttccagtggattctcaaggacataaggttttccttgtatgcagaagttatggtgagaaatcaagtatgcagaagcatctatcatcacctgcttggtagatctgaagatgacaggtaacttgtcaacatattgtcaacatacactttcctttccttccgctgtagcagcctggcagcttctgtacacactttattgtgcaggtgctttcttttggcagacatgttcagataatagagcaatccaatcaaaacatcagtgagactccctgacagaacatt

SEQ ID NO: 169667 - DNA, 574 bp, Homo sapiens
caagaaatttttatttgctgtatgagatcagatcgctgattcaggtaacatgcgtgtgtgccgtttaaagtaatacacaacgtaacatgaaaagtaatgtttatgaatagtgggaagccgaagaagaagggattttgagtcatgggatgtgattactagctatgacatttggaaactttagtaagctctcccagccatttttctcatctatgaaagggcaatatgaagaccttcttacaacatgtttgaagcgtttcagttgtctgataactggtattacccagcagtactctgatgggtaaggttcacttgtcaagttcaggataatgttggagctgcctagaaagacttggtactaatacttttactttatgtacaaaatgagaatgctatccttcttgatatatgcctatgtattcatatatattttgtctgtatatatgttcaatataaaagtcatttttcctcttgtaggaatttacagtatcaaagatgaggaaaatctatcagccagtgaatgaattcacatttttttacataaaacatagttattttctctctgctgtgcaaggtg

SEQ ID NO: 169668 - DNA, 522 bp, Homo sapiens
aatttacatcctagtatgggcatgctctgctcacaaatgcctctgctgagcagtttacatactgggtgaaaatgtacataggaatcctcatgggggatccaggtttgccagtgagattactatgtactcagactgaaaaagatgatttcttctgattacctgtgtgtctgccagaggtggggaaggactagaaagagattcctgcacaagccgttttgtctacttagagaatggcatgctagaagggttagcgagctaaattacagttttctttttgttgttgttgttggcttttatgtatatgttgaatagactaatagcatttgatgacccttttttttttttttactgtgaattcccggattttgtgtgtatgttgctcagagggtagtgcagtgagcaaagggatagggagattgtctgtttttttgtttgttgattggacacacttgctgctggtaatttgagcatctaaggatcttcctttatattgaagccctgaaccttttggtggaaggaaaa

SEQ ID NO: 169669 - DNA, 224 bp, Homo sapiens
caagacagaagaggaagaaaaagggaaagcagcagggggaaaaaccctctctccttaccttatattaaatggaagtagggtatttccaaatgaaagccttggctacctagtcatcctaaaaacaagtgatttccaaaaagacaacaatgagatttttaattgcttctagatgtacaagaacatagtccaggggagagtcaagacaacagccagctggtcgtggt

SEQ ID NO: 169670 - DNA, 142 bp, Homo sapiens
tattcattggatgtttaccatgtgacaaacaacttactaaatgctttacatgttgttactcataataacagccctattgttgtagatactcttatttttctaatttgacagatgagaaaactgaagcacagagaggttaaat

SEQ ID NO: 169671 - DNA, 543 bp, Homo sapiens
gctttacacaagatggcagctgtatgtccttttatgcttcttcagccttcgtgactatgtagactagtatttctaggtgccatcagtagactaacccagcgaatttgaatcttgtcttgaagtggacaaaagataagcagctcccactcacatggtatttgaatggcttgctctgagcaaaactttccactgcctttgacaggtggcatttatcacctagtttaaaaatagtcagttttcaggcatttgataatttcctttgatgttagattaaccaggaaaattatgtaaaatcactgtttttcttactactgaaaagcatttgttaattagcaggtgacccaagcactgtttaaggaggtatatccagacagtaaactcctggcagttaggagtgacatctgagccagctctgctgcagacctgtgaatagaagctctgcctctgaagccaccagatttgcacctgtgtcactcccagaaaagcacaaggaattgaactgagtcactcctaagaatcccctcccccactccctatggccac

SEQ ID NO: 169672 - DNA, 520 bp, Homo sapiens
cttagaggatcccgagatggagttgttataatttgcctcatagggatagtacaaggaaggggtaggctatgtgtttggtcagtgggttgagaatgagtgtgaatgagggttctatgtggttaatgtggtgggtgagtgagcgagtgagtgactgagtgagtgagggaagcttccctctggcttgctgggactgagttccttcgtaccaggaggtaggtagggctaacacaaataaagaagccaaacggtgttactccttgcctctcagaactggaacagagtcccctatcctccctctcagatgcatttcttaggggaagagccgcaggactttgcggaagccttcagcatttaggggtcttgggtcttcccctgacctcctgctctgtgcatattcattctcctaccacctggtgctcggtgccctcttaacttcatccgggcatcaaaggcctgttgtgccatttacttgctctacagtagctcatccttaacccagctctacctacctacacacaca

SEQ ID NO: 169673 - DNA, 748 bp, Homo sapiens
  misc_feature (736)..(736): n is a, c, g, or t
ggtcggtgaggctgactagaggattccgacgagttgtccgagttacttgggaggctgaagcaggagaatcgcttgaacctgggaggcagaggttgtagtgagccgagattgcaccactgcactccagcctgggcaacagaaagagattccatctcaaaacaaaacaaaacaaaacaaaacaaaaaaacaaaaccacataagtactaaaagaaaatatggatgaattctccattaccttggagtggggaaaaccttttaacagtgactcaaaatctagaagtagtaaggagagagagtgataaatttgattacatagaaataaaaagaaaaacttgtaacaaaaaagcatcataaacaaagtaaaaagataaggaataactacgaggccaggcatgtgtggcccacacttgtaatcccatcattttgggaggccaggtgggaggatcacttgaggccaagagtttgagaccagcctgggcaacacagcaaaactcctctctcccaaaaaaaaaaaaaaaaaaaagaagaagaagaagaaagaaaaaaatttaaaaacagtcagatgtggttgtacacagctgcagtcctacctacttgggaggctgaggtgggaggaatgcctgagcccagaagataaaggctttagggagccataatcaccactgaactccagccagggcaacagagtgaaaccctgtatctaaataaataaacataactcggacaactcgtcggngatcctcggagt

SEQ ID NO: 169674 - DNA, 629 bp, Homo sapiens
ctacactgtgcctcaaagaaccttacaactaaatgcaagtcaggaattgcagtttgttgcctgaaagcatgtgaagaggtaggaggctcattcagccagggtgttccaagagatagcatggagtggtggcccgggcactgtgctgtctgaacagtcacatcttgggagtcactgagaatgaaaggagaatcagctgttgagtatgttagggcatgtataaatgcattctcaattgcttgttcacttgactcggttgtacaagccatgaggggaaatgagatatgcagagatggcatgttgacaaacgcaaaatagtctttgaaatgaatcctgagttccttagtgtggttttcacaatgatacggtgaagcaaaggtacttctttctgtaggagcacacctctgaaattatcataaaagtcagtagaaaaaatgactcaatatacaaatattttctgtatagcttttctggaatgtgtcttatacataaagcttagttctcctgtagcttgaattgcttttcttttttgacagattcccttttaataaaatgaatgttagccagcagcatgattttgtcagaggaacaaaccttttcaattgaattacattaaaattctgttcttagca

SEQ ID NO: 169675 - DNA, 456 bp, Homo sapiens
ttgagggagtccgggtttgggtgcttgatacatagaaatatcatgaatagcagcagagaatacaagaagaagagaaagcttgggggagaagatagagaattatgcgttgggtatgttgaggatgaggtgcctgtgccatatccgggtgtaggtgcccaaaggcaactggaagtcatgagaagtcagggatagaggtaaatgtttgggagttgttaatacaggggtgcatttttaaaatatctgaagtatgttactggtggcactcaaagatttttaatgatgtaaggtattcaacaacatggaactacgtagttttaaaagaaattctcttgtaggccgcgtgtggtggctcacacctgtaatcccagcactttgagaggccaaggtgggtggatcacttgaggtcaggaattccagaccagcctggtgaacatggtgaaaccccatctctactaa

SEQ ID NO: 169676 - DNA, 323 bp, Homo sapiens
aaaaaaaaaaaaagtgcctagggcccatcaaaatcataatgtggccctgtgtggttgagcatcttttgaaaactcagtctggtctactggggtatagtagtggttatgtatctgcatatgacctctttgaggagagtaacctcgttgagaaaaggaacataccttcatactcctccagtatgttttttcagtacaatgaggaagtattcattcaaagaaatgatttttaaaaaattgaataaattaaaatttacaaagccaattttatcactggctttgattaaaatatgtaatggtgtttattgtagcctctacctaattta

SEQ ID NO: 169677 - DNA, 568 bp, Homo sapiens
agatctttcagctcagaggctgatgaatgaagagagaaggctgtgttaataggctaatcttaagatgcaaggcacccaggcagaaaacataaaacattgataaatgtgatactcagttttgtgaagtaaacttcatttaagtccaaagaaacaaggtgtgtcaaagtccaaggactcatccaagccatttatttcatagatgagggactgagggttgatgaggaaagtggcttatccaagtcagtgaccaagctgggtaaagacgagtaccattgactgataacatcttaaaatgttactcttccactggtaaatactcttgcatgactgcccaaaagctttgtgtcacaaagcaaacaacttagaatgttacttctacattggtagatcctccattggtagatactttaaagtcttaagccaggtctgggtccacttgtctcctgactttacaccctttcccatagattaattacccatctgtctactaatggtagttatttgtccagactccactgggctccagactcacagatccacctgtctactggaaatgttagcacattct

SEQ ID NO: 169678 - DNA, 381 bp, Homo sapiens
gacccgggacctgggcgggggcccctcctgtgttatcctccaaggccaggcttgaccagggcccactgccccctgtgaggctggacagatcctccccatgaccctttatcatcctgttcgcacctgctcagccctgaccactctgctgtggggctccgagctcctgggtccaaagccaacccgttttgctgttacccgtgcctggtacagtgcctggtgtcctgggggtacttagaaagcacggtgagggctgggcatggtggctcacacctgtaatcccagcactttgggaggccgaggcaggtggatcacttgaggtcaggagttcaagaccagcctggccaacatggtgaaaccccgtctctactaaaagtacaaaaa

SEQ ID NO: 169679 - DNA, 353 bp, Homo sapiens
tgagacagagtttcgctcttgttgcccaggctggagtggaatggcacaatctcagctcaccacaacctccgcctcccaggttcaagcgattctcctgcctcagcctcccgagtagctgggattacaggcatgtgccaccacacccggctaatttttgtatttttagtagagacggggtttcttcatgttggtcaggctggtcttgaactcccaacctcgggcgatccgcccaacttggcctcccaaagtgctgggattacaggcatgagccactgcaccccgctagccaacagtatttcaaaccacaaaccactcatctccacatattctgtattttagtcatatgaacaggc

SEQ ID NO: 169680 - DNA, 330 bp, Homo sapiens
taagtgcaagggagaacaaagaaagagaggaagttgcttatgaaaggtttaaggaagcaataacatttccaaataaggaagggccataagctatgagctaaggctggactgggcctgtccagacatgcctgagtaagccaaagcaactaactgggctgaagtgtaagaactaatggttgataggaggctttagagtaagaagctattatttctagtgtctattattttatttttaaaccaagatgagctttgaagaggaacttttctactttctacaattagccaaatttttatggtgacaatcaaaataagaattgaaaaatgatattt

SEQ ID NO: 169681 - DNA, 417 bp, Homo sapiens
aaaggctagaagatccataacttctactacctgactttataagcttcaactttgtatcatttttgccttggttaaatgaatgttgctttctttacaaggcattgatgtatttattgatgaactttggaagtaaatgctccttggagggttaacatttcagtttagtaaaagattcaatttagtaaaagattaatacgatgtgaagagaaaccagagtatcaacatttcaatttatttgaaagaattcaccactaaaattcatctagaaaatatagtcttggagatgatacatattttgaaggttcatcaagtccaagactgtttcttgtacacagtcattagagaattgaagcacttgcagaaatttccccctgaccaaatcaaagattgtcatgatcagctctctacacaattaga

SEQ ID NO: 169682 - DNA, 461 bp, Homo sapiens
ctcacactttggaatcagcctggaaaatgtcatcctcagttccttgtctttgctgacttttaggtggtacttgctgttcttcacagcgaccactgacaacccagcatcacaaatatgtgatgtgagcaaaaggaaatgtagagggatctaatgtggagactgtgagcctctggagctggtagtttgtgtgatgcatgatgatatagaatattgctgtggttcctttccatcgaaaatatagctattcctctgccgacatttgcagctgtgagaacagaacggcaggaatgcagtaggtgttcattggaggggtcgagtggaggagctcatctggttgccaggcattgctcagtgtccttggagatgagttgccatggaaacagtgaggggcagagaggaggggccgttcctttctagccaagtgagctgcagagacgaaggaaagtgaggcggacgtccca

SEQ ID NO: 169683 - DNA, 600 bp, Homo sapiens
tataagctccccaactgactgaacggaatccctcttggccaaggggaccccagagagaccttgaaatctaagttcctggccatgatgggatggaagctcagaaatgcctcattgtatcccatccctcactaacaaccattaggctttcttccctaagggctaaacagaaactggccctttcagaagagtatcactgatttccacctactacttcaccaagactagctttccacactctgaaatggatttctgtttgtggtctgttaggccactgtgtggtttcccctatgggattcctttttgtggttggaggtcaaattctttcttgcctgctgcttccaggaatgtgtgctgtgtgtctcagtgtgctgcacaggagggtcttatttcacctcccttgaatggaatggcagttatccagcaggtctgggtgcatgtataaatagagggatgcgtaagcctgcgtttaatatctagcacataaaccggccaccactgcgtgctacacagtcatgttttcattaaaggctgctgacagcaccgcagaccatgctgtggggcccagcaaaccacctaatcccactgcttgatcccaggcat

SEQ ID NO: 169684 - DNA, 184 bp, Homo sapiens
cggggacaggacaagtcctgtgctctgtatcaccgccttctaagggaggtggagtcttcagcaggacatgtacaccactggcagagaagtccctgtggacccaagctgcatgttgccccttgagagcattaggaagacaccgccttccatgtgaagggcagcctggcacagggcctggttgcag

SEQ ID NO: 169685 - DNA, 212 bp, Homo sapiens
atttctcttagcaggcagaaagaactcaaagctcagatggtcagggtcctgttggttcatcaagctcagcctgcctggaggcagccactgtgttgttccctctcttcgtcctccctctgcactctctcttgccacgggacatttgcacaagcagttccctctaactggaacactaagaaatatggaagtaaaaggggttgggagaaaagaca

SEQ ID NO: 169686 - DNA, 217 bp, Homo sapiens
aagaaacataagaaggataaaatcagaatccattgaaaattgttacctgggagtgtatacgtgggagagaaagcagtgagacctctctctctctctctctctctctctctctctctctctctctctctctgtctctgtgtctctctctctctctctctctctctgtctctctgtctctctctctctctctctctctctctctcttgatcgacagggt

SEQ ID NO: 169687 - DNA, 546 bp, Homo sapiens
tatgtctacatataagtgtgcattcatctaaagacataagtgattaacttcttttaatctataactaagatctgagtcctgaagacctttctctggagcctcagtaaatttacttaatctaaatgggtccaggtgctagggtgattacccttatcttgtctcctgctaaatcacagaggtttggggagttccttcagacctccaataaacttgtgtgtggaggcctggggaatttcttcagactgacaataaaacttgtttattccagtctggccaacatggtgaaaccctgtctctactaaaaataccaaaaagttagccgggcgtggtgacgtgcacctgtaatctcagctactagtgagacctggcctgccacaatgtggttaaggaaacatattaaaacatttttaaaaatcaagattttccatttcaatggccttgtaattgattgaaaagtttattttgagtcacatggtgttctagactcttgtggagggtttagattggaaaataagtaatgacagtgaagcagttgttatgttcgta

SEQ ID NO: 169688 - DNA, 424 bp, Homo sapiens
attttaaaaaatttcctagcagatactagttatagattaaattgtgtccctgccaaaatcatatgctgaagtcctaatccccagtatctgaaaatgttgccttatttggagattacttgatagagataatcaagttaaaatgaggtcattagggtgggccttaatgcgatattaccattgtccttgtaaaaaggggaaatttggacccagagatggacatgtacacgagaagataccgtgttaacatgaaggcagaagtcgaggtgatgcacctacaagccaatgaacaccaaaggttggcagcagagcaccagaagctagaggagaggcatggagcagattcttcctcacagacctcaggaggaacccttgatcttgaacttttagcctctagacctgtgaagcaataaatttctgttgatta

SEQ ID NO: 169689 - DNA, 422 bp, Homo sapiens
taactcagagctaacatcaaaatttcttcaacattaataattatttgcaaacaaacacaaaaagttcattttaattccacatttcccttacaaaacatcttttcttgtcatcagaatgtatgcatccatcttggttttcaaaattattaaaatggttaaatcttaaaccaacaagatactttaaagctcactacccatgcagaatccaaggacaagcactgattatggatatcataacagttatctataaggtttcagaatgtcacccactgatttctattattagtaagatttgctttacagaaaagaatagtgtaaatattcttttactcaatctaggccaaaacacctttttttttttttttttggggggggcccccaaaagagcgaccgcgggagggcatgacagcggggacgagggg

SEQ ID NO: 169690 - DNA, 471 bp, Homo sapiens
ccagccagagcaagacagcaagactctgtttctacaaaaatttttaaaaagtagccaggcatggtggtgtgtacctgtagtcccagctacttggggaactaaggcaggagcatagcttgagaccagaagttcgagggtgcagtgagccgtgattgcaccagtgcactccagcctgggtgactcagagtgactctgtctcaaaaagaaaaaaacaagttaatgagagactgaggtggacacggtacaaggcccccccattcccatagactgcctttgcatttatttctgaatgagttttgggaaggggatgacctctttctgctgtatctctaggaaataggtgagggctccagggataagcaaaaggtgtcccagcatcttggcatatatttccagacactctcccttcagttgctcatcagaggggccctctgagagctttccagaaaacttatgagagagtcaagcatt

SEQ ID NO: 169691 - DNA, 652 bp, Homo sapiens
tactggaaatatggagagctaataaatatattatgggatggggtgttacagtaatgagagaaatcctcatcttccacagtagaagtatgatagttaacaacaaactagaaattttaaaaatgaaaaacggcatttaaaatatttagaaggccaggcgtggtggctcacgcctgtaatcccagcactttgggaggccaaggcaggcagatcacgaggtcaggagatcaagacaagcctggccaatatggtgaaaccccgtctctactaaaaaatacaaaaattagccgggcatggtggtgcactcccagctactcgggaggctgaggcaggagaatcgctgaacccaggaggtggaggttgcggtgagtgagccgagatcgcaccactgcactccagcctgggcaacagagcaagactctgtcttaaaaaaatagatagatagatagatagagagagagacagagagacagacagaaaggaagtaagttgggcacagtggctcacactgcaatcccagcactttgggaggtcaaggtgggaggatcacttgaacccaggagttcaagaccagcctgggcaacatgtcaagaccccatctctacaaaaacattttaaaagttggctgggcgtggtggctcacgcctgtaatccc

SEQ ID NO: 169692 - DNA, 632 bp, Homo sapiens
tactggaaatatggagagctaataaatatattatgggatggggtgttacagtaatgagagaaatcctcatcttccacagtagaagtatgatagttaacaacaaactagaaattttaaaaatgaaaaacggcatttaaaatatttagaaggccaggcgtggtggctcacgcctgtaatcccagcactttgggaggccaaggcaggcagatcacgaggtcaggagatcaagacaagcctggccaatatggtgaaaccccgtctctactaaaaaatacaaaaattagccgggcatggtggtgcactcccagctactcgggaggctgaggcaggagaatcgctgaacccaggaggtggaggttgcggtgagtgagccgagatcgcaccactgcactccagcctgggcaacagagcaagactctgtcttaaaaaaatagatagatagatagatagagagagagacagagagacagacagaaaggaagtaagttgggcacagtggctcacactgcaatcccagcactttaaattaagaatatttagaaatgtgggagtaattccagaagagttgaaaaggttcaaagtatgttattactttcataacaactttttaaatagttgattcaattgttaat

SEQ ID NO: 169693 - DNA, 125 bp, Homo sapiens
atgcaaataaagttctttgcacctagtaaatgttcaatatacagttgctattattattttaatagtagtattacctcattattactatctgaatacaattagccttatgttttctcctatatcca

SEQ ID NO: 169694 - DNA, 222 bp, Homo sapiens
cctctagttaagtagtattattcatttaacaacaaaaaaatttatgcctaccttatgtaatgctatgtggaaggttctatagctacagcaatgaaccaaacacacccagaaaggcaagagagtacaatacacaatcgcaaattgtgatatctattctgacgggaaggtattgaatgctacaaaatgatgagtctgacttagtctgcagggatagggaagacg

SEQ ID NO: 169695 - DNA, 650 bp, Homo sapiens
tgttcctacacagacacactcaaccacacgttctcacatatatatgctgtaacaactgagaacaggttactgacttaatctaattcattctatcttcattgtaaaacttccactccagctgaagagcctgtttcatttcaattcaaagatttctcatatatccactaattgtatggcaaaactgactcatctccagactaagatattcaagctcaggaagtcaaataatagaaatgattttttaaatgtgtaagaggttataaagaaaaactttatgtgctccttatttaacctctattaagtaaaatcctttatagacctatctccatttctgcagtaaaagtgagctctacagttagcttgtaaggctaactagtgaaattcctggacttgttcttaaaaatgcaagttttagtaattaacaaaatgatgatgaagatgtcccttttccctacaactacagatggagggagatttttctttgccatacaactagcttaaaggattaatttgataagttgttaaactgagaactttcacaaaagtatccatcttgtttttgatataaatggagatacatgtagttattcataactgtcagtaatttgctgtttatcctgtttctatatatctgtccttgagagtataat

SEQ ID NO: 169696 - DNA, 463 bp, Homo sapiens
gaaattctccttcattggtaaacaggcagtcttggagagacactgatgtgactcacgcttgtgttcatattcaccacaattatggttggcagaacagacagacttattaggcaattagaaggaaataaatccaacttcagattgatctaccaaaatactcagtctctaagacttgtgctagatatagtggaactagtgatgagaaaaagtgtgatttctttattgaagagccatcattgagttatcctaggtctccttggagaaacttgtcaaaatgatccccggttagccttttgaatttccataccaatggagacatattgttgccttctagttccttaaaacaaaaatgtgataggataatttttaaaaaggattccatatggctatgaacttattaaaaatacataaatatctaggttatgaaatactagagtgccttttaaaattgattcagttgatg

SEQ ID NO: 169697 - DNA, 236 bp, Homo sapiens
gcaaaatcgagttcaatttaaatctcttttgagattctccccttcaactgacacagaaacaaacttggcaaatgcttggtagataggcaaacaccgcagtaatttgggatataccttctcacagaaacggctactactttttttttttttctttgagacggagtctcgctctgtcgcccaggctggagtgcagtggcgcgatctcggctcactgcaaactccgcctcccgggttca

SEQ ID NO: 169698 - DNA, 416 bp, Homo sapiens
tgagacggagtcttgctctgttgcccaggctggagtgcagtggcgcgatctcggctcactgcaagctccgcctcccgggttcacgccattctcctgcctcagcctcccgaatagctggtactacaggcgcccgccaccgcacccggctaattttttttgtatttttagtagagacggggtttcaccgtgttagccaggatggtctcgatctcctgacctcgtgatccgcccgcctcggcctcccaaagtgctgggattacaggcttgagccaccgcgcccggctcccatggaattcttttgttcatcttggccaaactcttgtatctgtagccagcagttcaaccatgatcagacaatcattcattcagttgcatctcagtttgcccttttcccaacaaacttactattattatat

SEQ ID NO: 169699 - DNA, 277 bp, Homo sapiens
ggcacgacagaacagtctctggacaagtcagaagtccaggccctcaggcacttttcttcctcccagtgaaaatgttacagagaagcataactataggaaagatttaaggcaggtattcaaaacccaagagtgggcatccctggaaaatgggattcagggtctggggagaagacttagacgtttacttcaattacttctaatttttacggtgagcaggtactgcttcggaagctttcagacactggagcgggttttcatggccctactgacccctgag

SEQ ID NO: 169700 - DNA, 540 bp, Homo sapiens
cactagtgtttgttcttctactgctgggctaagtgtttgaatttcactttcatttaagatttaaggctggacattatactccaaaatcattcctggcctttattgattagcactgatatagtgcatccaaactgaagatatatgacacccaagtcacactgggttttcaggccctgtttttcatctatgaataagcacactgaaagagttttgtttaatattattgaagttgaagcatgtcatgttcatttactgatatgtaattcattatgagcaaatgctgactctaaacgtgaagtcacatgaggtgtactccctgtgattctatgctatttagaaatgatcccttctgtggccgggtgtggtggctcatgcctgtaatcccagcactctgggaggccaaggcgggtggatcgcaagatcaggagatcaagaccatcctggctaacacggtgaaatcccatctctactaaaaaatacaaaaaattagctgggcgtgatggcaggcgcctgtagtcccagctacttgggaggctgagg

SEQ ID NO: 169701 - DNA, 200 bp, Homo sapiens
accacctctagagaaagccaaaggccatctgggaccactctcgaggtactcattcttcccaagaaggagcacatctgactcatggaagaatgtgtggtccccttcccagagactcttttgtttaaaagattttttttcttttcttttctgttttgtaagaggcagggtctcactatgttgccatggctggtcttgaactc

SEQ ID NO: 169702 - DNA, 127 bp, Homo sapiens
tctatcagtttgccagtgagatttatggtttacacttggtctctgtgaaaactctcggggggctttactgttacgtagcaggaatatgattatgtgaccaaaaaaacaaaaatccctagctgagatt

SEQ ID NO: 169703 - DNA, 371 bp, Homo sapiens
ttgaaggcagccgagttcccacatttacagagaaggaagctgaagctcctgggtgaagtaacttgccagggcagcctagccaggactttcgagatggctgggggttgagctcagctttgaaatcctgaagtcaaaccagtttagctagtgtggtgtcgtttgatggatatgtaaactacctggtattgtcactcttctaataacagtatacctcaaaccgagcaaatacaaacaccctttatctcagtgcatatcagtaactagtcccagtgctaggctgggctgtgggagaggcctgtttgtgtatttgtgttctgaggaaaggctgcctataatttggcttggccaacgtttagagttgacttggcacg

SEQ ID NO: 169704 - DNA, 210 bp, Homo sapiens
agtagaggcagtgaggtcagacggacctgggtttgagttcggaatctgcctcctaccagccataactcctgggtatgtttaagtcctgagcctcgttcttgttatttctaaatggtgagagtgatgggagacagaaaggaggaggggaggtgaggaaaactagatggaggctgagctcccagccttgtgtgtgacaggcgctcctgggct

SEQ ID NO: 169705 - DNA, 292 bp, Homo sapiens
ggttgcttactactattaaattcgtggtcgtgtcgacggtagtctaggacttatgagaagtttcatgtttattcagagacttaaactcctttcctctttctgatccaacatcctggagcacaggggtcaactcactatgaaaaatagctacccaatcatgggttctaaatttcaggaaggagaacgggtggagggcaaaatatagttctcactgaaaaatttttcacatactatcatctcattgcccacaaatcagtcgacccggccgcgaatttagtagtagtagtcgacc

SEQ ID NO: 169706 - DNA, 524 bp, Homo sapiens
tttttttttttgagacagagccttgctctgtcgcccaggctggagtgcaggggcatgatctccgctcactgtaacctctgcctctggggttcaagcgattctcctgcctcagcctcccgagtagctgggattgcaggggtgcaccaacacacctggctaaattttttgtatttttagtagagatggggtttcaccatgttggccaggctgatcttaaattcctgacctcatgatccacccgcctcggcctcccaaagtgtagcaattacaggcccagccgactctctgaacttttgtacaggtttttgtccatctgtctgttccatgacacacaggcactagcatatattcagctataatagcttataaatgcaagataatcaaataaatgaataaatgagagaataattatgcctgaacaaatggatggatggacagatggatgaatgaatgaatgaatgaatgaatgaatgaatgaatgaatgaaatctctcccaaagctataaccagcaagtcagacaatc

SEQ ID NO: 169707 - DNA, 243 bp, Homo sapiens
gaaattaatagcaatcatattcatttttcaatgacaaaacaaaatgtaagtatcaaatccttactctgtatatttcaattttcccagtttcattttaagtaacaccctaccaatgtacactaaatccgtcctttccaaaacatgtaagaattttgggaatcattccctccaaattctactttgaatagaaaatcatgcttaagcaatttcccattttttcttgcattaaactataaaactcta

SEQ ID NO: 169708 - DNA, 514 bp, Homo sapiens
agatagatctcagaccgctgtgctagcagtgagtgagtatctgtgggcgtgggaccctccgagccaggtgtgggatataatctcctggtgtgccgtttgctaagaccattggaaaagctcagtatttgggtgggaattacctgattttccaggtgccatctgttaccacttcccttggctaggaaagggaattccctgaccccttgcacttcccgggtgaggcgatgcctcaccctgctttggcttacgctcggtgggctgcacccactgtcctgcccccactgtccgacaagccccgtgagatgaacccggtacctcagttggaaatgcagaaatcacctgtcttctgcgtcactcgcgctgggagctgtagactggagctgttcctatttggctatcttggaaccgcaaacagtatgtttttcttacattttttcctttacctttttgtttgacttacaggggtttaagtattctgtattatcttgtttttattaaacctgttctagaaata

SEQ ID NO: 169709 - DNA, 532 bp, Homo sapiens
ctaatattaatttaatattttatacctataaataactaagctaacattctacttttctttttgtgatttatctttgggtttggtattaggtcctaatagcttggagttacagaatagctcgatgttcccttgaatagttataaatagccttttcaacttcctaaccttctagtatattttaattaaattaaacacatttacaatcaggtccttagaaagagaaagaaggtactttgtttgttttagacttaaagtaaaacaataaagtgaaaccacatagtccacttccctcttctctcagctgtggtctacagataggagactcacaatttttcccagaatggatgtaacaggtgtgatataaatgacctcttttagactctgacttaaaatgtctacactatctttgttgaatggtatgttaaaagaacatatttactatgtgaaggctagacttgtcaatataatgctcactttttgtttccaaggggtaattaacaatgaaaatatttggttaaaaaattaaatcccc

SEQ ID NO: 169710 - DNA, 368 bp, Homo sapiens
tttgatgttaccaatgtaattcttttagggcccacaaattgggctcatataagacaagaaacattatcaataaatgttgtgtgtgttctgattgctccacagattggctgctccccagcctctctccctttcctcaggcttccctgttccctgagacagaataatattgaaattaggtcaatgaacaatcctacaatggctttctaagtgttcaactgaaaggaggagtcgcacatctcttgctttaaatcaaaagctagaaatgattaatactaatgaggaaggcatgatgaaagctgagataggctgaaagctaggtctcttgagccagctagccaagttgtgaaagcaaataaaaatttcttaaa

SEQ ID NO: 169711 - DNA, 297 bp, Homo sapiens
atagacgtgagctaccgtgcccggccgcacatctgtcactttaaatctacacctagaaatgattaagcttagtgaagaaggaatgtcaaaagcggaggcaggcggaaagctcggcctcttgcaccaaatagccaggtagtgaatccatagggaaagttcttgaaggaaattcaaagtgctactccagtgaacacctgaaaaatagaaacagacataagtatcacttatgctgatatagagaagattgtagtgctctggatagaatagatgaaaccagccacaatgttaccttaatct

SEQ ID NO: 169712 - DNA, 492 bp, Homo sapiens
ctgattctagagatatcccctggagccgtttgcgtcctcagagtctcatgatcctaacgaaagaactaagcgccagtgtcttctcctcccagtggtgctcaggttaaacctaactgaactgatcacagctgttccccagatctccagctccatgaccctcagacttaaacaacagcagcaccagctcatccgtgggtctatatctccacgaccctcaagctaggaaaacatcagctcctccccgggtctccaaccgcacgaccctccaactagaaacacaccagctcctccctcagtctccagctccacaagcctcccactagaacagcaacaccagctcctccgcgggtctccagctttacaacctaagacattagtggcagcaccggctcctcctgggggctcaagctccaagaccctcagacttgaaccgcagcactggctcttccctggatctccaactcgacgatcttcagacttaaacaacagaag

SEQ ID NO: 169713 - DNA, 378 bp, Homo sapiens
agatctggttgtttaaaagtgtgtggcacctccccactctctcttgctcctgctccaaggctctctctcccgactctctctcttgctcttgttccaggcatgtaagacgtgcctactttcccttcgtcttttgccatgattgtttcctgaggcctccccagaagcagaagcactatgcttcttgtatagcctgcagaaccatgaggcaattaaacctcttttctttataaattacccagtctcagttatttctatatagcagtgtgagaagaaatgggttttcagattgcatctgaatgggaacataataatttaaataataaatttaatttataattaataataacatgtaattaattataaattaatttataatta

SEQ ID NO: 169714 - DNA, 180 bp, Homo sapiens
gcctttttgatccttataaccacccagagaggtgagcaggaaggatgacatctccgtttcaaaggagagaaatcaggtgagaaagatgaattgacttgcccaaggttacatcaggaggaagaggcagtttttggactttcaaattggaacttgactactagcttgctgtgtgaccttggg

SEQ ID NO: 169715 - DNA, 472 bp, Homo sapiens
tgagacacagtttagctttgtcgcccaggctggagtgcagtggcgtaatctcggctcactgcaacctccgcctcccaggttcaggcgattctcctgcctcagcctcctgagtagctgggattacaggtgcacgccaccatgccccgctaatttttgtgttttcagtagagatggggttttgccatgttggccaggctggtctcaaactcctgacctcaagtgatccacccacctcagcttccaaagtgctaggattacaggcgtgagccaccatgcccagcctacttttttcttttaagttaaatatagtacaaacaccaacaacagtggaacccggccattcccaatagcctcctgaaccttcacccgcattttccacttttacaacccactcagcaacaccactaaataccagagatgtgtggaatcttaggttctggaatgtttttgtttttatttttaattttttaaa

SEQ ID NO: 169716 - DNA, 578 bp, Homo sapiens
cacccaatcaacttttcatggttcagttgtggaaactgatgtccacagataaatgtcttgctatcatgtcagatagttctccagccacgactgaggcctgagtccccctagggcagaggaaatctcccatttctaaaagaaagccccgcactgttcatagcagtcacaacctctctcacatccctgaatcaggatccaacgacttgccaatcaacaaatgttgctggagagtttaccacaaacaagtctctgtgctaggccctgagaacacaagctgtccggcaacttcctgctccctaaagtcacagtctatggtggaggtgcaaacaagcgatcctgttggggcttcagggtacttcctcctgtgtgctttgcacgtagtaggtgctcagcgaacggaaacggggagactagttatcactctccaggcaagcccgcaaagaggcctcaggtgaaaagagaaaggaggatttttttttccggccctggctctgcgcaccgctccccagcgcgccaggcggggctgcgtccggagcatccttccctccgcctctgtcctggtccccgctcagcggccg

SEQ ID NO: 169717 - DNA, 295 bp, Homo sapiens
taatcaagaggtgaatgatgcttggtgggatgtgtggaggaattcctgcatcgcctgaataactagaaggaagaactttgacgtttgtgatcatttttgcagtgctgtgaactatacgatggtaaagccccagaaagagctatttcccattcattttgctcaccacacagggcttagtgcaacgcatggctcagagcacccacgggataaatgcttgtggaaggacagagccgtgtttctctgtcatcccatttatcccatcggatgccactgctcatggtgatctctggggagt

SEQ ID NO: 169718 - DNA, 132 bp, Homo sapiens
caggaaagaaaaggggcttttctaaggatacacagcaattcaaaggcagtacagtagaattggttaagggtactctatttgagctccaagcttggctttgctactttccttttttttttttttttttttttg

SEQ ID NO: 169719 - DNA, 170 bp, Homo sapiens
ggtagagaatgttctttattcttagaagatgcatgctaaagcacagggttataaagtgtcattatgtctgcagcttgttttcaaattattcaacaaaggtagatattacaaatatggcaaaatgttaacacttgtttaaactacatggtcttcatggtattattgtttca

SEQ ID NO: 169720 - DNA, 847 bp, Homo sapiens
ttattagaataaatgttgttgccaaatgaaaacatgacactgtatataactgctgaggcctattctcatgtttaaccttcctaagccagttttcttaagttggtggagatggaagactatagtaattttcctagcatgtctggcatctgctgctataaaagagacagcagtaagcatgaagactgtgtttcccatatttgtccaaatcactttgattttgcttttagagtcaagagtcttaaaaattggtgatttttccaattttttctgctaatagtatatttaaaaattagcatatgctttaggtacatgaaactttaaaaaagtaattataatgtacagttaaaaatttatagtaagtggatctcacaattcattttctaattagtaattgatagttttacccattaaaatgacaatgaaaatatttttactatgggttttcctcccatttgtttctaatcatacctttgataatattttataaaggcttataatcatagcagggaattaatttactacttaaattttatgtatatgtacagtacatttaaaaattaagtagtcagggcatggtggctcacgcttgtaatctcagcactttgagaggccaaggtgggtggatcatgaggtcaggagttcaagatcagcctagtcaacatggtgaaaccctgtcactactaaaaatacaaaaattacccgggcgtggtggtgcatggctgtaatcccagctcctcaggaggctgaggcaggagaatcacttgaacccaggaggcggaggttgcagtgagctgagatcacaccattgcactccagcctgggtgacatagtgagactctgtccccct

SEQ ID NO: 169721 - DNA, 332 bp, Homo sapiens
gtagaagaaaggtgagatggcatactgtctataatcagtgatacaggaaaaggaaatagagctttaagtgtattaaagttacaatagcaatacacagaggaataaaaataacgacatgggaaaggggagaggtatgtagagcgtatgaatgaaaccctatctatatcaggaaatcaataggtaatgtctaaagttgaaaaatcaaaaataggccaggcgcagtggctgacgcctgtaatcccacataaatataccatttattaatatgcaaataatcgccaaaaaacaggaaaaggaaaaatggttcaaactgattgactctggagatcagg

SEQ ID NO: 169722 - DNA, 347 bp, Homo sapiens
tgcggatgggaaataacattcatagtgagcttttccggctttcattctccagcttccatttgctccattttctagcttttattcttcagctcccctgtgctccatttcctcagtgaaatgagcttgtgctcctgctttctttctccacgtgattcacgctctccctgctcagtactaccagacacaatatccattcttcaaagcctgttggtaggcaggggtgccctgaaaaggcatttatgaacaaaggagaggtgagatgcagaattccatctgtctctatttctgctctgggatacagaactagaattattcctgcaaatggagtgttcatggtgagctgtgag

SEQ ID NO: 169723 - DNA, 226 bp, Homo sapiens
ggggtgactctagcaggatcccgacagcatcctaaccagatatgctaaaagagtatatgctaaatagactccagcctataaaggttgttactctgaaacaacagagaatacctgatggataaaaagagactgtaggttaaatcagtgacatattagaagctgtagtgctgatatgacaaattctctgtacagtagtcccactattacaggactagtcctgtgtagc

SEQ ID NO: 169724 - DNA, 418 bp, Homo sapiens
atgagagggtgtgttagtaagaagagcaagtgagccaaagggacaaagagaagcaataaggaggaagaaaaagatgaaaaaagaaaaagaaaaagaaaagaaaactctaaggcctgagatggtcagagagctgcccaaggtctcagcaagtcaggtgtagggctgtgcttggaattcagagctcctgattgcccaggctatggctagagaaggtttttcccagccaggtccacaagactggccctaagagaataaagataattgtcttcttaggcaaaatcctggcactggaagcattctttaatggccatgaatttgccccaatgcctctgaactaaaattcacccaaagaaacttaaacagatcattttgggcattttctctctttcatcataatccttagatttcccacaacaga

SEQ ID NO: 169725 - DNA, 599 bp, Homo sapiens
aattcaacttttctcagcccctggtaactaccaatatactttctatctctatgaaatggtctatcctggacacttcatataaatgcaatcatacaatatatggcatttggggtctgacttctttcacctggcacaaggttgtcaggtgtactcatgtcatatcatctatcaaaacttcattccttttattttattattttttacatgtaaagagagacagggtctctctatggttcccaggctggtctcaaatgatcctctcgccttgaccttgggattacacacatgagccaccatgcctggcctgaaatatattcttaaaattaaatctgaatcaagtgttgatggaatctaacaagcacttctctgggatagtatttataacaccttctacaagacagaactaataaaatgtagcttgcttacatctgaagaggaagtgacttttcaaacaatgaattgaaaaagatgatagctaaaaacaataaagagccttcttcctagggtggaatattgatattttatgtctttcagtaaagaaggcagtaggtcttttcatggttccaccttttaagattcaggcatttttagtatattca

SEQ ID NO: 169726 - DNA, 329 bp, Homo sapiens
gtgtaaaagtggtcccttttcactacatccatgccaacatctattattttttcattatggctattcttgcaggagtgaggtggtattacattgtggttttgatttgcatttccctgataattagtgatgttgagcatttttccatatgcttgttggccatttgtatatcttcttttgagaattgtctatttatgtcttcagctcactttttgatgggattgtttttttcttgctgatttgtttgagttctgcatagattctgaatattagtcctttgttggatatatagattgcgaagactttttctcactccgtggattgtctgttaa

SEQ ID NO: 169727 - DNA, 322 bp, Homo sapiens
ctctctctctcctcccccaccaccactttctgtaattccaattacatgtttgttagatctttcaccatatcccacacatctcttatggtgtttttctgtatttttctttctttttatcgcatatttatccagatactttcaaatgactgtcttcttgttcactaattctctgttctgcttctaatctgctataaatctatttactgaattcttcatttcagtcagtgcgatttttggttctagagtttccatttgactctattttatgaattccaggtttttgctgaagttctcatcctttcccttttttcttgaagatatt

SEQ ID NO: 169728 - DNA, 162 bp, Homo sapiens
gcctgagccccacgtgactttcaaatgttccactggacagaaatgtaggtgaaaaatctgagcctagaatctaatctcatgtgacatattaatagaaaggtttttttgcaagactttcatatatattgaaagcatactgcagcaaaccgccactgtgcacat

SEQ ID NO: 169729 - DNA, 416 bp, Homo sapiens
tgggatggcaacttgtgaagtggggccagtaggggagcgtggggtcctggagagcccctgggcctagttggctttcctgacgtgaccaaagcagaccccgagtgcagggagtgagctctcctgcgggaagctaaaaaccataaggagccttgccaaggggcctcaccaaaattgaaaaggtaagccagagcatgccattcctctgctcaaaacctacgaaggtaggccaggctcagcggcatgcacctgtagtccccgctcctcaagaggctgagtcgggaggattgcttaagcctgcgggttcgaggctgcagtgagccatgattgtgcctgggaatagcaactgcactccagcctgggcagcatagtgacacctgtatctaataaaagtaataaccataaaataaaaaaaaaac

SEQ ID NO: 169730 - DNA, 328 bp, Homo sapiens
tgttctctggttgccttgttggttgatcccttgaggcggtcgatacctattggtgatggagcaaaatgagcagtcggtgggtgttcagcagcttggcatgggctgggccactcaccagctttatgacctcaggcaagtcatttttacctccctggaccaatgtactcattatgaaatgagaatctgacctagatgattctaatattgagagggtgtgatttccattagatagagtccatgattccttcctttttaaaattggctgggcatgggacagggccagtggcttcgagtgtttacccagccaggggaggaggaaggacatagc

SEQ ID NO: 169731 - DNA, 370 bp, Homo sapiens
tttcatcaaagtgcctcagagacctcaagacaaatgtctccacaccatcttcaggcaggaatgttaacagttttctatatgagggttccatgtaagattcggttttacaagttttgcttataaaaggcttgcaaatgtttacaaaataaataggccttaaacttgtaacattctgtacatgtaatatcatcactttgtggtggtgtttatttttctctacttgatgctagaaacagtaacttttctgaagcttttgttttaaaaggtgttttgttttgtgtttttttttttgaaataaacataaaaataaaaataaaaaaacagtccagtgctagagctggtggtaaaagtgaagacatataaggaaaga

SEQ ID NO: 169732 - DNA, 158 bp, Homo sapiens
catatccctcccaaccacaggggcagtgcagtggtggctcagagggttaggtcctagggagaggcaaacacaggccctggaataggggaggtgggatccatgcagagaggagaggggaaggaaggcatgataactccagcagccatccgggataccga

SEQ ID NO: 169733 - DNA, 316 bp, Homo sapiens
attaaaatgtctaaacaaataactgaacagaaaccaaatcataggctatcttttcatccttctttgatccagagcatttagcaaaccaacctattatttgttcagctatggtagaacaaattctaatagaacaaattcaaataaagaaatgattgggcaggaccatttgataggttaataccttttaaatatgtgggactaactaaaaactaacaagctcaaaatgccaactggtacccattttttttttttttttttttttttttttttttccccccctttttgtggtggggggggacccctcaaagagtcaccc

SEQ ID NO: 169734 - DNA, 355 bp, Homo sapiens
gttatagaaaaaaatccaagggtctacagtcttttgatattctatcaatcaaaatagttgaagatgtcctacatgaaggcattacatgagatgctgagggagataccaagctggctgcctgacctcaagaaacaaacaacctagccagacagaagtaactgaggaagaagaaatcagtgttggtttcagaacattagatgtcaagtatacataaatgtcagtgaaagattgttattgggcagtattcagaggaaatcattaatgggctgcagtaagctagaggacttctctagaagaaaacctttgaccagttctttttttcttttttcttttcttttttgagacaaggtctctc

SEQ ID NO: 169735 - DNA, 146 bp, Homo sapiens
ggcttgaacccctctctcaccctcagccccaaagcagccgctcaagtgctttcctcaagccctgggccagcacataaagggctgcctcactcttaggtgtcttaggtcacgggcttctcaggagctcagaagtgatcacctctggt

SEQ ID NO: 169736 - DNA, 586 bp, Homo sapiens
ctcatagaaataatatattctgcatttgtatttttaaatcagtttttaaaaagtaacacatctaaaatagtaagaggcatgtctaaaattctagtgtaggtctgtttaacaccacagtgagtgctgcttttttttggtgattgagggcctactgtaatatatcattgtggcagcttctttggaagataagaaattatccaccagaaataaagaggacacattctcttttaaggaaaacaccatctcggcttttaaacacttttcttttttaaagggtgaaggaagccatggagatttcttaagaagagagacacttcctacctttcttttgggaagcactgtactgattctgttcagcagtgtacagaattggagccatagtagaaggaggtggagattggagagcgcctagctcagcacccttggcgactagttgtagccctgactccttggagtgatctgtatgtcactctgtatttggacacagctgtttcctcgggttgcatggtaacaaaccaaataatttgcctttaggctcttttgcttactatgtctgtcatcttttacacaactgaagcctttggtg

SEQ ID NO: 169737 - DNA, 225 bp, Homo sapiens
tgagaaacacccaagaattatcaataaaaaaataaattaaaaaaataataataataaaaagcaaggtgagactacagtactctccctctgccatgtgaggacaagatgccagccaacctataagccaggaagaaagccctcatcaggaaccaaagcagcagcaccctgatctgccgcttctagcctccagaaccatgagaaaataaatttctgttgtttaagcca

SEQ ID NO: 169738 - DNA, 151 bp, Homo sapiens
atcaaaggaaaggagaggaagatgaggaggaggaggaaagaataggaggtgagaagagaagggaaaggaagagacaagaagggaagataaagctagaacaacagaaaagaaatcaataaggatttacttgaaagaagtgacagtaaaagaa

SEQ ID NO: 169739 - DNA, 150 bp, Homo sapiens
cagtccattatcaagtatgtctttttccatgggtattttctcccagtctgtggcctccttcagttttgttccctcttcttgtgtgtccagcagattcacagctccttatgaaagaggtgcccaaaacaagagcagctatgggggagcatg

SEQ ID NO: 169740 - DNA, 413 bp, Homo sapiens
gagacagggtctcactctgttgcccaggctggagtacagtgacacaatcttggctcactgtaacgtccacctcgcaggagaattgcttgaacccaggaggtggaggttgcagtgagctgagattgcgccattgcactacagcctgggcaacaagactgaaactccatctcaaaaaaaaaaaaaaaagaaaagaaagaaatatgaaaagagagatgttgaaaaaatataaaatatcttaccagcaagtctataggtcactttaagagagtgggtgggttcaaacctgagctcagaaattcttgagaatgggaaaagcaagtattgacactcagggtgcttacattatatgaaagatggccccaacttgaacctttcttccagtggaagggaatgtcatagcaaatgtacttatc

SEQ ID NO: 169741 - DNA, 347 bp, Homo sapiens
gtcccagctgctcacttgcactgcttgtctggggagtagctcagcagggactctgagtctgcagaagaggaggctgttggagaactcagtggcagggcttgctgttgaggactctggcccatgagagtctcagcagcacctcagtcccacatggtcaaagctttatcagttgccaggctcatcctcaccctgcctgtcttgcccacgtttgccgagtacactcaatcagcataacagccagaacatagatgcagtttagtgacaacacaggtggaatacatgtggcaaatgaccagcttggggtttattttacacaaattaatacttggtgataatatttggaatta

SEQ ID NO: 169742 - DNA, 325 bp, Homo sapiens
gccccacagaagcattaatcagatttatacttttccagattacatatcctggcttaagtctgtaccctaatttacattaagagttggaatcctcacatggaaaggcgggggtgaagataaaaggagtgagacttaaatggacattcagagatgtgagaatgtggcttactttcttactttgcttgtgccatgtcagtgctagaggagcagccttgtttatagaaaattcattttgcattttcttaatttagggaaacatgtaccaccattgaaataacctctcagacttttgtttgtttgtttgttttactttgtgaaagcgtag

SEQ ID NO: 169743 - DNA, 356 bp, Homo sapiens
ttcaggaacttcatcttgttagctagcttgaaatcagcaagtgctacaaatcagggtttgatttattgttctgttgattgtctaaactaaagtgatagagaaaatgttaattatgcagattaaacttaaagatgtgtctgtagctattatattttgggcatagaaaaatctgagaaaatagccttccagtatttgaagacttacctaatttagcgaagaagttgcccacgtcattgacaaatgagtaaagttccaatacacaactttgttatttcacttttgccttgctcattaatgtaaatcaaaatatcaaccaatattcatgtcagaactatacttgcttgtcagttgcaatc

SEQ ID NO: 169744 - DNA, 260 bp, Homo sapiens
aggccccaggttcagttcaggtctacctgtgtgtcttctcatcctgggacttcagttgaaaacacagctcccatataagataatgtaggtcttgtggagggcatgggaacacaagagggttgctagaatttgcagcgactcctaaatcctttgtgtggactggcacactgtcacttttatccatatttgtttgttttgcataaaaggttaaattacgttttgttgttgttgttgttgttttgagacggagtctccctctg

SEQ ID NO: 169745 - DNA, 469 bp, Homo sapiens
gattcccaaggcatcgaaactttagtctaaattggaggggaccaggccacagctcctaagtcccacttggcagtttgaatttggcaactcagttggctcactgcagcattagggtaaaaaattttgaaaagtctattctgtgttatctttcatggaatcccagaattgaacattttaatatccaaaggggagtggcaattttaacttcatctagtaagaatatattagtgtgcctctcacaatttggaactcaataattaactattagaattctcaatggaaacaaaaacagtctatacatcttgatttttcctgaaaagtccttggtaccccaaccttcagaagtaagaagacacacattgccaagcacagttggaaaaccacagagtttgctgtatcgcattgaaaaaataactccaacaatgggtagaaattgaaatatatgtatttgagtattttggccagaact

SEQ ID NO: 169746 - DNA, 471 bp, Homo sapiens
attccacttagcgtaatgtcctcaaggttcatctatgttgtaatgtgtcagaatttcactctgaaatttcactctggaatttttaaggctgcatcgtattccattgtacacatgtatcacattttatttatctgttcactcatcaggacacacattgcttccaccttttggctattgtgaacaatgctgctgtggacctatttaagttcctgctttcagtacatttgggtatattcctagcagtggaattgctaggtcatatggtaattctatatttaactttttgaggaactgcaacacggttttccacagcgggtgcagcctttttcatttatattttacatttcttcaatgtacacaggttccagtttctccacatcctcgctaacacttgttattttccgttgtttttttaaaaaattagagccatcctgccgggcatggtggctcattcctataatctcagaactt

SEQ ID NO: 169747 - DNA, 266 bp, Homo sapiens
gacacccgtagaagcagctgggtccaccaggaggcaggagtgaggggaaggcatggcccagagccacctgtggcttccatgggcaggtctggccaaggtagggtaggcaagattgagcatgctcaggattggatagtgtggacaattctctaggctatagatgtcagcctctggttgtctagtatctgtccctggggtgatttagggcagggaaaatattggcttggtgtctgagagtcagataaaggaagtgttggggataaata

SEQ ID NO: 169748 - DNA, 439 bp, Homo sapiens
aggatgagaggcgtatgaaaagacttgagggcctccatgcacgtgggcaatggctggagctgcatctcctatttttagaccacatctgtgagttctgccattgttcctagtgtctaagagagtaatggccgttttcttctacaaattttaccctacgggaatcttcttctataacagccctaagcactaggttgactgtctgaaaccaagctgcagatcctagacggacttggaacagtagaaggaagggcatgtgccaggctctttccttcttgtttgttacttgagaaagaagaaacaagccagtctgcttttggttttgattggttgataccagtctggtaggtctgaagggagatgccaaaaccccactgctttaagttccttcctcaaaatatgtaagacagcgtaggtgctgttcttttcttttcagacggag

SEQ ID NO: 169749 - DNA, 481 bp, Homo sapiens
taggaagtaaaatctcaagtacagaaaatataaaaaggtataaagaagcagaaggatggaaactgccagtgtctccactgggaggatcgggatgaaacgttgcctggcagagcctcagacttcagagggaaggggcctggagctgtgctttgcagctgcccctgagtttccactcctggtttttgtgcatgcgggtgactgtgcaggatgacttagtgtcgtcatgcttatgagttattttgaatcttgcttttcaaaactttattatcaatacacaactttctatcatattacaaaatcttcttacacacagctttcaccagctgtaggctgtttccaaacagaggacctagccactcttcttttgcatgtttttttcattattgtaattaatatccttatacctaaagatctttctatatattggattttgttttaaaatcacagatttctcaataaaagttactgggtcaaaaggcat

SEQ ID NO: 169750 - DNA, 480 bp, Homo sapiens
gagggttgaatcacaactgctatttcatagccaggaaattgagatcaactgattttacttactcggataagaagtagttggctctagggaagctagaaatggaagtctctgtctttgattcattttattagattagtgtttcccaaacttggctggtcatcagaacaatgaaaaagtcatttttaaaatacagattcctaagcttaaagtctaattctactgattcagaatctctaatgtgtcaggctgcaatgattctatgtatgctagtggtagtaatgtttgtttttgctgctaagaaagtccaaagggagccttatatctgactgtcagaggagtggggtttcggagaataagctaggtcggcttccatatctaaaaagggaagtagattgaagatacaacttatatagctgtcactcatgctaagtgtctatcaaatcacgaataaagtgcaaataattcatatgtcatcaactc

SEQ ID NO: 169751 - DNA, 344 bp, Homo sapiens
agttgcccaacaccacactgctaagaaatagtggaactgagatttgaacccaggaagtctaactccagcttctgtgcctaaccagtctgctggctgcctctctgatgactaccttagacactctagtccagattctgcaagggtaggtgttccaaagcccactatttcatcctcattttcaacttgaatcagttggtctttattgcacagacctctgaattgaaaagggaaatcaggtctttcacctcctttgtgggaagagtgatgattggttagcgtgtctgccatggaaagtgtggtgatttttcaatgctgcttgctatggtgtagaggggattgacaga

SEQ ID NO: 169752 - DNA, 310 bp, Homo sapiens
cttgcattttcgaagagcttaatgaacatagttgtgtcactggaggtggtgagcaccccgcctgcggggtgtgcaacctctgatggtcagtgatgctgtgctgtgtgctcaggagtggggatggaactcagtgcttctacttcccttccctggacggggcccaggcacagtcaggctcgggcccccagccttggtaggggagaactttgttcttctcagcctacttagtaggggagggtgctctcggcccctcagccagtgatccaggacctcgaggagggggaggaaaaaagaaagggagggttggtgg

SEQ ID NO: 169753 - DNA, 794 bp, Homo sapiens
ttctgggtccactgttcaatcataatatccaggctgtataatgccactgatttatgatttataattagagattttatttactaaaaataaagaacaagaaagaaaccagctgaatatgaaaattggtttatggttcaatctgattccagatgtgggtgtttgaacatcttgcagtgaagttatcaaacactaatagggttgttacaactcaggtgcttaattgaatgggctctggttggccaaagaagatgagacaatctgagcatcagtaagcattaactgcaatataatgaatcatatcaaatatatttaaatccgtgagttcataatgatacttcaagaactcattagttttcttcagagtatgctaaggagccaactatgctttagagcaaccaaatagttgctgagaggaagtttcttttctcagatagaataaaacatcaccattttctaatgaattcctgaacctaagcaaagatcatgaatggctgctaactgcacgggcagaaacggacattagctttctcttaatgaaagttcacagtgctgcccatgaagtattcttgccaaaaaagttgaacccgaatgtgatcaagtctctagctctaccagtttacaggaaacacagaagacagagaaacacattaagtgataccatgtgaatgcagttagcaaaatataggttatggggaactcttagagacatatgtcttgtttttcaacgagcaaattgtagggagaaaaaaagagaaacggaggaggaaaccgtagattgacagcgtccctaagga

SEQ ID NO: 169754 - DNA, 612 bp, Homo sapiens
gagatatttacggattgacggtacggtcgatcacacactaaggtatacagctctacgcagtatagtgagtcagatgtgtacatgcccatagggggtaatcatcctctaggttaagggatggaccctttctggctcccagacagctccccatcccctgtcccacatagtccccctttaggtaaccgtgactctcacctctagccgcgtggatacgttgcccatgcttggacttcctatgagtggaatgctgcagtctgtactctttcatgtctgcctccttctgcttcatgttatgtttgtgaggttcatcctcattgtagcctggacctgtaacttgttctttttcacgggtgtgtagcattcagttgtgtgaatctaggaaaatgtaccccttcttccttgtggacaggtggtcaaggatgacaggcagtcggctttcagcttggagctcttagaactaaaactgctcccgaggctcgtcttccggtggcatatgaggatggcttatgttcgtcacgtgctcaggagtggggttgctggagagtcctgctgaaacgtcaccagcaggcattcttgtgggtcctgcagacacaccgtcagcagcgccttgtg

SEQ ID NO: 169755 - DNA, 216 bp, Homo sapiens
gaagaaattcaggattacttcttgttttctagcttcagcagccaggtggagggtggagccagaaaacaaaatggggaagatcagatctgggtggaagaataggtgttgagaaaatctaaagctgtttttcaacttgttaagtgtgaggtgcctaaaacctccaggagaaaatgtagagaaaacagatgccaagagttcatcagttggccgggtgca

SEQ ID NO: 169756 - DNA, 455 bp, Homo sapiens
agcgaagggtgctggaaggaaagaacaggttaggagagaccggaggtggggagaaagcagagaccccacccgcgtggaggaactgcgggaactgcgtggtagaaagagattaggtgcaagagaaggtccctctcccagggagataggctgtgggaagatagaggagcgacaaaaagttccaaaccttgacagcctccttcagggaaccagaaaagtaaaaacaaaaacacaaagatgtcattacttaggttgttattttagaaataggacctgtccactaaggacaacttttttttttttttttttttttgagatggagtcttgctctattgagcaggctggagtgcaatggcgcggtctcagctcgctgcaagctctgcctcccgggttcaagtgatttcccttgcccaagcctcctgagtagctgggatacaggcgcccgccaccacgcccgg

SEQ ID NO: 169757 - DNA, 627 bp, Homo sapiens
aatgtgagaaagcattttatctcttcatgatggtgtttttgttgtaccgtagcttcattcattgtaccgtagcttcattaggattacctttggacatctccatttaagttaggcagtttttttaaggagccacttgtggcttaatggcaattacgtttccatcataggcttttattttatttccagctttataggtgcttttcaacagtctttcgtattataaaatggaactttaaatgaacatttagattttaataagattgcttttcaaaagtacagtaattatgctttctttaaacattgctgcatttgtctcataatggaatgtttttcatgattgctacatttaacagttttctgtgattggaaatggtcatcaagtcaaagtgaaaattgcaattttcctatgttatcttgagaaatttcacttagagatttcattgaagttaattctatgtcactattgttggtaaatgaacagcttttaggaagcagtttctgtaatgaaatttcaaatgttctgaatatttctgttttatagttaactgtgtaatactttcattcaggttttcaaataaaattactgcgcagttaaaggaaagcaatgttatgtcgagctttcagtaa

SEQ ID NO: 169758 - DNA, 381 bp, Homo sapiens
gttaaattgtgatataaaaatgtaacagttaaaagaatacttacatggccgagcacagtggctcacgcctgtaatcccagcactttaggcggccaaggtgggaggtttggttgaggccaggagtttgagactagcctgggcaagatagcgagaccctgtctctacaaatataaatacataaataaattagctggtcatggtggcacggtgtctgtagtcctagctacttgggaggctgatgtgggaggatcacttcaacccaggaagtcagggttgcagtgagctatgatcacagcactacactccagcctgggtgacagactgagaccctgtctctctctatatataaaaaaagagaacctgtaatcccagcacttgagg

SEQ ID NO: 169759 - DNA, 351 bp, Homo sapiens
aaagagggtgaggccaggaaaggaggccaacaccctacagtgtcaccaccacctgctttcagggaagtcacgctgaagtggggacccttgaggcaagagttctctggggaaacagaggtggggagaagatcctaggacatcagcaactcaacccccaaagatcctcacccccagaagtccccttcaccagttttgtgcaacttgacagcctgattcttcagggtggaaagagcaattgaattctgggcagcaaccccagagccctgtcttctgccttcacccaggagacgtcgggtgtgaccactgaatctcagtccagaatcgagatgggctgcaccagcagccagaccc

SEQ ID NO: 169760 - DNA, 205 bp, Homo sapiens
ataggcagacactgcccagagctcaatatggacaactgtgctcctgtcgagctctgcagggctcagaatcagtcccactgctcctcacccgcacacttgccggctggttattttgtaccgatgttacacatagagtcatatctctccactgttctagagggaaagcttactacaatatttcccttggaagaaagagatacagtga

SEQ ID NO: 169761 - DNA, 560 bp, Homo sapiens
acacgtcctattcccatttttcttctgaggtattcatcttctatttgatggtaagagccaaacagaaaagattttaaccttttcttctatcacaaatattgtatgtttcccacttctccatttgccttttaattttgtctttttaatttgttgttgttttaatcttgaaatgtagcatttccagctagtcaaatcctctgcatttgtcctttgtaatgccatataagggatgatctaccgaagctggctaatgacctattagtttctaaaaagcagccagtgtaagtcccccaaatctgcacagcctgcagaggttccactcagtgttggccagatggaaggaatgtggagtagaaacgctaccagatggactatgagtcaggaggcccagatgcttgtcctgggtttgctgcttgcttgctgcaagtccttaggcaaatctcccattctctctgggtaccataaccctctgtcaacaaaatgaaaggtatggacactacactctcaaaagacacatcatttttttttctttttagtctggatgctcggcgtgtgcagga

SEQ ID NO: 169762 - DNA, 345 bp, Homo sapiens
acataccctttaatactcaatttaaatatcattccctctgcgaagcccttatctctgggcagtgcctactcctccctttcctgtattttcatcacgccttgtttatacctttcttatagcctttgtcatgaaactgattattagctttctgaaaagataataaaagaaagataataagaaaagacaataaaagaaaagataataaaaagattattatcttttctgccatggattgtaatcctcaagagggcagggattgtactttacttcttttcgtctgcttggtgacacagttactataacagcatgtgcttgataaataaataccacttatgctaaatacaa

SEQ ID NO: 169763 - DNA, 334 bp, Homo sapiens
agtgctctgttgtgacctttatttttatgagctgtgagaattaagaacctaccagttttagtttaattaagcagtaagacacagcagatggtgcatttgtgggtgatgattgcattccactggtttcctcaagcagcactctaaccctatggaatgctttgcctggagtatcacgccactgttgcaaaattaccaggaagacaaacacattgtaataatgtagtcagaaaatcttggaggacagtttagaaaaggacctgaactccacaggagttttagtagttagcagctactggaactaggatattaaggagaggaatccatgacataacgg

SEQ ID NO: 169764 - DNA, 392 bp, Homo sapiens
attggagatcccctccccacctgatcatggggtggcattagggtcctggagaagggctatagagaagcccagcctggtcccaggtcccacacagagcttctctgacccagcacccatgattgggaaggtctccatgttctgaactgggggtccatattctgaaaggtgggcatgcgcggcatcaccattgctggggctgccgtcaaaacacatagtgctctacttacccatcaggggagagaccatgatcacaaaggtggttttcccagggcgagtcttctccattgtactctggatgtgctgatccctgcaatttccccaaaggtgggaaactcgacttcataatttgtggtaatggggaactgcatttgcactctcccctggcattttgt

SEQ ID NO: 169765 - DNA, 302 bp, Homo sapiens
gctgcttaatcataacactgtttcttcaaatgagaatgcacacagaagcccactatagaaaagcagacagccaacccgtgttgagagccctgaaaatcgttggctgcacgaacctttccccactggacagatggaaatggacccgtggggcaatactgccccaactctctcagcccagggctctcccggccgtatcagcttaatcagtgccagaggcatccagcctgcatggagctgcctccagaaggccccaccagcaggcagtctcagggcagcgtcaaggctgcacacttctgctaaaa

SEQ ID NO: 169766 - DNA, 413 bp, Homo sapiens
tccacctcctgggttcacgccattctcctgcctcagcctcctgagtagctgggactacaggcgcccgccaccatgcctggctaattgtttgtatttttagtagagatggagtttcaccgtgttagccaggatggtctcgatctcctgacctcgtgatccgcctgcctcggcctcccaaagtgctgggattacaggcatgagccaccgcgcctggtggtttacgggtttttaaacacccatctgccttagaggcttagaatggctaaaaagcaatgccagtggatgcagtgcagccgagctggccattccacagggaagagtgtgagaatcccagagatctctcagcacatgggaggtagaatgtgtgcagaagctggtctttcctctacagacctttctcccctggtctaact

SEQ ID NO: 169767 - DNA, 437 bp, Homo sapiens
tttttaatgttctgaacttgtagaaatgtctaattaattttcagtggctcaatgagatttaggtatatatgagcatcttccaaaatatgtagagtcacttggcttcaggtctatgatgtgtgggatcatgtgatgctaaaaagcaccagggccccacgtttcctgacccctggtaaagttcactacccaccatcaaactggcaactgacatgacaccagaacgatcaaagggagatttttttgacttctaagcacacttgatgattcttttgtcattgtggttggttttcattgtgtcaataacttttggcagttggtctactccttaacctgaataatcaggattaatctctctgcattctgtctccaatgtctccactgatgtcttacataagctggttccaaatatgcatctcctggtggggaacccgagactg

SEQ ID NO: 169768 - DNA, 445 bp, Homo sapiens
gttttcagctctgaaactcacggaggggttccagtgcaaaggttgtcacatgctcacccagcactcacaccatcagaaacactccatgtttgcctttccttttatcccccaactatgtcctgggcctcctaggggaacacagactcagccccattagtggccctagatctgaagcctgcagaactttgttgcagagggaaggaaacacaattcctccccactggctccgagttggagctgagacacaaagtgaggacacaggaaaacccactccatcctatcactgcttggatgtgacgaagtggcttgtagtttacccagggggcaacacatgccttcagggtaatgattttaaggcaggatgcatttttaaatcacctggggaaacttgtcaaaatgcagatgttcaggactcagtctcaggctctgacttaataggtctgag

SEQ ID NO: 169769 - DNA, 242 bp, Homo sapiens
aaagaaaagtggcaaatggcagcttagatattctctggctaaatgtaggtagcagataatagagtgttaaagtagaaatgtgtcttccctatagactggacctttctggatataaagtaagagatgtatcaagtttctttttttcgattttgagacagagtctcgctctgtcgccaggctggagtgcagtggcgtgatctcagctcactgcaacctctgcctcccaggttcaagcgattctt

SEQ ID NO: 169770 - DNA, 916 bp, Homo sapiens
cagtgcagggtgccgggaacccagacggaacaactcagcctctttcctcagggagtaagtctaagacctggcttcgagtacattcggtgaaagaaagctcattgggagccgcaattttggctagctagtgaaaaaaatcaccgaatgcccctgcaggggttgccaggacttcctatttgtttttgttgttgttgttgttgttgtttgttttttttgagacggagtctcgcactgcactcctcctgcctagacgacagagtgagaccctgttttttttttttaaattatagtttttatttcataatcataaacttaactcagcaatccagttaggcttggaaaggaacacaggaaaacttggaacccaaggggaacggcagcaagagcacaaagataagatacggcgagcaggccgggcggtggggggcccgtctgtacatcctagcactttgggaggccgacgaacggcaaactcgcctgaaaccaggagtccagatccagccgggaaatggcacacacccgcccaacaaagagcaaacccgaacaaaccagacaacaacatacaccgatcgaccccgcacccccacactaccaccagaggcgcagaaaacccaacgctcgcgccggacaggcccaaccgccacagaacaagacagcggaacgcagagacgggcgcaggaaagacgggaaaaaaccggaaaggaaaagaagcacgaaaagaacacaacccgagcaccgagcgaacagacagaaggccagagagcaagaagaaacagccacggacccaaaagacaaaacgacaaccgcaccaaaaccagcgacgggaagccgcaaccaacccaggtcgaagcggcacaggggccggaggaaacgcccaaaggcgcccacaaccgagcgcgaccgggcgaaggaggga

SEQ ID NO: 169771 - DNA, 188 bp, Homo sapiens
tgccaatgtggagactcctctgttaccatgtcttcatactcttttgacttccctggctcctgggaggtccatgtccacaattcattcccatcccttggcagggctggccctccacaacctggaatctgtgtcatcctcaagatcttagcatccgattccccgactcacagccatccctggttcggctg

SEQ ID NO: 169772 - DNA, 506 bp, Homo sapiens
attccaatagcagcatatgcgaattccttctgcttgataccttcaccagcacttaactcttgttggatctttaaaaaattttatcctaagttattttttaaatacttgtggtcctaagtctttgtcatggtcttaatgttgcccagtactcatgctttgttcctttctctgatacagatgtatgcagggttcacctggggaaatgtaagaaatactgaaggatgggccgggcgcggtggctcacgcctgtaatcccagcactttgggaggccaaggcgggcggatcacgaggtcaggagatcaagaccatcctggctaacacggtgaaaccccatctctactaaaaatacaaaaaaattagccgggtgtggtggcgggcacctgtagtcccagctacttgggaggctgaggcaggagaatggcatgaacccaggaggcggagcttgcagtgagccgagatcgtgccactgcactccagcctgggcgacagagcgagactctgtctc

SEQ ID NO: 169773 - DNA, 448 bp, Homo sapiens
cttggggcctcgtttcctcacatatagcctggggtagggggtaacaataactgctaactcagaagaagattaactgatacaatccacataagagatccaggatagtgtttggaaagagacgctgaatacagtgtaactccaacaaggacagcagaggaagaagtgaaggaaagtgagcagccaactccagcctttacccccaacaatagagcctgagaactcttcttgatgcataagattcactaagaaggccctggggcccagaaagtgcttctggtaaacatgctatacctgggggaatatgtggtccccattctggagacaagccatctgcatagccaacttcatcacttctatgtgagctctaagagccgtattttaaaaattacatgaaaatgaatgctagtcaaacaagtagtaaatccaagaaagaggaaggcatagatac

SEQ ID NO: 169774 - DNA, 221 bp, Homo sapiens
gtaaaatacacgagtttctgcattcagaagaaagtatttcaggtaaaaattaactattaagcaacttttctcagcagaagaaatgcccaaattcttaaggacagccaagttgtgagttagagagctagtgttataacagatatttttaaatacatatatgaattacctccttacgttactttattcttgtgtttttagcaactgttgaaaacaattataag

SEQ ID NO: 169775 - DNA, 345 bp, Homo sapiens
caaacaaaatagtgaatagaatgtttcagggaggaaatagtataagcaaaggcatggaggtctgaaccataaaggtatttgggatgaactacaagtatataatttgatattacagagatgtaaattacagtgtcagagagagattggaggtgagaccggggaggacccagaacttaaaatttttgcttgctatgtttaggaattggaatattatcctcgaagtggtagagagttatttgaaagattttaaatagggagctggtgtgattaaatattttaaataaatcagtctggctctagggtggagaattgaattgcggcaagcaagaagactaggagactatt

SEQ ID NO: 169776 - DNA, 365 bp, Homo sapiens
cttgttattgggcatcagttatgtaccaggtgagcaaagcaaatgtggaatcttctcttaatattgatatgaagtaaatatgagtaggacttagcaaggtgaagagtgaacaggtatcacaggcatacagaaaaatacctggaggtcctgagttaggaaagggtttagcaggttgaaggaacaaaaataaggctagtgtggctagaacatagtagttaaagggggtagtgacagaagaggttggagaaaagacttgaggcagatcatacagggagtaaaggatatattatggctgatttcattttaagtgtattgggaaccattgaaagttttaaaacatgattagattttcatttttaagagat

SEQ ID NO: 169777 - DNA, 499 bp, Homo sapiens
tttaaaaggaacaaattagctctttatctatctaaggcagaggagtcagaacacttattcctatgagcgttcagggatttcaacatctatgggtagatttccttaaatagccaaggaggctgacttaaaggctaggagagccagccctctgtgatttggagagataataagttagcaaactggatagcataatggtttatgaaattcttccttcaaggaccattatctagtgctaatagtgttttatgtcttcctctcctgtgcttatttacagcataattataagagtgagaaaaaggggaggagttgggtatcaaaataaccatatgccaaattaatgcagccaactagaatctctggcccttggggcttgtttatcaattagttctgttgcaatttgagtttctgtttttccccacagaatgaagatactttttgatttcactcatatgccatctccaaggaaagtcatttgagatcaaaacatttttcagaaagg

SEQ ID NO: 169778 - DNA, 338 bp, Homo sapiens
cacaagtgagtctcagatgaacatgatggcagggataaagaaaagatgggactctcagctctgttctgctggtctcctcagaaaccactgtgtccatgtatgactaaaaatgcctctcagttattttccaacagtgcggcaaatgcgaggaaattaactatggtttgacattatggttagtctttttttttttttcaaatttgtcaatggaaattttcacaggtacacaaagatagagttagcgtaatacacctcaatgttcccatcccccagtttttcgacttgtaatcaacacatggcttttctcatttcttttataccttcacccacctttttct

SEQ ID NO: 169779 - DNA, 356 bp, Homo sapiens
agtgcagaggtttttgccttttggtttaagttagacttaatgtctacgtgtttcaatgtttagaatgctcagtcctgccagatagttgcagaagtaacataaaattgcttggaagttatcaatgaatgctagactttccaaactgtgcaggaatcttttgttcaaatgagagtaaatgaaacatgctgcccctaatgcatggaatggtgtgaaattctgactggtgtgggttcaagagcaaactgaaagggaaatcttaagacagagtatagtacaagtgttgctgaaaatgagactaatagtagtaaggggaaaatggggggtcaaaaagggccggccggatatagggtaccgag

SEQ ID NO: 169780 - DNA, 407 bp, Homo sapiens
atccacctgcctcggcctcccaaagtggtgggattacaggtgtgagccactgcgcctggccccttacacattattcgtaaattgttaacatgagtaactagttaaaggaaaaaatataatatctccatcctcctcctgaaaaacaaaccttttatttttattttatttttttctcattcttgctgtcatcttaaacaaggtgttgagaatgttttaactgtgagcactccttctcctcttacatattattgtgtagtattttggttctaatttgtgtttataccacctaaattagttatcattattattgctttatacagttgtgcttatttagatgtatatttatatggcattttctttcttacccttgcttcttgtatcctacttgtttttttggattcagtgtg

SEQ ID NO: 169781 - DNA, 339 bp, Homo sapiens
tagcaaattaatcaagctggaaagggggtcataggaacactagatttacagccagtggttcagaagcacaggtaaaacaacccagggcttgcaactggcactggaaatgtgggacagtcttgtgggactcagctctgaacctgtgagatctgatgttaactccaggcagatagcgtcagaattgagtaaaactgtagaacagccagctagtgtccactgcagaactggctatagtgtatggagaaaaacttctatacatctggtgtcagaggtggagcactgagggtatagtaggagaaaacagtttccacattgtgccaagaggactctacattggga

SEQ ID NO: 169782 - DNA, 317 bp, Homo sapiens
aattaatgtttttaattagcaggccgtggtggtgcacacctgcagtcccagctacttcagagccagaggcaggaagatcacttgagcccaggagtttgacgctgcagtgagctctggctgctccaccccactacagcctcggtgacagcaagaccctctcaaaataaaataataataaaataaatagagcatgcaaaacttatggtgcctattcaaaacacggcttcattttttccacagcctttcagtgagactaggtatttctctgaccttgaaaatgtttagagcaacttctacaactttgatcgtcattttta

SEQ ID NO: 169783 - DNA, 567 bp, Homo sapiens
aaatagcatttttacttcttcctcattcttgccatttctgttcttcagtttctatgttaactgctttgccattttcaggtcaactactgtttgttgccttaaatctatctgggagctgcttcaaatccatttggaagcaaggggaggatacattataaataaatgatatgttcagagatgggcagagttggaaagacatttcagtgagacggaaggccagtaaagcttttgtctatcagcatctgatatcattacaaacatattggtctgggcttagcttgcttctagaccatctggatttatcttcagctgagctaaacccaggaaaaaagacaaaaaaaacccatttggatttgctctgcagttcttattttgtttttcttctaacgcaaaccctgcttcaaaaattaagtgttgattttgactgatgataacaaaacaaaaatacaacctgatgtgctagctaaggcgggggggaaatgacaaaagcctcagagagcaggagccaagtgttcacttctccaggacgtttccttccctagtactggtttttcctaattcagcaaa

SEQ ID NO: 169784 - DNA, 541 bp, Homo sapiens
acgagttaactgtgtaacaaaccttcacatgtacccccaaatctaaaataaaagtttttttaaaaaggaaagaaatgtatccccctcggatagaaggggactgctgtaccaatactttagtattatttaagtcctggaacttggagtcattttgtaagtatttgttgactaatgaaacaaatttattcattcccttatgcaaagaaatctctacatctgcaaaaacataggcagagtttctgggctaacaaaaaagacaaatgccaatgcaaaggaagtctgaaaattgtgaacaaagattattaaaccagtatttacagatcgaacattttaatcacgtttctattctgcaaagtatgtttttctgtattagctcattttatccttacaggaatctgtgtagcattatcttcattttacagttgaggaaactaaagctcagagaggttatgtgaattgcttgaggacacaaagctagtaagtggtataaccagggttcacagccccctggtattttcactgcagattccacccttttttt

SEQ ID NO: 169785 - DNA, 396 bp, Homo sapiens
aaggggactaaaatgtttctgaccttttaacagactgtctcccacttgaatcacacacaaaagtacacattgtgtctgtatttactgccttactggacaatgggaaagagacaagtacacagaatccaagctcccttgtggacacaaacaaaagcaatcagaataaaaatcacctgtaagttctctctacatccccagctcgaaagggagaaaaagtgcagtcttgggaccaccagagatttaagcaagcacccacagccaccaaatgggaacctttaactccaataagaaggggaacttagatgagctgcactgcagtgatccagtcttttggaaaattttttggtacagatggcataacaacagtacactgacaaaaaaaggaatttaatctcc

SEQ ID NO: 169786 - DNA, 187 bp, Homo sapiens
ccacagcgaagaattagccggtcccaaatgttaacactgccactgctgagatgtcctgacctagaggaagctacattaggatttgagtactcagaaaaaatgcagttttacaaactctcaaaattacttaagtaggaaactcagattatctagttcaatcctctcacagtacagaagaggaaaatga

SEQ ID NO: 169787 - DNA, 622 bp, Homo sapiens
aaattccacctgtccttgaccatcatggatcatatcaaacagtgaaagcatggagtacacagcaatgcgtttcacaagctccccctctctgatgtcagacaagtggtgtggagccttgtggcgttcccatccagtcaggttccaagcccactcattgatccactgcagaattattagtgtcacttgaggccactttgtgtggtggctgtgatgatccagaaatgaagcagacacagcgtgctccgggaggatgtggtcactcagggcttgcaactgatggtaggaattctaccacttgacgagaagattctaaattctgggagagatgctgtttaatgaatctgagtcagaattcctgttatgttttaaatcttgctttcatctccaaaagcccttggattgcagttggtccatgttattttcatgaaaatgtacacattagaattcaggccattttgtcgcagtactatgttacaaattaaccatttcagcgaaggagagaatggctggtttgccgatgatgtttcattgttcctttctgaaaccacatccgaacaaaagctgaatcatccgtggtgtgactcatcagattagtccgacaaaagaattaccaaaatagggc

SEQ ID NO: 169788 - DNA, 255 bp, Homo sapiens
ccttatatgggcattatattttattgttagtatggagaaaggctattgatttttttgagaaatatatttatctaaacactttgccaaatgaatttattaatctagtagcttttaaaaaaattagaatctcttgtgttttctaggtctaccatagcattaccagaaaagatcatcttccctgttctttgacaatatgtttattgattgttttcctgttttatcatgtggtatgacctctaaaataatgttgaataa

SEQ ID NO: 169789 - DNA, 387 bp, Homo sapiens
actacatgaaaagcatggaagataatgacagcctagtggacaggcagatggaccccatggaaactcccttcccacaccagggctcagagcccaactctgccactcactaatgccatgaccatgacccagaccagtcatgtctctgagccttcattcctaacctgtgacacagggctaagaagacctacctcaagagaagagctgtgggcattatgagacaaaatgtattttaatcacccagcgcctaataggcatgcagtaagtactctaatggatgagctcttggactctgttcccctgctttgaggggttgcccacagaacagctctggtggagaggaaaaggagtgctctacaaggcaaggcagcagcagtccagctaaagcac

SEQ ID NO: 169790 - DNA, 127 bp, Homo sapiens
ctaaatatatatgcacccaaaactggaacacccggattcataaaggaaagattactaaatctgaaaagaaagactccaatgcaataactgtgggggaatttaccaccttattctcagcactagacag

SEQ ID NO: 169791 - DNA, 570 bp, Homo sapiens
tgagcctcaatgtcatcttcggacacagggtttaataagcctcggtgacactccatttgcaggcaggtgcctgcagttgagcctctactgccaacctccggccctgcttaaagacaggtgggcaggcgcccctgggccaccacacagtgggaggggactttggacaggccccgagctggaaggatggagcacagggggcagctctgaccccacctgagtgaccttgggccgctctctgcttccccctacgcttcagtctcccctgcctagtaccggcacctgctccgaggcttgctctaacctccggagtttccaggctcacatttgacctcccctcccggccttggtttcctcctcatatggcaacggggatctgccaccaggtggacccagctataggtcagagggactcaaggaaagaaaaggaaaaaacaaacaaacaaacaaacacccagcagggatttgtgatcgccccaggaaccttcccgaccaggccccaggctgggctctgcctcggccgcgcctcagtctcccgcacagagcaaaggacccatccactgcctgcggccg

SEQ ID NO: 169792 - DNA, 301 bp, Homo sapiens
gcattctgattgatagagaaaaagacatcagttttcaaagtattttcccttcttctggttggctcctctcctgtagcttctagaacatgtagcgttaggtgtgtttggcagatgtcagctttacgagggcagagaatctgtctgttttgtttgcttcggtattcccagggcctagaatggtgtctggtttataggtactcaataaatatttgatgaatgagcgaatgaatgaatgaggggcgtggggccccgatgaatgatttattaagggtacacatctggtaggtattaagacttggtc

SEQ ID NO: 169793 - DNA, 180 bp, Homo sapiens
gttcactgactcatggtggcttaatctccctgtaattttttattgtgagtttattttattgaatttaaatcattggaaattccaagggcctacatttgggatgctttccttcagaaggacttttatatacctctgctaaaagccagatggcatccggaccactttagtgtgcgcttcaag

SEQ ID NO: 169794 - DNA, 250 bp, Homo sapiens
ccagttcagaaattgtacctttcaaactgggagaaacgtttttctcttaaccttgtattcaggctattactgcgtttcagttcatttggagttaaatcaacttttagggccactgtgggtttattaacaatgtgtatatgaagtacattatgtttcacattcctaagaaccaactgactcgaatttttacaactccaatggtttagaaattactttgtaacataaaacaatcaggcagtattaacagttt

SEQ ID NO: 169795 - DNA, 683 bp, Homo sapiens
gctgagcaaggcagggaacggggcgtggcccccctgcccctggagctggacatcacacagtccatttgtgtgtatgcatgaatgtcacattctagagttcccctttccccaaactggtccagaggcagtccagggttacacctccagaggagagcctgagtctgtccactttccttccccaccagccccagcccaggcattgtggctgctatagtgcccgcctccctgccactgctcagcagccaagtgcaatcttcattaggcctccctccagtcctgtcccttctctacgtcagagattcttgtcatcttccacacaaagcccagacatctcaccttgccttccagagccctatggaagtctcaggtgactctccaggcccctggctgcctccagctcctcagggaccaggcttccttcctctgggcttctgcacacacagttccttgtgctggaaacactttggctccccatcttcatgttgaaaacaggctcccatctcctgggtctcagcttaaatcctacttcctcagagaagcctttccctttctaaatccttgtctccattgcccccctcctcgcttgcagccatcctagcatcaccacaatttcagatcatttacttgtttactacctgtctctccactagactgtaagctccattagggcagggaccacgtct

SEQ ID NO: 169796 - DNA, 514 bp, Homo sapiens
actccccacagctttttgttcatgctgcttgcatggatggtgacccactctctctggtcccaggcccaaggtgccattttgggagtttaaaatggggctgtggcccaccctcagcctgaggtcagactgacgcagctgtagtcaacaccaagcccaaaagggacagggagaccaggccatcctacacaaatctaggagaatacctactgctctgcagtaggctgctgtgagagtgagacatgcaaatttacactttctacagcttcttgcccacactatttgcctgggcggtcctccaccctccctgatcttaggcccaaggagtcacttttgagagtataataatgagcttctccccacactcagcctgagttcaggttgaagcaactgcagccaccacacagccaaggaggggcaggagagtcaggctctcctccagaccctcctcctagggcaatacccaataccctttttaggctgctgcaagaccaagatttgagcaggctacattccc

SEQ ID NO: 169797 - DNA, 956 bp, Homo sapiens
  misc_feature (678)..(678): n is a, c, g, or t
  misc_feature (828)..(828): n is a, c, g, or t
tgagatttcccgactagtccaaccatacacttacaattacactatgcactcacatgttcacgtatatacatacacacataggctgggagtccgtgtctcgaatgagggaggagaggtggagttgccggggctcaggcccggcctcgagcatgggcggatgagaggagtcgggagccgaggcctagggtccttcgggtgaggggagacggagccagcgaggagatggagcagaagcttgtggaggagattcttcaagcaatcactatgtcaacagacacaggtgtttcccttccttcatatgaggaagatcagggatcaaaactcattcgaaaagctaaagaggcaccattcgtacccgttggaatagcgggtttgcagcaattgttgcatatggattatataaactgaagagcaggggaaatactaaaatgtccattcatctgatccacatgcgtgtggcagcccaaggctttgttgtaggagcaatgactgttggtatgggctattccatgtatcgggaattctgggcaaaacctaagccttagaagaagagatgctgtcttggtcttgttggaggagcttgctttagttagatgtcttattattaaagttacctattattgttggaaataaactaatttgtatgggtttagatggtaacatggcattttgaatatnggttcctttcttgcaggcttgatttgcttggtgaccgaattactagtgactagtttactaactaggtcattcaaggaagtcaagttaacttaaacatgtcacctaaatgcacttgatggtgttgaaatgtccaccttcttaaattttaangatgacttagttctaaagaagattacaggccaatctgaaggtactccctgtttgctgcagaatgtcagatatttggatgtgctaagagtccattggcccagttaatcaacttttgtctggctgttgtg

SEQ ID NO: 169798 - DNA, 574 bp, Homo sapiens
ttgagaaaaagaaccatatgaatgaacaagattattcaaaataaatttaagcctgagttacttaaataatcctgagattgagttactgtaatttaaatagctgatatgactcctagaatctatattacttaagaaaaagtagattatgggtaggaagagtggaagaaactgttgacattcattgtaccattcgaggtatagaaatttccaaagcaaagaaacatttcaaaatgtatgcatgtcaactaatctatagaccaattcaaaaaggtaaagaatgaaatcgtatatttttaaatattacattaataaattggtaaggccataaactaatgttttcctccatccccacatattctgttttccccacttaatcttagaaaccatctaagaaaaataaaaatgagtctgcacttttcaaatttggatttactctcaaaaatctttgagaagatgattaagcaatattaaataaagcttataaaaataaggatttttaaatcttttagaactacttttataatcttttaaactagggcttttgttactttaaaagaaatatatgcaaatacta

SEQ ID NO: 169799 - DNA, 215 bp, Homo sapiens
gttcacatttactaacagttctccaatggacataattctttacaatactccaagacatttagcttactttaaaattaaagttgatatcattacatcttttcaaatacatttaataaacagaaaatattgtttttcattgttaaattctaatggtagtggaaagggacctgtgatatgaaaaaggcattgtaagtattccatgatattgatactta

SEQ ID NO: 169800 - DNA, 606 bp, Homo sapiens
  misc_feature (592)..(592): n is a, c, g, or t
ggattctggcaaacagtgtgcatcaaggccagtgctgtgtaggagaggaaagacttgattgtgttgacagagagaggttgataagtgaggggttaaagttaaaccataacccagttagcaatcaggatgtggcctgtggactttgcctgtcgctagggccttcaggagttggctgtggttggctgggggtggggaagatggggtgaggatggaacatacctcatacctcaggccagagacctaagtctgtggaggcaccttgtctccagctggagaggggagcacggcaggtctgtgtgcttccttctcagaagtccaattcacagagaaaatcgagccattatgggggctcatgcagcttctccacccacaaacatatctatgtctcccccattcttatctctgccctgccatcctgaggcagaggaaggtcccttctgctctgggcttatctggccccctgtgcccaggtggtatccttctcaggaaccttacaacatggctctttgagctcactttctgttggtttctaccattcaatgatacgtttgctcaattctactacttaatactccagctccaagcctgtagnggtaccagctccga

SEQ ID NO: 169801 - DNA, 453 bp, Homo sapiens
ggccttcaggagttggctgtggttggctgggggtggggaagatggggtgaggatggaacatacctcatacctcaggccagagacctaagtctgtggaggcaccttgtctccagctggagaggggagcacggcaggtctgtgtgcttccttctcagaagtccaattcacagagaaaatcgagccattatgggggctcatgcagcttctccacccacaaacatatctatgtctcccccattcttatctctgccctgccatcctgaggcagaggaaggtcccttctgctctgggcttatctggccccctgtgcccaggtggtatccttctcaggaaccttacaacatggctctttgagctcactttctgttggtttctaccattcaatgatacgtttgctcaattctactacttaatactccagctccattctatgtctttttttcttcagctcca

SEQ ID NO: 169802 - DNA, 116 bp, Homo sapiens
agcattttgttctattcaggccttcaactgactggatgaggctcacccatattagatgctttacttagtctattgattcaaatgtcagtctcatccagaaacgccctcacacccag

SEQ ID NO: 169803 - DNA, 198 bp, Homo sapiens
gtaagggccttcattagggcaagggtgaggtttgtagggcaggagatagttttgagaggcttggaagaacatcttgaataggacttgggtcctgaaggataagatgataatgtgaagataatatgaaggtcttcagcagagaaaatgtggaactagatgcccaaacaagaaggaaaattgggaagaaagtagactggg

SEQ ID NO: 169804 - DNA, 301 bp, Homo sapiens
ggttttctcctatggttatcctgagttggggtttataaggcagcacaggctgcctaatgctgcttttttatgaactgaaatcactttgggatattttttctgcaacactggaaaattttatttaaaaacaaaaaatacttaagcagatatctgtatcttttcaatccttttctaagagacaatacttattgggtctgcacctccacacttgagcttgttagcggtgctgtttctgctgttagccatgttaaagtgttaatcctgcacatttggtaatacaagattgttgacattaaaaaaa

SEQ ID NO: 169805 - DNA, 435 bp, Homo sapiens
caggaggctgagttgggagaatgacttgaatctgggaggaggaggctgcagtgagccgagatcacaccactgcactccagcctggatgaccgagtgatactcagtctcaaacaaacaaacaaacaaacaaaccctgaaataaacatcgttttaagaaaagcagcctcacctacacattttctctctcggttccttggctggaattgggaggcatggccaggccgagttgcaagggcagcgggaggtgagtgttctcctgggcagacttggtcaggatggggcagctggggaggaaggattagacactgggctggcttcatgcggggtctgctgtggcaccacgtgtcctgaggagaaggtggccaggcctgggagtgttccagggctgctttaggactcaggagagctggtactgatgctccattcactgtgagc

SEQ ID NO: 169806 - DNA, 119 bp, Homo sapiens
ccaagttataggtgcctggccagcctgtgggttggtgcccctgggtcaggtgcccactcctcttgtgtgctaaggattctgagcatgacaagctgtgtaagcaacagtctggagtcact

SEQ ID NO: 169807 - DNA, 294 bp, Homo sapiens
ccaaaatgcatattcttgattgatgagaggctctcctccaagttcaaggacccaggtccttccaccttatggctccaccatctacatcatatgacttccaaagcctttgtgcttcttggcttcaaattgatggagaagaaaaagcaatgggattatgttcacgtggttttgtggcgggggcaggcctgtatgtgctgcatattatttccacttgcctatcatttgctggaattcagtcgtagggcaacatgaaatggtaaggagttgagaaaatttaatctaactttatgccca

SEQ ID NO: 169808 - DNA, 571 bp, Homo sapiens
attccatgggccctacctattaaataaatgcctatagcacccaccaaccactgagacaatcacaaatgcttccacaaattccttaaatgaccctcaggctcataaaaaaacaaattagaattcaccagaaggtcctgggtccctacctggtcgagatggagaaatcactggctgacactcctccctagagcccctctagagcccccccaggcagagattacagagcagaggagcgaaggagcacagttcacagcacttccagtgtcttggagaaggggaagtggtggaaattaccactctctcttctccaactttgctcaagggtgtcacatcagcacacatcactgagacctctagtccaggaaagtcaaggtttgggggaataaaaagtagctctcctcataaaaacattgtggatcctgcctctgtgttctaagaataatctgaaacaatagtccatgaagtatgcctcatgtatttgtcaaacagtgtttcttaaaaacaccaaaatagatgcactgctcccaaaaataacagggaaaggcactgaaggccttgagcctctccccga

SEQ ID NO: 169809 - DNA, 222 bp, Homo sapiens
ccctctttgtgcaatatctatcatattacgtctatatacattgaaaaatcccatcattatatgtcttttccccatcagacatgtttttaaaaactcaaaaggcaggcatctgcctggagtccagaagatcgagaccagcctgggcaacatggcaaaaccccatttctacaaaaaatacaaaaacttacaggtagcacatacctgtagtcccagctactcagg

SEQ ID NO: 169810 - DNA, 669 bp, Homo sapiens
atgatgactagctctggtcaaagcagtaatgacctgaagtaggccagtgaaataagaattaaacaaatatgagaaatgtttcagaagaaggatgatacatgttactaactgatgaaatatgaggtgggttaagggagatatgagagaaagtgagaaatcaaaaatgtccataaatcctaccttggacacgtgagtatagttgctgttaattaatatgataaagtgggagaaggatcacatttgtggtgggggctaaataattccatatactagaacccttttgaatttgaggtttttctggtggttttatctagcagacttgaaaatatggacctggttctagaggtattttgatattaaagataaatacttggaacccgttaatgtgtgggtgttagttgaattcatggggatggatgtaacaacttaaggaatgcaagtataaagagaggaaaaatctgtctgcagattgaacatttcaggattggataagtagggaaagaaccttcatattaggcagaggaagagtggttagagatagaagcagaactgcggagagtattcttagagagcattgggaacaactgtttgaagaagaaagtaatagcaactgtttcaaatgctgcaaagatgccttgttaaatgaagagttataatattcactcaaaa

SEQ ID NO: 169811 - DNA, 665 bp, Homo sapiens
aaaaaagcggggggggaattggtatattccagtgcctatttggactaaaaggagttcaagacaacgcactctacagactccccagaccagggctccccttgggtgtctcatagaggcctcaaacttcgagtgtctggagctgagctttaggcagtagctgtgtgcactgaagctccttcctaagcctgcccctcatcctcaggctgcggttccccagtgtcagcagcttctcactcaggccaaagaaacttgactccattcttgactctcctttctctcatgttccaaatacttctcgcccccttctctgccgccatcctggccaagcgcccacctttgctcacctggtcccctgcagcagcctcccgcctggcagcctcacttgggctcttgtcccctggagcctgcaggatagtaggtgctccctgagtgaggaggaaaaagaagaggtgggagagtgtgccgtgggttgtccccgtgggctcctggaaccagggggaggaagttgagcctttccatgcatcagggcttattgcccgtgtcaatttttggacttgggggttcctattacgcactcagtcggggcattgtacggctctgtctgctcgggcccctgtaatgctgtgctacactgttagtattggtctattattgttatatgtgtc

SEQ ID NO: 169812 - DNA, 283 bp, Homo sapiens
tgctatatctggtatctacttttagtccctaaagaatgccattttgtttcaggaaaagctttagctttgctactgtagaaatgtgtcttacatgtcaagatttccttaaaatgcttggagggttcttacatttattttaacattccactccagctgcaactgcagggaaaacttcctgatcaggcctccaccatctctcacctgatggtgacctccacctggtctcctacattgacacccctgtctcctttactgtgaactttcaacacacaatcagatggat

SEQ ID NO: 169813 - DNA, 1295 bp, Homo sapiens
tttttgagttgagtctccctctatcacccaggatggagtgcagtggtgagattttggctcactgtagcttccaccttccagattacagtgattctgttgcctgagcctctcgagtagctgggattagagatgcacgccaccacgcttgtaacggcatgatgtgatgtgtgtgcatgaatacatggatggataagcccatggtttatgtagaaaacacttgatttgcaataaggtatattttttatagttgttatgattgtaagtatttttcatttttgttaactatcacaatgatgagttattagtaaggattggccgggtgaggtggctcacgcctgtaatcccagcactttgggaggcccaggtgggtgaatcacaaggtcaggagtttgagatcagcctgggcaaaatggtgaaatgccatctcaactaaaaattagccaggcctggtggcaggtgactgtaatgccagctactcgggaggctgaggtaagagaattgcttgaacctgggtggaagaagttgcagtgagccaagattgtgccactgcactcctgcctgggtgatagagtgacactccttctcaaaaaaaaaaaaattaaaaaacgtcataattattaatattattattattacaggcatgagccactgtgcttggcctgcctctgttttcacagacacatctcttcatactcagccaagggatccttcttcacatccatggtctctacattgctgtactcctcgtagactttactcattttttttgtgtgtatgaaattctggaatctacacaaggcatatttttgagtatatgcttgaaactagaaatcagaggccattttacctaagagatgtaaaactgctttcacctcaggccaccatactgctgattttttggatcttgttcattcttgtcccttgcccatattgtaatttgcatagttaaccttgggtcagtattttaccatttgctaaattagttccattttcctccaagctcaaaacttggtctatcccagtggaattatattcccacagatgtgcatgcacaaagttcactcctacgtgcccattcctgccctccacccttgccctccttttcctggccttgcttcacatggtacattgatttggatgcaaaatactgttgctttccagcctattgattttgtaatagtgaacaccccaatttccccatgagcccctcccctccaacactactctcactgagtaagtcaagaccttattcatccactggacaaaattataggaggccgcttaaatcagtgtgt

SEQ ID NO: 169814 - DNA, 828 bp, Homo sapiens
caaagtgctgggattacaggcgtgagccaccgcgcccggcatctgaactttgttttatttattttttttgagacagaatctcacttcctgcctgggtgatagagtgacactccttctcaaaaaaaaaaaaattaaaaaacgtcataattattaatattattattattacaggcatgagccactgtgcttggcctgcctctgttttcacagacacatctcttcatactcagccaagggatccttcttcacatccatggtctctacattgctgtactcctcgtagactttactcattttttttgtgtgtatgaaattctggaatctacacaaggcatatttttgagtatatgcttgaaactagaaatcagaggccattttacctaagagatgtaaaactgctttcacctcaggccaccatactgctgattttttggatcttgttcattcttgtcccttgcccatattgtaatttgcatagttaaccttgggtcagtattttaccatttgctaaattagttccattttcctccaagctcaaaacttggtctatcccagtggaattatattcccacagatgtgcatgcacaaagttcactcctacgtgcccattcctgccctccacccttgccctccttttcctggccttgcttcacatggtacattgatttggatgcaaaatactgttgctttccagcctattgattttgtaatagtgaacaccccaatttccccatgagcccctcccctccaacactactctcactgagtaagtcaagaccttattcatccactggacaaaattataggaggccgcttaaatcagtgtgt

SEQ ID NO: 169815 - DNA, 410 bp, Homo sapiens
ctgatatctgttttgttcattggactgtggacccattttaaatatttatcatctgctttctaaaccaatggcaagagtgtctgcataccagtgtggtgaggggagatacagtggtggaggggagatacagtggtgaggggagataagtccctgaatcagacttagctttcttgaggactcagtgctgactttgttactgtttactttagcaactcaggtaaaaacatgcgtcaaataactcttttgtttcatataaaacctgaggttttgcaagagacaaaacctcttaaaagtgagatttgttgtttaaataagaaatagtgttctattattaacccaggccagctgagacaagctttttaattagcctaaaaagagaggataatgtataaggagaatgaggtaggttt

SEQ ID NO: 169816 - DNA, 415 bp, Homo sapiens
actcaaatactgatcatttaagagagaacttgccaactcagagccatgggctaactataaacaagactttaaacctttttgctaatgccatagttaatctcaagtaataacttctgaaaacctttgaaaaggtctgagaatggctttctgtcaggggcctaaggaaactgtacattttctcaccgtgaaaccttgatcatgccagatataatcagactgtttatctggcaatgttaattttctgagtttacagtataacaattcgccaagattattggaacagaatcagaagaagttatatttgttaatcggccaattttctttttttgcatttaaaaattcagtgcaaaatggtatcacattttctagagtactgacgagactatgcctgaataaatgcatttgccaaagcgaa

SEQ ID NO: 169817 - DNA, 771 bp, Homo sapiens
gctaccagtgagtgaagggccggagggcccgggcaagcttgagcccaggatccagtgggcccactgaagtcagggcccacttttggggggctgggaaaaggaagggttgctgtgggaccactgggataggcctttaaacagcacttcaccattggcctgaatcaaacattgtcattcccagtgtcccgagcaccttccctgagtcttcataccttctgcctcctagcttatggaggaggagccaggggcttatcttttgggggaaatgagagcacgattaggcatcaagaagggttgatgagaaactggtaagggggactgtcaagaacagcagagtgctgaaatggtgacaaaagctctgggctccggccccagctctgtactgagaagctgtgagattttgggcaagtctcataacctctgaatgccaatttctcaatggaaaacagggagactacctaccctataggtctgtgtttggagaaaacaaagtgtaagcgctggacatacagtagcatcagaaatgctgaatccgttggccagggctcatgtgtaaggcaaacatttcttggccactcctgagtagcatggtcttgcaggaatatatgcttaagtgctgtgagagcacagaggaagctttgcccttccctagagggttaatggctaccaacgtgagaaggtcacggagttccttaatgagagggagcctagctagaacaggggatgaatgagaaattgttctgagaaccagaggcaaggctgcaaccagca

SEQ ID NO: 169818 - DNA, 511 bp, Homo sapiens
ggtgactcgggtcaaagcaggtgatagggatgagtcaggacagagcaggtgaccaggggaacaaatgtgaactaccgattaaaactgatggaaaaagttgtttactgaaactacaaggaagttaaactttaaaatggaggacaaagaactgaacatactgacatactgattctttgaaaagaaatctagaactcactgtatctaacatatctaaagaaactgaagtcaagatgtcaaagagatatctgcatcctcatgtttcactgcagcactgttcacaatagccaagatatggaatcaacctaagtgtccatcaacaaatgaatagataaagaaaatgtggtatatatatacacagtctttcactgtgtgtatatatatatatacacatacacacacaatggaatactattcagcttcaaaaattgaggaaatcctgtcatttgtgacaatatgggtgaacctggaggacattatgccaggcacagaaagacaaataatacatgatctc

SEQ ID NO: 169819 - DNA, 147 bp, Homo sapiens
ggctgtggctgcagagataggaatgaacagacttaggacatatttgaattatagcccatataatttaccagtgatttcaatgtggggatgagggacagagatgaatcaaagatggcttctgggttatgggttgagtagttggttgga

SEQ ID NO: 169820 - DNA, 541 bp, Homo sapiens
tcagaaaataaataaataaacaaacaaatcgatgaagctccagggggcagataaaacagaagtgagtcttggggtggaagacagggagaggcatctgtggctggatccctagaagccatctgagaacacctgcctgctttgccatcccagatcagggacagggtgccaaggacagcaaacagggctcagcacagcctgggcatgcaaatggcttgtctgtggttcacggaacaagctcaggaagctggcagggaggaaggggatatagtgaggcagaaaggagaagaacaaagttcaaatacacaagggaagggagtaggtggggctcacctaatgtcaacagcccttgggtgcaggaactctgtggagaatgtgaccccaagaagggagtggtggcaatgccaacatgccttggttaagagaaaaggccctttggctataatgctgtgtcctagttcccaaggcagcccccaactagatttccctcaaaatgcaggtgtgtgtatgggtatgtagagaaggtagagtaatcacatgcacc

SEQ ID NO: 169821 - DNA, 447 bp, Homo sapiens
tctgggctctgattggtcacaccttgctgacgccggaaccgagactggagaaagtttgaatgaaagcgctgcacactcaccgcgtggacgccgcacgctcggccccgcttcctcccgggcccgctccgcaggcagctgcgactccagcagctccagctttctcccactgccctcctccggacacccagatcctcctctccccactgccatcccaagtggcggaggcggacatttccctgaaactctgcgtccgctggggaggcgatccctggagaaggagagcatcctctccaaggctcaaagccacactctctctgggagtggtctatccgctccctgggccgggagtccgtcgggggagagccacctggtcatcccctttgtcctcctcttctccctcccttcccgcctagcgagggccgcaacaggtgcagaaggcgcggccgc

SEQ ID NO: 169822 - DNA, 200 bp, Homo sapiens
ggatctcttttgtataaatgttgatgctgaaaactgacttcctgttctgaacttttttcttttgagtggctgagtgggtgactgtcctaagataccagtatgacttggccgtttgcaaaggattgctcaacagggctttccccaagttgttcttccccatgagaggaacagttagcaaacagaatggactttggagttgg

SEQ ID NO: 169823 - DNA, 457 bp, Homo sapiens
cctcccacctgctttgactgaatgcctctggccccggagcctgcccggatggaatgagaatgccatggagccaccaccaatgaccaagtctgaaccggtttggaactaccattgcttctcttcccccacgtcttctaccctcctagggaaacagcttggaatttagagatcttatcctttaaatttcaaaaaagtaattgagttttgaataatgttctaagtctcctctgcaagaatgagatgtgctttttctaaagaggaatgctcatgtgatgtcagggtgggaggtgtgtgccagcagagccaggcaaggagaagttaaagaggccaataggaaactggacccagacttttaaaagggattgaaattgaaataaatcaaaggaggaaaaagtgggaggttggggcaagaacacattgtatatgggggaggaaggaaaggggaagcaaaagatga

SEQ ID NO: 169824 - DNA, 408 bp, Homo sapiens
taggtattggaagagtgtggttaaaagtagtcaatgtacattttgaagaaccaatatagaacatctagcaaaccagattcttttcggtgatggttatatgtctttttttacctgtatcaggggaaaaaaatagacccacacacacaaaaaaaacagtcaatgatcatttctaacttccttccaataattttgtaaaggacactgggcacataaacttttccttggtgctttttagatattcaagcaatttcttgaggacactgtgattcatgtttctgttggactagtgtgtaaaaacattcttccatacatttttgtgaaaaccactatgttcttttatgagctgccaggaaatgtggggaccggtggaccctagccaccatctctcttgatctttgccttctattt

SEQ ID NO: 169825 - DNA, 378 bp, Homo sapiens
tctgtctatatcatgagagtttttatcatgaatgagtgttgaattttgtcagatgctttatctgtgtctattgaaataactgtataattttttcccttaattctgttaatgtatcacatttaccgatttgcatatgttaaaccattcttgcatccctgggatgaatcccacttagtcatgatgttatctttttaatgtgctattgaatttagtttcctagtagtttgttgaggatttatgcatccatgttcaatcagagacactgtcctacaattttcttttttgttgtgttcttgtctggttttcttatcaaggccttgaaaataaatttggaagaattctctcctctccatttttctgaaatagttttaaaaggac

SEQ ID NO: 169826 - DNA, 303 bp, Homo sapiens
ttcctattagttctgtccctctaagagaaccctaatataattgctaacaagctccccaactggagactcacttcccatatgctagcacctgcatgctacactatcaggagcttcaccatagtagttaggagaatggggagggaaagaaggggggagtgaggggaatatggatggcaagaaccggtggtaacaatcatatgcattacacacgtaacgaaacgttaacactaaagtcacagttcaaaagtttttcttttgctggaagtataaacttgttcttacgatccttatgaactggctggg

SEQ ID NO: 169827 - DNA, 510 bp, Homo sapiens
agtgcttaacgaagatgatctcatttgatcctgaaaactaccttttgaaccagccaagcattatgatccgtatgctgtagaaggtggaattggagctcagagaagcaaaatgacaaaggtgacaaagctgcagcagagctggggtttcaaccctggcagtccaattccaggcccctgctcttcccaccagggacttcctgcagccttctgaacctattacgcattttcctgcctctgtgtctgcagatgctgttcttctacctcaaatgccttgatccttattctcttcacctggacagttcttcttcatcatccaagatccagctccttcctgccttctttaagaagccttcatggacctctcccctgggttatgccatcatagccactccatgcaattctctctcatagcacttatcttgctacattgaactgtctgtctctctaacagagtgtgagcccgccttgaaggtaggtaccctagcctttaccttgacatccccatattcc

SEQ ID NO: 169828 - DNA, 456 bp, Homo sapiens
acaaacaacaacaaaagaaaaaaaacaccaaaaaccaatattaaggaatcttccaatcaatgaacatgatatatctctctgtttgacttagggcttccttaatttttcttagcaatgctttgtagttcttggtgcagacactttacaaagctttccttatcttaaatcctacgtgtgttatgtttctggatattagggtttttggcttttgtatattgaccttctgtggctttgctaatttagcaaataattattaatcattgttaattgaatattattaattctagcagatttttctgtagattactttggatttcttttagacaatcatgttttctgcaaataatggcaggttacctcttcctttccagtcttcgtcctttttattttctgtcttattggattaactagaaacttcaacacaatgttgaatagaagtggtcagtgtgaatatcc

SEQ ID NO: 169829 - DNA, 410 bp, Homo sapiens
tggtttgttgttgttgcatagaataagatgacgcttcaaaacgacatttttttttctcagctcatgaggcacctatgagtgggtacttattgagctttttcacctctccaatttgcttcaaatgccaaacaaccatagaatggtagatgttgagtttttcagcaacttctcgtgttgttttaagaggttcagcttcaatgactgctctcggttgttgtcaacttccgacggccagtcactatgctccttatcttcaaggctctcccctcctttgcaaaacttcttgaaccaccactgcactgtaccttcgttagcagttcctgagccaaatgtgttgttgatgttgcaaattgtctctgctgctttacgacccattttgaactcgaataagaaaattgctcaaatttgct

SEQ ID NO: 169830 - DNA, 508 bp, Homo sapiens
gctttttgtgatttataccttactgtgaattaatttctcaaacaattaaaaaacttatcaactagttatagccagtttttagaagaagcaggtagcagtgaatatgaagacattaggcatgtcatgtgctagaaataaagaaaaaacatgcaaaggtaaagacagatttcacttccttccattttatgatgggtcagctggcatttgcaaataagctgattttcacttgcccagcagtgataatgatccataaatcatagagaaactgaacataaaagtgtggtcttttttcatgcagtttgtcactattctagtaacattaaaatatatatccaatggaagtggggtcaattagtgtcattcttttcatgctagttttcaagtaactgggtttttttttttcccccaaagccacgtggatgtcccatctggctggtagaaatgacatagtgagtattctctgggggaagaaagaagccatccatcctgcccatgaccctattgcaac

SEQ ID NO: 169831 - DNA, 357 bp, Homo sapiens
tccctctcaaaagaagaagaaaaatgttaaaaggacattattaagacaattagggaagtaacattataacaatgttaaattccctgagtgtcttgaatgtgttgtaattatgtaggaaaatgtcctacttttctataagcggattatttgttttatcattcattctataattttgacaatgattaacgtaaagcccattggcctatagtttctgaaatccaactaaatatttccttcttttaaaaataagcacgtttgttaccaccaaatacgagcctttcagagagataatgaggccctttgtggaaattaatcccagcaatattcattgctcaaccctcagttctaaatttcctc

SEQ ID NO: 169832 - DNA, 625 bp, Homo sapiens
tctttcccatggccctaggtaaattatactctaaatttatttattttttttgaaacagagtcttgcttttgttgcccaggttggagtgcagtggggctatctcggctcactgcaacctccgcctcccaggttcaagcaattttcctgcctcagcctcccgagtagctgggattacaggtgcccgccaccatgcctggctaatttttgtatttttagtagagacggggtttcaccatgttggtcaggctggtctcaaactcctgaccttgtgatctgcctgcctcagcctcccaaagtgctgggattacaggcgtgagccaccgcacctggctattatttttaacttggttttcatttctggcatagagactaatttgggtctaagttattcccattcctgctttgatttgctgatttttcaaacctgaagtccaaagttactgtttttggggtttggggacttggggagtattttacttttttttttttttttttttaagagacagagtcttgctttgttgcccaggttggggtgcagcggtacattcatggctcactgcagcctcaaattcctggattcaggcaatcttctcacctcagcctcccaagtagctgggactacagg

SEQ ID NO: 169833 - DNA, 295 bp, Homo sapiens
ctgcaccctccccctcccaggatgggggtgcgtggatcctcactcactcgggcaatgtacatgcattcattccccccacctttcctgtgtctcctaggctccggaccgcacggagaccctccctcttggcccctgccccaaaccgcgtccccctccgagacgtgcctccctcctcgggctccctgagctgcagatcctggatcctcccgcaccctcacccatcccaccctgtacctgcggggctcggcccgagcgggcggacaaggctggaggggagagggtcccgcgcggccgc

SEQ ID NO: 169834 - DNA, 365 bp, Homo sapiens
gatttcttacacatgctactaatagaagaggcattcaaaaataaatgactggtggccagcgagtggataacttgaactcccgacttcgtgatccgcccgccttggcctcccaaagtgctaggattacaggcacctttttaaaattattatattgagacagggtgtcactttgtcaccctggctggagtgcagtggcatgaccttggctcactgcatcctcaacttcccagactcaaaccatccttccacctcagtcccccaagtagctgggactacaggtgtgcaccaccacatctggctaatttttgtgctttttgaggagatggggttttgtcatgttgcccaggctggtctcaaactcctgg

SEQ ID NO: 169835 - DNA, 219 bp, Homo sapiens
aagttacataacagcagtactcacatgccaaaatcaccccctccctgagtcaaggctggaataggggcctcagccacatgagggagtcctgcacaggtgacagcaaaggtcagagaatcctgctctctcctccccataggagtttactacggaaaatttgcctaagaaggaccctgaacctcattgagctggaaccagaagcactatttggacaactct

SEQ ID NO: 169836 - DNA, 159 bp, Homo sapiens
tgaattgtcataggttgagggaagaaaagaactggtcttttaccacagatagtttaaaaagcaacacactaattttcatatcctacatttacacacaataagctaatattcactgggcacttactacatgcctgctactgtatgctgtccacccagtat

SEQ ID NO: 169837 - DNA, 384 bp, Homo sapiens
aatttcggctaataagagctagatgaagagcctcagctctggaatcgactgctgaggcctgaatccagggcccctgccccatgccccaacctctgatcttggctcctacttcccctctcagggcctcaatttccacatctgtaagatgggggtggcaatgcctacttgatagggacattgcaagggccaagtgaattagaacatgcaacgtccttaacccagtgcctggcctgtagaaagtgcttcatacatgctgactgtactcaaagagcactggctttggagctcctcagcagtggtatagccttgggggagtcacttcatctctctgaccccagtgttctcagctgtcaactgggaataataatatgcctgactcataga

SEQ ID NO: 169838 - DNA, 433 bp, Homo sapiens
tgaagatagagagatgaaagtgtttcatttgctgaataatgatggagacagtatagagagaaaataaacaaccatacttgaataaatgcattatctcaggccaaaaggagaaaggcacattggtgaaggatgttacatggttacaaatgtagggagaaatccattacattgcaggatcataaatattaagcatctggtgaacaagaaccatgtttggcagaccaaaaatcatactttattgaatctaaagttccaccacttgtaaaaagcaccattattttatgtaccactgaggaagaaaacaatgctaccatttaagctagtaattactgtaaaacatataatttcagaaatattaatatgtaaaaagtatacatcttaaagtgatggaagttggtatcaatctctccttcctgtttctcaacccaacagc

SEQ ID NO: 169839 - DNA, 502 bp, Homo sapiens
tgggcaggcactcgtgcctcggcctggttaaaaacaaggctgagggtccccggccaacagaaaggggagaaatccccgctcccagccctgtgccctattaccttgcttctagagctgtaagactccaccccaagaggccctatcctctctccggtggtgctgttttagggcaggcctcctgaggctagagccaagaatgggaaatctaagtcctgctctgggggagggggggaaggaggcctcagacaggggagccagcgatggaaaatcagcctgcacgatgtgtcctagtcttaggaatgagtaaggatgtttgggagggggcaccgcaagggtaccgggcgggggttgggcggagaggcagtcgagagtctatgggagtaagggactccggtcccaggagcgcggggcgggatgatcgaggccgagggtgacaggagccccagtgctgggagcaccttcttgcgccccgcccccactcccctccagatctggcggccgc

SEQ ID NO: 169840 - DNA, 299 bp, Homo sapiens
cgctggtctcaggcagccagcatttctagcccacccctgttctaatatggatgggctcagaactgagctagttgacttgaaggtgaattccttatctctcttccctcctgctgagagccacagaactctgggtctgagttctccaggggctgtagttggcattacctgtgccttttcactctaccatctgccctctctgtctgaacaggaacagctctcttctgtcttagctttgaaagggggcagggactgcttcagtttcgtcgacccgcccgcgaatttagtagtagtagtcgacc

SEQ ID NO: 169841 - DNA, 609 bp, Homo sapiens
acacacaacgtttattatagtttaccatcgtacatgggcacagtttgtggttccccaaaacaatttcaatggtaacatcaaagatcagcgatgacagatcaccacaacagataacgacgaaaatgggtttcctaataatgcagaggtttgaaatactgcaagaattaccaaaatgagacacacagatgtgaagtaagcacatgctgttggaaaaaatggtggcaatagataaagggttgccacaaacctttaaattgtaaaaagtgcattatccttgaaacacaatagagtgaagcctaataaaatgaggtaggcctggattttttggatacttgatagtatctaagtttcttctcaaacacagcaaacatttcacagttcaaatttgcccatcggtagagttttctctgtggatcttctctgttaatgccacatctgtctagagtaaaagttcaattcaatattgtgctatcaacttagcaacttgttgaagatgaactaacataagtacatgctgtgtgtgtgttctgtgtgcagacacaacacaggtgagctttccgtaagcctggatcttcccaatggcggtgcttctcgtgtgcaggccaacta

SEQ ID NO: 169842 - DNA, 218 bp, Homo sapiens
gttacaattccttagttcatcttgtggatctaaacaccccagagggtagagatgatgctggcatagctcctggcctgagggaacactcaccgatctaccagaggctgggacacccaccgtggggcttgcaggaggatgatctggttttgaatctgcacagtgctggttatgagcctgtgatctccactcccttccctcctcttacagcagagacaaga

SEQ ID NO: 169843 - DNA, 316 bp, Homo sapiens
ctggtatgcacagaacggactgaagggagcaaaagtagatgcagagaaactggttaataagctgttgccattttggatgtagagatgctggcagcttggactttaggagtagagagaagaggagatatttaggatttggagatggattagatgcggggtgagggagagagagtttcaagactgactcttagttttctagcttttgaaactgagcagatggatttgctttcactgagaaagaaacactggaggaagactgggattgaaggaaggggtggaggtcagtctggatcacgctgagttgtgtgtgagacat

SEQ ID NO: 169844 - DNA, 317 bp, Homo sapiens
agcctgtgggaaaatgactgagtgcccatagatgaagtgctttcaagactgtctggcacctagaggtatcatcgcagaagccttggatatgaacagaagcaggcagaggatgaagctgatggtgtgcatggtcactgtgctcctgcccatttttgagcttctggaatacaagctgtgcctttgcctggaatgtccctcccagtctgactaggcatcttctgatggggtttgacctggttgcttctaacactaggatggacctcttggcaatctctggatatctttctgtggtttgttataatggtaattattactta

SEQ ID NO: 169845 - DNA, 338 bp, Homo sapiens
  misc_feature (50)..(50): n is a, c, g, or t
  misc_feature (90)..(90): n is a, c, g, or t
cgcatgatgtgctctagaggagtccccgggatgtcggatgttggcattanggtcttgtagttgaagtacaacgatgattttcatgtcatngacggggatttgtgtggcataggggttaaagatataacaggagggagaatataatccttaaaatgtaggctattcaggccaggtgtttaactagactaagagacacttcataacaatcaattgaacaagacccaattacctaagtggggcattatacactaaagaaattcacaaagaacaatatgaagcaaaacaaaaacaaatacaaaaagtaagaaattaaaaagcagaaatcaccaaaacaaaat

SEQ ID NO: 169846 - DNA, 461 bp, Homo sapiens
agtcggccaggagatgatccccagccagatctgaagggctctgagaatataacaagttgtaaaagggccggggaagggggagagagaaaaaaagaaaaagaataaaggcaaaattaattttcacaattaagtatattcttttttttccatgtagttaatttccagccgctcacatttattgcacattaattatgcatacagcttttgtgcaacttaaaaagtgaggaatgtgatccttattcttttatggaggctccggctgccgtgctggaggcctccgaagcttcgggtcagaggggcaggagctgagtccccctctgcgagcagccagtggcggggccacctcacccccagccagtgccagggatcttggattcccccacctcgactttcttaaaagtgtttcctacagcaggggtggtgatcgggggccgagggggcctggacgattggctggatgt

SEQ ID NO: 169847 - DNA, 415 bp, Homo sapiens
agacaacaatgccaacccctaaacactgcttccttctttgccttggtgggtatttcattttcccaccatctccttttctgtagccactttcctgctattcctagtagattataggaggcctgaggaccattcccatgagagcagcaagtgtctgagcagggcagtagggagcgcttcctgccctaggctcttagacccccattttaccttctctcttatgagacaacagagattcacagatagctgagaccttgggcttacctgagctccgatccccttcaggaaccccggcaccaacataggaaactgcctgtctatagatgtgatttgtaagcgaaacaaatacctctggctcttataacggaatatgtactgcatccttgccacaccaccacccagtcttgaaacagataat

SEQ ID NO: 169848 - DNA, 288 bp, Homo sapiens
catccaggtcagatagccactccctgctccacatgtttttctaatttacctgaagagtctcctgagcctttgaatgtgatcacctcaagaaacatgtcacagtgcttttcttttcttttctgtttatgtgttcatctacaaaccctaggattgtatgttggtgtgtgtgggtatgactcacagtggtagaaatctgagatgtgcatacgggtggcagaagtatatatatttatatccgtgcatggcacctgatgtagcatattgtaaatatacaccaatatttgcaga

SEQ ID NO: 169849 - DNA, 211 bp, Homo sapiens
gatatattggtgcttgtaccggtttttcgagggctgcagggtgaagatggtaggagagtctggagaacgggtctgctctggtggcttatggactactctgtggaaggggctgctgttctggtagcatcgaaggagctttctacgggagcgctgtcaagaggattttggtgaatttgacgtacttggtttgataactcactttgcttttttc

SEQ ID NO: 169850 - DNA, 442 bp, Homo sapiens
agtactgggattacaggcatgagccaccacacccagctacaaaccacctcctttgcaaagcaagagaaacatttaaaagagtaataccttacttggaacctcaatatataaaacagataaaaaccagactgctatgggtaaaagcagctactgaatcccacctgtcagcctttcctcaaactccagcatcaccctgagtgaggcctcgttggctagggtttgaaaatggggctcactcagatgactttgaaaggcctttgagctccatcagaccacctgccagtctaagtgatgaaaacccaccgtggcgtggaactgccctgtgcagtccccaaagtgctcattctctggctgactgtaggctgcctagccctggaggcatcacagctagcgcaggcctccacccaccacacccaccctcctgatgagggggaggcaggaa

SEQ ID NO: 169851 - DNA, 326 bp, Homo sapiens
tgttgcccaggctggtctcaaactcttgccttcaagtgatattcctgccttggcctctcaaagtgctgagattacaggcatgagccatcatgctcagcctaatatgatcttaaataaatacactaaaatgtatagattttctattatcttgttaagaagcaacatgagggaagagttatggtagaaggacagacagtttggctctccttttataatgattctggaaatactactttcacagacagtttctcaattctccctcaaaccttgattctacctcactaagtacactattaggacaaaaaaagttatcatggtgtttgcaa

SEQ ID NO: 169852 - DNA, 219 bp, Homo sapiens
gacctgggatgagagctgtcaaactccacagtctgtgtccttaacgcacgcctgagctgtgcagggcagacaggcatggacctaggtcagatcagggtggtttgaaggcagagtgggggtgggaaaacacggaagaaagaagaggaaggaaaggaaaggaacgaaagcagggaagctgggggagttctgagagggagcccagccagggggagggagcag

SEQ ID NO: 169853 - DNA, 573 bp, Homo sapiens
agctagcacttgtttgctgaactgtggaagaactgcaaggtcacgcacattattcatgataaagcaactgagctgacaagtctgtgcttaattcaagaataaccagtaggagagagagaaaacacaaggagttaaccaccatcgccggtgctctctcaaaggaagaggggttaacagatgaattcgcaaagacagctcttctggccaagaatatggatcatttgcagcacagaggcaagttgatatatgtagcatcatgacagtgaagcaaattccacaaaaactgctaatggacggagaaatttcatggagaaaagctagcagacagagctggaataaaacaatggcagtgttccttgctcaaagaagcagtcccgggctgttctttgcccagggatatcttcccaagatgaccagaaatggcttcatgacctaagggtggacagcagtgttctattgtacccacatcatcatcgtctcacacggaagagatgaggcctgtcatcaatccatcagattactcttttgatagtgcaaattggaattacagaaaggtttctttttggagaaggg

SEQ ID NO: 169854 - DNA, 857 bp, Homo sapiens
aaaaaaaaaaaaagaaaaaaaaagaaaaataacaataacaaaaattagctgggcgtggtggtgcacgcctgtagtcccagctactcgggagtcccagctactcaagcaggagaattgcttgaacccgggaggcggaggttgcagtgagcagaggtttcgtcactgcactccagtctgtggactcaggtcttttgggcttgagaacccacgtttataacagccacatgcgcatatacacacacacacacctaagagcacacccacatacgtgaaggtgtatgaggcagtgtgcacagggacacacgtgttatctgtacatgggccagccattagctgatcttggatacatgcatatttttatttatttttgttttaaaaaatattttatagagaaaagctttcactatattgacctggcaagtctcaaactccagaccttaagcaatccttccgccttggcctcccaaagtgttgggattacaagcttgagacactgcgcctggcctcatgcacatttaacacatagggcaaacagacacatacataatatacatgtcatgtaatcacagacatattgcatagagcaaagcaatcccaactctacctcttaaccaggttattgaaccgctctgtgcctcagtttctctctctgtaaaatgggtgagtgataatggtgataccgaatcggaactacatccaaaaggtttagcacagtgtatagcgcatagtatgtggtctgtacacattagctcttaactatgatcttgggtagagttttcagctttgaatgttttcttctctggaaatagtcctggtagaactggtgtcccaaggatttagtgagaaagtgatgttcc

SEQ ID NO: 169855 - DNA, 494 bp, Homo sapiens
cactgtctgcacaggaacagaaaaaactcagcacggagccaagctgtattagagacagggaaaggttacttctgagagcctggaggcaagcagggcggggtgcacaggtgagtcttcccagctcacctccacccgatccttaccaatctactcaaggaacacaacaagttcaacgagcaccttgcatttggaaaacttcacattcaggagaaatgtacaaagtggatgtttaagcctctgtggtgccaagtgctgggctgcatataatagagaagtctcccacgcctcctgcaatctgtttcagcaagattgctttcacgtggaaaggcaactgctgccagcagtgatgccaaggtaggatatataagatggggaccctggaggttagaggcgacccactgtccaggttgttggggacttcaagggacatgacatttttggtgctaagacccaggccaatcgcaataaggtgcatcggtcgcttgggagaaaag

SEQ ID NO: 169856 - DNA, 283 bp, Homo sapiens
cccagcgaacacagacaaatttcccattaatttccctatgccagagagtgacattttcctaatctatctttcactgaaaattctggcttcatgaagaattctgaattctaacttgcttcttcctgttgacccaaggctttatcttctatcccttcccggccattaaaacccaaatgctttggaccctgcagaatctcatttgtttactgccgtttaaatattcacctttgacatttttttttttttttttttgccctagggagttcctctactttctttcccc

SEQ ID NO: 169857 - DNA, 394 bp, Homo sapiens
tggctggcttaattgtttcttttggaaacttttatggggccttagtagtttgaaagtctctagcttgcaaaggtgcttgggatgttcgttctttcattttctgtggctcattaccatttgagtaatgtctgctcattcgcttagtcggctccagttttcaggaataaaagccaaagcttttcagcactgaacaatatctggggtggtcagagatccccgtagcccaacgtagaaatcacgcactgtcattatgaatctcatgcatgttccaactgttttgcatggcatggtgacaaaactgactggcgtaggctgggatgtatagaatcatcttgtgccatatcaactctgtgaagtttttgaagctgacttttcagtgtcatccctgggccac

SEQ ID NO: 169858 - DNA, 423 bp, Homo sapiens
tttattaaaattctccacaataggatatgagttctgtgaggtcagggatcttgctgtgtctttagtaccagtgcctggtatgcagtaggtactcaataagtatttgttaaatgactgaacaacggtcggctttcagattcaggggcgttggtgcgacagtaaatcagcaaacagggacacaggacaggttgtgggactgtggagagatcggcaggcagctgatgagtggggccaccagcagtgtggcacctccagccttcagggcacaggtgggtggagttatgggagtgcctaggctcctcctcccactcctaccctctgccaggatcaggcccagcctgtacagggtctatgaattgagttctttctccttcaacaccagccttcacatgggtggatgccacagaagaggagagtatgacc

SEQ ID NO: 169859 - DNA, 386 bp, Homo sapiens
gcaggctgagtctggaaggacagagatgcaggctgggggaaagatctggttctggacatgctggatttccagtgcccctcagatatgcacacggagatgtgttcagaagagaacaacaaatatttggggtcctggttcttctattgcctggcgaggtggccagggtcacatccataaaccaaggcccagaaaggacttgcctgaattcacctcccatgcaagggggagagccaggcctgggatccagatcccaacttttagtttcctctggacaatgctggtgttgcccatggcactcacataaaaccggccaagttggcgccaatgtcagttgacataaattgttgtgctttggggacatggctggtcctacccaaagctacaca

SEQ ID NO: 169860 - DNA, 723 bp, Homo sapiens
cccggctaattttttgtatttttggtagagatgaggtttcaccatgttggccaggctggttttgaactcctgaccttaggtgatccgcccctctcagcctcccaaagtgctgggattacaggcatgagacaccacgctcagccatggccatgtgcttttgattgacttggcttccttctactttttgacactgaagaagtagatgtgaatgctgtaggaagacttgcatctcttagagataagagcctgaggcactacaaggattctttagattagcatttatttatcactagtgatatctctttcactttttctgttttgtcaaagaaacctaatttgtgctgcaagtatcggggcaagttatatgttgaagtctgaacttgatgttcacaattttaatagaaaaattaagaacattgaagttgacagcaaagatacactgagtgacttgggttttggtttccaacttcagagtgagcttgccattccacacactgattttaatgtggaatggaaaggagtgattcattctttgtgggaactaggaaggaaataagaaagctatagctatttttaaacttgcattctggaagggattgtgttttgggagtcctaactgcccattcccctcaccccactaaacagttttcttgctgaaaactctgtggtccgtgtttttttttgtttgttcattttttgtttttgtttttgtttttttacatc

SEQ ID NO: 169861 - DNA, 329 bp, Homo sapiens
gttttcaacgaagacaagtgtaacacaattttgagtatcttactattagggcatcaaacatttcagccactccctaggcccagataactatgtatatttccaaaccaatactcctcaagtttgcctgtctttacctatctgatgtaatatggatcctcaaaaatcagttcgtttcaacatacttctgtaattatataatgtctttccaactagactatagctccataagttcagaaaccacatctattttacaggaataatttaccagacaagcaagctatattgtaagaatatcttgagtaacaaatttgcacctgagttttacatga

SEQ ID NO: 169862 - DNA, 331 bp, Homo sapiens
agccctgcgggagggggtgttacattgtcgcccaggctggcctggacccccaggctcagcaatcctcccgccgctgcttcctgagtagctgggacctcagtctcccgcgcccgcgcccacatccctgctgtgtttatccagaaggtggtgacctcactcctcgctggcctgagcattccgtcccacatcccaggcggtggccctagggaagtctctgcagctgagcacagggtggactctccctcccaagtgaatggagactggaaagggagaggatttctattctgttttgtgggctgtcagcatgaaatcgtacgttccatccaggcag

SEQ ID NO: 169863 - DNA, 212 bp, Homo sapiens
agacaaaaacgttaaatttaattttgcttctagaagtgcagagaagagaaggaaatgatgacagatctttttaccttacaaaataaatgttagctatgtttcagcatgtgtcatattatgtgggtgaaatggccgtctgcgatctctgtctctcctaagccgaattagatttcccactgcatgttcctaactccctgagcttactcctgctg

SEQ ID NO: 169864 - DNA, 511 bp, Homo sapiens
gagcttccaaactgtctaatttagtcctaaggtgattttgatagtcaagactctaactcgatttgcatattaccaattagaatttcaaggcaatccaataaactgggcattcaaaatttatgtccaaattggatctaacagacttttatttagacttcctaatcatcataaatcttagatgattacaaccaatcaacaggggtctttcctcaagcaatctactacaaattaaagctaaaaagtgatggaaaaacataaaacctgagatcagggtttgcagttaatgtatgtttggaaacatgagtctgggctatgactggtctgtcgaaaaccatcccacagccacagattattatacctcaatgccccccaccacccgttttctcttctttgcagccatcttccctttcatcagactacagtaacttctgccacatgacaaatttgttcattaaagcccagtctttgaaggatattaaatgagaattcctaagatgaggcacgtatctct

SEQ ID NO: 169865 - DNA, 272 bp, Homo sapiens
ctagaatagattaccaaggaaaagtataaaatgtatgtaaagacttaggtgacacaggagccttcagaaataaaaacccaagagaaactgcatgttcacactcagattcaacgaagagtgggtggctgtgcagaaatgtgattggacagaagggaaggatctaatcgtagactggatggggaagccttgccccgtgtgtagctttcttccttccaggtacagggcagggcccttctggaatgaaggtctgggatccattttcagataaagta

SEQ ID NO: 169866 - DNA, 507 bp, Homo sapiens
agaggatccaggcaagcctacagcagagattagaataaagcagaataactacacaagaaatacttcactaaaggaaggacggaaagaaggaaaagaagacaacaaaacaaccagaaataaaaaagcaaagtggcaggagtaagtccttacttatcagtaataacattgaatgtaaatggactaaattctccaatcaaaagacatagattggctgaatggattaaaaaacaaaaaacagttaagaggttccaagatggccgaataggaacagctccagtctgtagctcccagcgtgagcgacgcagaagatgggtgatttctgcatttccaactgaggtaccgggttcctctcactggggcttgtcagaaagtgggtgcagcccatggagcagggaggggcatcgcctcactcgggaagcacaaggggtcggggaattccctttcctagcaaagggaagccgtgacagatggtacctggaaaatcgggacactcccaccctaatactg

SEQ ID NO: 169867 - DNA, 481 bp, Homo sapiens
caacaccaatatacatatgacacttttctagataataaagtataaaattaagagcatataggcagtaggaataaaatagccacaggtaataagcaactgctggtcacctgttgcccacctttcttttagagaccagatagtgaacaaaagatgatggggctacaggagaaaaacagctgtcttcagttctgtccacacacttgaactccagtatttagagatggagaaaatagattaaaagcaaacatattttgctatttggtcttggccctaatggtcaggctgtatttatctgttttctcctgtggtgtgggggactatgtgagtctaagcaccaatcacatgcatacatgtctacaggtatttctgcattacccaaattctctcacaaaacatcaaactttaaatcaggggaagaaatcagtacctagagggtgtccactgttagaagccaactggtagtcaacctgtctctgaatcc

SEQ ID NO: 169868 - DNA, 454 bp, Homo sapiens
gtggtggcatgcgcctgtaatcccagcaatttgggaggctgaggcatgagaatcacttgaacccaggaggcggaggttgcagtgagcagagatggtgccactgcactccagcctgggtaacagagtgagaatctgtcaaaaaaaaaaggaaacggaaggtagcttctagccaaatctgggacaactgttatgtttgaaagtatttcacagtaaagagttttttgttttttctttaaatactacatccaggctgggcacagtggctcacgcctacaatcccagcagtttgggaggctgaggcgggtggatcatgaggtcaggagtttgagaccagcctggtcaacatggtgaaaccccatctctactaaaatacaaaaaattagccgggtgtggtggtgcgtgcctgtaatcccagctactcgggaggctgaggcagaagaatcgcttgaacctg

SEQ ID NO: 169869 - DNA, 207 bp, Homo sapiens
aggtattgcttggcatactatagaccgccattgcctaaaccatgaatttcatcagtgtgttctataagttcaattttgtttctttccatagctgactggaatagactcccattccttacagcagtaaggtacaaaaattttctctaaagcagaatcaattagaatccagaaactgttgtcttctccagtgtacatatcctttaaaat

SEQ ID NO: 169870 - DNA, 546 bp, Homo sapiens
tggagcagttggggaacggaataggagagtaccaaaaaagatgcaaatgttcctataaaaaccaggaggcagtaagcctgctgcctggagccaggagactggacagtggagaaaatctcttctcagatgctcctattcatttgatggctaagtaaattattttgtagtgttaaacatggacgttgttgttgtttttaaatggtgggaaccttcccataactggcttattttctcatcggtctgtgtctcctattcttcagaggttgttcttaacgtcctccattcacctcaaatttcctacccctccaggttgccagttactgccagtcagaaaagaagctttagatgtcaactccctcaaattttgcctccaggcctgcacaattaacctgtactcacattcagtgctttgtcactagtgaagggcaaaccacatcccagtcccactttgttccttattctcctgctctggaaccacctcctcctccctgctcctgaaccacctccttcttcctgctctgaaactgctgaaacgcacctccttca

SEQ ID NO: 169871 - DNA, 341 bp, Homo sapiens
ctgagaatgccaaccgctgctcccatgggagactggatgaaagggcttatctcttgcctcaagcctagtgagtgggatttcagagaaaccagtggcagagcttgatatgtgagctcagtgctgatagggacaaaaggtgagagaactgctgaaggagattgggtcagcagaatagagagctatgattggaaatatactgtggtctgtcaacagagggccaggggtgtatctttcccatgaacaagacatgaactatagaagagagggttggtatggcgctgctgtagatcctgccaagagggcttttgggagtggtgaagaggcttcagcagagggacgct

SEQ ID NO: 169872 - DNA, 379 bp, Homo sapiens
gttagatttttctacaccaaacagatggaagacgtacaactgtgcagtatggtatctcctgcccccctgtggacgccgacggagttacctgtggagaaccaaaacaatactggacaggagcatgcttacaggcactttcaaagttgagcaagggatagtggcatctattaacataattttaagaaatcagagagtcatgtctaaggtatgtgtatcatttggcaacaaaacatccataaatgagagatctgtccacccagagatacaggaccaaaagcaaatagaattatcctgttattatctcaaatcggtgctggtattgttttaaaattattattttacaataatctagggagagaagattctcttaaataagtag

SEQ ID NO: 169873 - DNA, 392 bp, Homo sapiens
gcctgccaggatagctctgctggatgtgtgggcgacaagatgcctggctcctggacacttcgtggggagggtgtcgggctctccccacagagcactggaggatctcaccacacttctcaaaaggactggccattaaagtgccctggggcacagttgctcgggtcatcagggagttcggtgttgactctccctttggtctggggccagcactgaaagagccactccagggcacccatagctctgcctctggcgtgcgaaggaggctcagaggcaggtgctgcacacggagggagcctctgggtgaccagggagtcagtgacccctcggggctgtccccttcccccttccagctgagaggccctcacctgtactgggcctgaagctaccgctgg

SEQ ID NO: 169874 - DNA, 363 bp, Homo sapiens
gattacaaagattgtttctgtgctttattctagaagttttacttcttacatttaggtctttgattcattttgaattgtgatgcgttaattatggagtgaaaattgattttcttccacacagatacctgttgtttgaacaatattggttggaaaaacttttctcatttgactgccttgacattgttattgaaaatcagctgcttttttatgtttggatctttttctggattctattctgtctcattgatcgttattagggcctctgtgttttgaatactgtagctatataggaagtcttgacctcaggggtgtctttctgctttaaatgtgattttaaagattgctttggctatttgaggtaat

SEQ ID NO: 169875 - DNA, 167 bp, Homo sapiens
cgttgtgcacatcacatgtaccctagaacttaaagtataataaataaataaaaaagaaaggcagaaatagaggactctccctagaaaggcagagaggactctcatttttctcacgaagttctgcagaaatatttactctttcaattatgtgcaattgtaactttgaa

SEQ ID NO: 169876 - DNA, 522 bp, Homo sapiens
tgcaaccacaacttgagtggatctcaagggcattatgcaacatgaaaagagcccatttcaaaaggttgtatattgcatgattccatttatataacagtctagaaatgacagcattatagagatggagaacagattagtggttgccaggtgtgaggaatggggtggaggagggaaagtgtgacagtaaaagtggcacaagggagatctttgtgctgatggaatagttctaggctgatggtggtggtggttacctgagtctacacgtggataaaattgcagagaacgatacacacaaatgagtgcatttaaaactggtagaatctgaataaggtccatggattatatgaatatcagtgtcccgattttgattttgtactaattatgccacccagataattaaagagcttacccatatcattatgctaactataaagccgttaccattgggggaaactgggtgaggggtacacaggacctctctgtattatctttgcaacttcctgtgaattgataatcatttca

SEQ ID NO: 169877 - DNA, 104 bp, Homo sapiens
tttgaagccccgtgagtcatgcaagtggagattccaataggccgttcattgtaccaatctaagctaaagctaagacttgagaaccatcagtacacaggtagtta

SEQ ID NO: 169878 - DNA, 504 bp, Homo sapiens
tgagaagtcagattctgggtatggtctaagcagcatctggaaggtatgctgatggattggatgtggcaggtgaaaggaaaaatcagggtaacaccaagggttttggtctgagcaactggtggaggagtcattattttctaacagggaaatactacaggaagtacagcttttggaggtggttctgatagtagtgatgattctgaggtctttcatttgctgtgtaataggctctattatcattgcaaccatgaactaaagaaacctgtcttgaaaaggaatgaaagctactatgagtaagcactactagtgacaagaaaattcacaactaggccgggcttggtggctcacgcttgtaatcccagcactttgggaggccgaggcaagcagatcacctgaggtcaggagttcgagaccagcctggccaacatggtgaaaccctgtccttactaaaaatacaaaaattagccgggcatggtggcaagtgcctgtaatcccagctacttg

SEQ ID NO: 169879 - DNA, 352 bp, Homo sapiens
agaaataaagtttaactccaatgtacactttaacatgattatgctgtccccttgccacagggcttgggagaaattagactaagccaaatcaggtagccactcttgagaaaagtacataactaggctgggcgtggcagctcacacctgtaatcccagcaccttgggaggccgaggcaggaggattacttgagcccaggagttcaagaccatcctgggcaacagatcaagactgcatctcttgctaaagaattaaaattactaaaaattaaaaaattagttttcatttttaaaattaaaattactactactaaaaattaatttaaaaaatttttttactaaaattaaaaattaa

SEQ ID NO: 169880 - DNA, 357 bp, Homo sapiens
tttgttctgcaggggtgaactaaccccgggaggtgtctgggaagaagagtaaatagcttgggctttgtcccaaataagaaccagggctaatggctaggactgggcctgtacccacccgctgtaggaaacctggggtgtgcagatgaacatgaccagcagccatagcccaggggagctctcagctgtgtccgagagagggtggcacaaacttagcatccttgaggtgggattttgtgttacccttcatgatctcagactgccctcctgcctctacctgtcctggaaagcagcacaggctttaaatggcagagtgagaatgtcacacctgttgctgctgcatgtttctagtaaagtcag

SEQ ID NO: 169881 - DNA, 304 bp, Homo sapiens
aggaagtggcagtagccaagatcacacggtccaaggacttcattgttcctgacttccaaactcagaatttctgatcaaatacctactaagtgaatattaatctgaagaattatgtccaaacttcattcactattttgttttaattctgctacaagcaaggttttcccctggtcccgccaccctctttttggccctaggtggttttgcttgtgaccttcatgtctgttcttggttcctttccattcccatgccagccctcattgttcactcatgacaatagccagtttcagacagctcctgggcc

SEQ ID NO: 169882 - DNA, 114 bp, Homo sapiens
tcatccgtttagctgagttacctgagctaaagcaccagactccctcccttgaggtgacaccaaggaatgtccctcctgggatggcagtaacactaccctttgttgctcaaggca

SEQ ID NO: 169883 - DNA, 105 bp, Homo sapiens
cctcaactccttcctggggagggcatagttcacatctccttctgcagggcagccttctcctcacagactcctggcccttcagcctgggggtgatagccaggtccc

SEQ ID NO: 169884 - DNA, 315 bp, Homo sapiens
aggaaacttccaatcatggcggaagatgaaggagaaacatgcatgtcttcacatggcggagcaggagagaacgcaaagggggaagtgctttgaaacaaccagatctcatgagaagtcactcactatcatgagaacagagaacagcaagggggaaatccatccccatgatccaatcaccttccaccaggaccctcccctaacattgggaattacaattcaacatgagatttgggcaggaatacagagccaaactgtatcattctgcccctgactcctctcgaatcttttgtccttttcacatttcaaaacacaatc

SEQ ID NO: 169885 - DNA, 293 bp, Homo sapiens
gtttattcactgcatgtatgtcttttggaaaatgtctgtttacatttgcccacttttaatggggttgttcttttcttgtaaatttgtttcttatagatgctgtatattagactttatcagagagcatatattttagaatcaagtgtgcattatcctaaattaaatgaaaacaaattatcagaacatatgatagaataatgaagcataacaactaaaaaaaaccatattacatttcagggccaatgatctaattttgcttttcctctgactgttaccaggagggcagggcatgc

SEQ ID NO: 169886 - DNA, 363 bp, Homo sapiens
ggcgccccgcccaccggtcacccagcgaacgcggggcggggccgctgctggcgctgggccccagggcttgcagagagagggccacgccagcggaagggccggccaggaggtggcaggacttgccttactactgagtcgccggcatccccgcctcttccggcctctccgcccggagccctagcgtggaacatgacctttcggaccctctgggtggagacacagcctctgcctgggctgtgcagtgaggtggcaccaccatctcaggtcgtctggcccagtgcatctgtagctggcatgtgacttccagcaagctcctgcccctgagcgctgggaggagcaggtccagcaataattttttttttt

SEQ ID NO: 169887 - DNA, 821 bp, Homo sapiens
actgcactccagcttgggcgacagagcaagactccatctccaaataaataagtgaataaataaataataaataaaaatttaaaaaaggaagtgggcagtggaccacaggatctaagccaaatctgaggggttggatcattgatttggaggtcctagtgggggtaaagaattgttggagtcaggactaaacctggggaaggagtgtattccggtctggacaacagaatgctcaaagttaagatagtggaagaggttgtggttgttggtctagactatagaacactcctgtctaatagatcaagccatgtgtgtaatcatacattttctagctgcctgcgctagagaagtaaaaagtccattttaatatgtttaatatattaaattcaatatatctaaaatctaaaagtttaccacgtggtacagccacatttcaagtgcttagtagctacatgtagctactggctgctgtgttggacattacagctgtagaacggaaacctgtaggtgtggttggctgagatgggaggggcaagctaattggaagagaggaggtcaaggacctggagttcagggtattgcgaggataatcaggaagtatgagtggcgtcagagaaagtgacagtgggccagctaggacaagctgaagatgataaaaggttgagaatgtggaggattttgttgactgagcacaagctcttagatctaagtttggggcattaagggtggaagaccgtttgattaaagagatcagagccatgtggagatgaaaaataagggatgacctggaagtcttgggcttcctgtgttgcacaagcaaacag

SEQ ID NO: 169888 - DNA, 684 bp, Homo sapiens
gtctcaagaaatcctgaaacatgtgtagccccttgagggtagagtcgatctaagccttattcaaagtgtagcccaaccctagcatcccgttcagcaccaaagacgctcagtgcctgcttgttgaatgctgtttcctcaccttaatcagaaatgggagagtatccctgagtgtggagctgagtgaagagcaaaggcagctttctgaggcatatttcattgggaacacacacaatatgatttgtctgtttgggagggtctctgagatttatgtctattggattggagaaagaaaatcttttctacatcctcacctacttggagaacacattcactgatctaagaggctggatggaatgggcagctcttggcaaaggtaaaatgcacagttatcttatgaaataactggccaggcacagtggctcacgcctgtaatcctagcactttgcaacccaaactcagttgtgtatgttttggttcaacttactttacagatttggcagaatgtcgtggtctacttattttccaagttgtgtatgttttggttccacttatttcaccccattacccaggcaggtccttctgtaaagccaaacagtgaatattcaggttgtcaggcacacatctctgggcagctactgactctgtggtgtgccaaatacagctacgtactgtgtatggggacgg

SEQ ID NO: 169889 - DNA, 469 bp, Homo sapiens
tgacacttcacaggtcttcccagatgatttgctgctttacattgagccagtgacttctgttcccttagtaggtcttcttccacttccaagtgtgaaaaaccaccagtgttcctagcagctctctccctgttcacagtttcattcacatgcatatgaaacatcaatatctccaaagcatgctccagattctatctcagtatctccgaagctggcctcctaactacattcaggacagccagtctgatgtcctcaagcatggtataccagatcctgttcttgcatccagctccttgcagtggagaagtcttgatacctctgactattccttgcttctttagtgtgtttcactaataagtctgctttgacttcattccattttctttccaaagatacacgtacaattatttttattccttttctacatatggatgtcgacgcggctgcgaatttagtagtagtaggcggccgc

SEQ ID NO: 169890 - DNA, 215 bp, Homo sapiens
  misc_feature (3)..(3): n is a, c, g, or t
tancacaacttcgtccatcatgacctggcccagacatagttcaccatcttacgggtcctaacacgtgcgtatgggccctcggcggcgtgtgcagtctggtcgctcggcgtgtgcaccgagccaccacacctggctgagtttttttgtttgttttttaattattgccattgactctgctgtatctgtcaaaacttttttctctggtgtgtcgtaaa

SEQ ID NO: 169891 - DNA, 113 bp, Homo sapiens
cactctgtccttctgcagcacctggtgcactggggccacctggatcctcgactgttgaggatcccgatgctctagacccccactcaggggaggttacgactatgtgccacaca

SEQ ID NO: 169892 - DNA, 295 bp, Homo sapiens
cataaataacatgcccatgggtctaggaaagtgtttttaaaaaacactgccacataactggaaacagttactttggcttagtcttccacaataggagacctcctctcagaaagtctttgtaaccattagtatgtcaatttctccaaccagtttctctcatcttgccccttcctatatctgagtctggttctttcctctttctgcttcctaggggacttttcttctgggttgctgcagcctctaaactgagatgtgtcttcccacctgaaaataagcccttattccaagaagccaa

SEQ ID NO: 169893 - DNA, 653 bp, Homo sapiens
tgaacctgacgactcatttcaatagaataaggcaaaaatgatgggattaaatttcactaaagcagtgaaagactgataaacagaaaactgtagacactgctataagaaattgaagacataaattactggaagacatcccatgtttatgggttgaaagatttaatattcttaagaagacattactaatcaaagcaacctatagactcaatgcaatccctatcaaaatctcaagggcattttttgcaaaaatagaaaaacctatcctaaaattcatacggaatctcaagagaccccaaatagccaaaacaatcttaaagatgattaatatttcctcatgtcaagttactaacaaagttacagtaatcaaaactgtggtactggcataaaaacataaagaacaatggaacagaatagacagcccagaaataaaccctcacacatatggccaaatgattttcaaccagggagcccagtccagttaatggggaaaggaatcttttcaacaaatggtgctggaaaaaactggattatcgacaggcaaaggaaaaaagttggacccttaccttacttaaatacaaaattgattccaaatggatcaaagacctaaatctaggcactaaaatgattttttaataatagctatcctgcttgac

SEQ ID NO: 169894 - DNA, 416 bp, Homo sapiens
atgacagagcacgaggtccgcacaagaaattaaccagatgcagccacttgatcttggacctcccaacctccagaatcatgagctaaacgaacctccttgctttataaattactgagtcttaggtattctgtgatagcaacacaaaattgactaagacagtattttgatttcatttcgcatttatttattgctggcatacagaaagaccacttatttttgtatattgatgtttcacctagtgaccttgctaaatctacttattatttctaatagtttgaagatgctcctgagtttcctaggtacttgatcacgttatctacataaaatggcagttttagtccttcatttttccaatgctgtgtaacttcctaattttccttctatttttgccttattgcacttgctgggccagaaaa

SEQ ID NO: 169895 - DNA, 256 bp, Homo sapiens
tactttaggcttaatgcaacgtacattctctacagaaactattcaactctgctctggcagtgtgaaagcagtcagaaacgtacatgaacaaaagagtatggctgtttcaacaaaactttatatacaaaaacaggcggcagtggatttggcctgcaggccatactttgctgacccctttggtagaagatattaggatggtagttggtaaaggtaggaaatgggagaatcagaaaacaatcgagaaagtacggttgca

SEQ ID NO: 169896 - DNA, 327 bp, Homo sapiens
ccatttagacatcattcggtgcaagaataatgacagcttaaagaaggagaaaaagaatggctgctgtgaatcttcatgggtgatgccgttcagtgctggaaagggacctcctggagccatgctagttacgttgctttatttttaatatgcactttagctgaataaattacttaccttttactaattagttttggaacagtgaaccacatcaatcaaatctgtccacttgaccagaaaagttagtaatttagtaaaagcatggtttatgctgggcccctgccttgctccccgtctctattttgtttgttatattgaatagtcaaggtg

SEQ ID NO: 169897 - DNA, 236 bp, Homo sapiens
ttgccaagcgtagtacccaaatgggaagcagtttttcagatgttgcgatttagtgttgggtccttcagtagcttgacattttggggattggtactggtagagtatcttgtagtactaataatcaaatacagcatcatttgaaatgacaagggagccattgagtaggacattaggaggaggaaggactattctttggagtggttggtaatcagagtcttgggtactacgcttaggca

SEQ ID NO: 169898 - DNA, 592 bp, Homo sapiens
acgagccactgtgcatggccaacacatgtagacatttaatcaaaaccacagaaaaggtcccacttataaatggttcattcatccttgatacatatcttacagagattgttggtttttaacccatagagtgtactttaaaaacaagaaaattttatgactggctttcaaatcaggattgtaactgcataccttaggtttgaaagaagtatggcacatctcctagccctatagctatggtgtcagataaaaagacagcatgctccctgccccttctttcattctttctccctaccttctctcctaatcgaagagggggaaattatatcattttattcaagtaagccatgctttccaaaagtatgtctcattatgctaaagagaaaacaagaaaccaccaatgaataaccctttactatctatttaattatctttctaaaatatttacaaaggcaaacaaaataacttgccttgtatcagtaccacttagtaactattcggaactagtttggagctctgcacatgcaagtttttagcggtttctctgcaaaaaaatttaaaatgtttctttcagatagactgaaatattagaggc

SEQ ID NO: 169899 - DNA, 319 bp, Homo sapiens
tggcttggtctttcctacactacatgcatttttttttctactgcactaagttttgtttttattatttattagttccttctttctttaggtttaacttcctgttctgtataaaaaaaatttcttaaaaggtctactcaatcttgcctttgaacaccttgtaaaaagtaagcatatttattttaaagtctgtttctgataatgtcaatatctggagtccctttaggactctttctatttgttgtttctgctgggttttggtcaactaattttgtccctttgtgcacctggctattttttattgtgtgttgggcccacattt

SEQ ID NO: 169900 - DNA, 258 bp, Homo sapiens
actagaggttacgtagggcgaggacaatggcgggtgggtttgctacataacgaagaggtacatagagccctgggcacacaggtgcccaccaggacctggtatgccgtaccacagtgctgatcgctaccccttccctgggaccacaggcagcctccccttctagcaggagctcccagtctccctgagcagctttcctgatgacatcatacttcctttagagtatgtatgggtgtcctagagccaccatacccacggccc

SEQ ID NO: 169901 - DNA, 641 bp, Homo sapiens
agtgaaaacacacaactgaaaaagtccatgaggactgagtggaaattgacaagaacaaggggagttcatcaggaacaacttttccaggaaaacttgaggttcagatttgagaggataatatggctggatgaataggagaaaataagctactccagaggaaatgaaggaagttaagacatggaatcacaatccatttcacctctttgttcttttcttttaaccttaactgcaaccttccccatagtaagcagaggaagagtagatattgtttctgtggttaagttacagaaagtgtgttgcttgctaggtactgcaaagtatttttctgttagtgacaagcaaatcatatcaaattgttcaaactcaatttcaactcttataagaggatagacatgggttttgaggaaatggttatcatttgccttgttattacctcatctttgagccccaacatgtgcctttactacttatcccagtgattctttcaaaaaattatttaataaatcaaaatattccataagtcaaaatatcttcaggttgcggatttacctttgactttcatcttaaccaattgtttaaaattcccccattctcctctcatctattgtgtataaattcagattaaaatgtagttaaattca

SEQ ID NO: 169902 - DNA, 538 bp, Homo sapiens
atacatagacattggtagaaaataacaaaaacaaaattaaaatttacaaattgcttgtatttactgatttgcatgattttcacctaaactgcagaaaattgtccataggagtttttactagtagtattttatctttaccactgatctaatggtagaaaaagaaatagagctctaagagaggtttttttttcttctttttaaaagttatcacttgtcttttgtttacatagaaaagtgtggctttggaataaattatattacttgacccacctcccacaaaagttttgcttaaactcggcctataggctggaaggactaggatgaaaaggggtattgctaatggatactggtttctttttgagtgatgaaaatattctaacatttattgtcataagaggtgcagaactctatactaaaaaacatttaactgtgtgctttaaatgggtgaattttatggcacgtgatatatatctcaataaagctgtttaaaaaatcacctggtgacgtgaatccattggtcaaaaataaaataaagaga

SEQ ID NO: 169903 - DNA, 467 bp, Homo sapiens
aactgccccgatgatccagtcgccttccacctgatccccaactcgacaagtggggattatggggattacaattcaaggtgagatttgggtggggacagagccaagccacatccaaaccatatacacgcccaagatgacagttttccatgtctgaccctgcaatgacacaagctaagggaaaggcatagaaggacccacacttccacctaggcgtttgcacatatcctgtctgtaactccagtgggtcttcagagacaatctacaattactttctccaataaaaaaaaaaaatcttgagtgcttcgtatagaacagatactagatcaaaaagatgattataggctgggtgtggtgactcatgcctgtaatctaagcactttgggaggccaagacaggagaattgcttgagcctgggagttcaagaccagcctggtcaacatagtgagacctaagctctacaaatagta

SEQ ID NO: 169904 - DNA, 458 bp, Homo sapiens
caggagaatcgcttgaacccagggggctgaggttgcactgagccgagatcatgccattgcactccagcctgggcaacagagcgagactccatctcaaaataaataaataaataaataaataaataaataaataaaataaaaaagaaaacagtatgcagagtacaattccacttctgtaaaaaaaaaaatctgttttgtgcttacagagaataattctggaaaatgtaaataaaaattttaatcctgagttttcttgagatactgggaataagtgacatttatttattttacatatttttattatactggctttatttttattatggaggttaatattttataattagataaataaataatttttgaaagaaaagaaaaaatgggcccacactaacccatgctaaatgaggtcacagcagtaaatcatcctgtgggcagccgtcaagtctcatggttga

SEQ ID NO: 169905 - DNA, 137 bp, Homo sapiens
taagtagtttaatgagagtcctgtatttttgtatctactgaatgatgtggtgacagaaatttgcattgcttttactattagtaaaattagtaactgcagtagttatgcaaaagctaatatatgtgctgccttctgtt

SEQ ID NO: 169906 - DNA, 341 bp, Homo sapiens
cgggataagtccaaggagaattagcattaacaaaggggagtgcttctttggggtaatatgcatagtgctttggggaaatgataaatagactgagttggaaggaagagaaagtttgtgtattaaatggtagataatatgattggagaagtaaatttggactagccttttcatttgagaaacataatcattgaacaattacagagaattctgagcacatagccctgtgctagatacttactgagtatacaaagaggtgaagtataaagctcatgccttcaagaagcttttgagtcctggattcaggaagtagtcataaatatgtaaatagtgtctgaaagtga

SEQ ID NO: 169907 - DNA, 273 bp, Homo sapiens
tagacccaacttacacatgcccttatattcctgtgcggaatactgttttatgtaaaatcttttcagtatcaaatacctactcctagctctgtagctaatggtaggggttgctagggatgaatgtggccgtctaagcctgtcccctaaaatgaggctgtaagatgcacatttggaaaaggacttgtgcttgggcaagtgtctgaagcttatctactacagtaaatcatcagatttgaggtcaaggaaagaaagtgggcttgggttgtttttgca

SEQ ID NO: 169908 - DNA, 331 bp, Homo sapiens
aaaatgctgggaattgcaggcgtgagctaacgtgcccagcctgtcctctcttaattaatatgctcattctgtatgtctaagcctctttcctgcgtctaagccgaattaactgctcacccatctgttactatagcacttctcacattctatatttatctttcatgatagactaactctttgagggcaagggctatatacagtaatatgcccaaagttacagcaaacaagatttagatttaaatatgagctaatcaagtaaactagcttgtggtctaaagacccagatttgaatctggccactagtccaagtcacctaattttttttttcttt

SEQ ID NO: 169909 - DNA, 139 bp, Homo sapiens
gcctctttgccacttctttacctggaaaactccagttggtttatgtcatcgttcagggatcaccttctccccaagaagcttttctagccccccttccactctgacaggtgactcctctgtgctccctcaagccctagtg

SEQ ID NO: 169910 - DNA, 106 bp, Homo sapiens
aggcaccaatgtctcacctgcaatgtggctatacttatgtagcagatgctgtctttttctgttttctgtaccccaggcacctagagtaccacttccccacccatca

SEQ ID NO: 169911 - DNA, 1756 bp, Homo sapiens
tccatcttttcaggcacgctccgtaccatgactggctcataacatggttgcatgaggctgttactcaagggataggagtggtagccataggagtcagttgtacagggcagcgggtcccagctggcatgctgttcccggcacaggggaggtcgtctttgcctcacggggttgctctcatagaggcgggagtcggaaatgctatccatccgagtcatcaccagggcacggcctggctggggggttgccccaggatggatattgggaggcatggggtagtctgcaggacagctggaacgtgttccagttgatgggtgctgggcatgcagagctaagtgggggactgactgtttgtgggggccttgcttagaatcctctgggccatagctctgcactcgtgttaaggcttcatggtaaccatgaggaaaaggctgaagtcggttctgggatgctgagcggtgcagcttcaaattgccttcaggatgggtatcagctacagccaaatacacgttgttgtaagaggaatagttgtcattcctggtatggctcacacggctgtcagaacagaggttaggattccgggcatacaccccccggtctacttcagccatgtaatactctcggttatgcatgctgttgatgttcagtttggagaagtcacctaacattgaatagtagccatggtcccccatggattcaaactttgggtattgctcagcatagctaataggggtcccatggctgttggtaaccaagatgggaggatactgcatgctggccatatgctccaaagaggccttctggtgggggaaatgggaggatcctggcactgggctgctggccgaacgggtgttgagtgcacccactgcatggcttttggggggtgggattgtgggaacacttagggcagtcacaagcgaggggacagaactagcctcaggcttacgggcaatggacagccattcctcaggctccatagccacagaccggatgctgggatctgattggcgcttgggggccacacgtttgacctctgaggttatctcacctttggcactagacatccctgtgccacacttggccagggtgccttcactcatagttttcactgtggacagtttggcactgatgcggagctcatcagccaccgaacgctggggttggttggcccgctccggatggtagtatttgcacttgtggccgtaggtgcattttttgcctgaaaaataatgccttggggtaagactctctctcagtgatggaaccctctgtgccaaaaactgttgtaacaatctggtcactcaggttagggttttactgtttggggtaaaggcagaaaattaactgtccacaaagatgagagacagacaacaccaaggaggcatcatacactgtgatgggagagagaaagtggaaagctatggagaaaattgcagcataaaagctaagagctggctggatgtggtgactcctgtctgtagtcccagcagtttgggaggctgaggtgggtgaatcactttagcccaggagttcgagaccagcttgggcaacattgtgaaaccccgtctgtaaagaaaaatacaaacaaaattagctgggcatggtggtgcacgtctgcagtcccagctactcaggagcctgaggtgggagaattcttgagcctggaaggtcaaggctgcagtgagccgtgatcatgccactgatctccagcccaggtgacagagcaagagcaagaccctgtctcaaaaaaaaaaaaaaa

SEQ ID NO: 169912 - DNA, 477 bp, Homo sapiens
gagtacttttttagtttattttaatgcctttaagtttttggtgacttttacatttggaaaattacataaggtaaattatttgtagagattacaaagttagccatccatatgattgcacttttactataaggagatgccacacagttctctgcccttgatgacctcatattatttttgctgcaagagaaagcaaacaaatgacaaaaggtgaatatgaagacaatggaaaatgttatataaataattgccactcaaaagtcattctttaattcctgacaaattttggatgtcaactcaatgaggacaaatttgtgtaaggataaatttgtcaacttatcacagatgatggagagtgactttaaccaaatcatttctcttctctggtcttcagtttcttgatctgtaaattgaaagactcagtgtagctggagctctgatactccttcttcactgcaagattgcatgattttgtgaggt

SEQ ID NO: 169913 - DNA, 576 bp, Homo sapiens
tagtcgtctcatagaggatcccctgccgagatgcatactctggctttgtgactgatacaatgttatgtgctggatttatgtcaggagaagctgatgcatgtcagaatgattctggtggaccactagcttaccctgattccagaaatatctggcatcttgttggaatagtaagctggggtgatggatgtggtaaaaagaataagccaggtgtctatactcgagtgacttcttatcgcaattggattacatccaagactggactctgaaaaaaaaggaattatacaaaggaacataaagaccaccatcaagaaactgaagacaatggaaaatgttatataaataattgccactcaaaagtcattctttaattcctgacaaattttggatgtcaactcaatgaggacaaatttgtgtaaggataaatttgtcaacttatcacagatgatggagagtgactttaaccaaatcatttctcttctctggtcttcagtttcttgatctgtaaattgaaagactcagtgtagctggagctctgatactccttcttcactgcaagattgcatgattttgtgaggt

SEQ ID NO: 169914 - DNA, 1037 bp, Homo sapiens
atttacaacagctccatgtcaaagatagttttcaaaatagaatttcagtggtttatagttttgtttgggaacctcatgccttaaaattatgagataatcaccactaagaacagtgttgtgacccagcaactgagtgtattctaattacattgtgtcctctaggaaaaataattcaaaagattggactgtcaactttggaattgtagtaaataaaccatatatgacacggaaagtccaaaacattatttttcatgaaaattatagcagtcctgggcttcatgatgatattgcccttgtgcagcttgctgaagaagtttcttttacagagtacattcgtaagatttgtcttcctgaagccaaaatgaagctctcagaaaatgacaatgttgtagttacaggttggggaacactttatatgaatggttcatttccagtgatacttcaagaagactttttgaagattattgacaacaaaatttgcaatgcctcatatgcatactctggctttgtgactgatacaatgttatgtgctggatttatgtcaggagaagctgatgcatgtcagaatgattctggtggaccactagcttaccctgattccagaaatatctggcatcttgttggaatagtaagctggggtgatggatgtggtaaaaagaataagccaggtgtctatactcgagtgacttcttatcgcaattggattacatccaagactggactctgaaaaaaaaggaattatacaaaggaacataaagaccaccatcaagaaactgaagacaatggaaaatgttatataaataattgccactcaaaagtcattctttaattcctgacaaattttggatgtcaactcaatgaggacaaatttgtgtaaggataaatttgtcaacttatcacagatgatggagagtgactttaaccaaatcatttctcttctctggtcttcagtttcttgatctgtaaattgaaagactcagtgtagctggagctctgatactccttcttcactgcaagattgcatgattttgtgaggt

SEQ ID NO: 169915 - DNA, 526 bp, Homo sapiens
cagctgccaggaaactacatgcccaccctcccagtggaaggagtgactcagtgggccagtaaggcaggcgaatggtcactgacttctacagctagctgtcaccttgctcgctgtccttcctctgaagttgttcttaagcagaacacgttctcctctctgccagtggtgccatgtgggggcaagctcaccaaggtgcaggcaggacctccccacttcatagcagaggcctctgttctctcccctctcaagaaactaactagctgagacgggggaaatcaaaggacaaggaacagcccattccatccgggtcttcagcccagctttgcaagcaaagagctaaaactatattttaatcttcttctgattcctgtgttcactttgatccagaattagcctgaatgtctaatactgatgccaggtttatcattgaccagccttaaccctacccacttgaggacacccaacccagttgcttcacatgtggtctgagccccagtgatgaaactgtagcttcttcttgaagctc

SEQ ID NO: 169916 - DNA, 289 bp, Homo sapiens
tcttttgcttttaataatttaaggtaactccttcaaagatattgcaggtctagttcacaaaacaaattgtacagtgagctgagagcaactttctctgtcctgagttttgatgaagttgttttttttaaatcatgatcaggatacaggtcctcaattagtttgtctggaatttagtaagcggagtgctggagattggagatcagagtagcatgaagattgaataagatggggattgcacattctggtttacccagtttggaagagtaatgcataggtaatatacaggttg

SEQ ID NO: 169917 - DNA, 155 bp, Homo sapiens
agacactggcatccacagaagtaaaaataaaaagtaaggtataatttaaatttcacacggtcatggtcacatttttcagctttttgcacctatgttgtataaaaaagacaaaaatgcctttagaggctcaagttttcaggacttcctgaagctgt

SEQ ID NO: 169918 - DNA, 126 bp, Homo sapiens
atatctgccaccacaaaaatatacttaagtacatagcccactgacattataaagcaactatacaatcaaatctacataaaaactagctattaataagaacacaatgacaggatcaaatcctaacat

SEQ ID NO: 169919 - DNA, 306 bp, Homo sapiens
tactctagacgatcccatttcgacacttcagggaggggtgtaagatgaggacaaacaaaaagagaatcagcatatttctgggttatggaggggatgagatgaggaaaaagaaatacagcatgacagttaggagcgcagattttagtgttaagagctcttgttcaagactgtgctctaccactatggcgtgactctgagcttgcttttcaactaggcctcagtttcatcaacttaaaaagggataataatataaggaaatggcttagtatagtggcatactgaaaacactaaaaaaaaaaaatcagg

SEQ ID NO: 169920 - DNA, 469 bp, Homo sapiens
gcgacacagaagtggacagtgaatctaggaagacagcagcagacaggatccaggaaccagtgttgagtgaagctaggactgaggagcaagcgagcaagcagcagttcgggtgaagaaaggaattagagcccagtagaaattaggcagaagcaagttcaacttcatcagcatgtagaattctctcctaaaatcacagcccactctggaaaggccttcttcgtggggagggttatgggagggtgggctgcagggtggccatgagaccagcgtccaggggtgaggatttgcactgggaaagggtacgcggcgctcagggagctgcagcagaaacaggcctgagatctggggtcctgcggcacctgggcacagcaagtgccctgcagtcgctcctcctggccctccgtggctggccttgtccctgagtggggtcagcggccctgagggagaggcagccagagtagtgggtgat

SEQ ID NO: 169921 - DNA, 207 bp, Homo sapiens
aaaaagcttaacaaatgttcatagatgctttattcataaaagccaaagtctaaaaacaatccaaaggactgacacattaatagtcatgcagattttgcatgttcccacagtgggctattactcaaaacataaaggtatgaattgttggtacacacaacaacgtggatatgtcaccaaacgattatgttgaaaagaagcagccagata

SEQ ID NO: 169922 - DNA, 355 bp, Homo sapiens
cgccatgggagcttacagtggaaatgcaggaacattctccgctgcagagagtctgataacctcggtccttagatacacaaaaacaccccagtgtgctaatattacccagagcatcaaaaaggcatgcaaggatcaaattttgcatggttcctgctgagtgtaaaggaaagcactaagccattttctctgccctctagaagcttataatgtacagtcctatcacaaagcagaataaaaacatgaaacctataaatgggaatgccataaagtatttttatctctacaggtccagggcagaggaccaacgtcgacgcggccgcgaatttagtagtagtagtagtagtagtagtcgacc

SEQ ID NO: 169923 - DNA, 325 bp, Homo sapiens
agatagaatataaatcatccctgtcttgatgatcttaacatctatagcttttaatttattcttcagctaccaaaggagcttggtattagcttcattatgcagataagaaaaagagaagtttaagtggctcatgtatgataatagcaataataggtgatgatcctggaagctgaactcagatctccagaatctaagtctaaggtaattttattatttgcccctttaggaaaagagatagatgctaggataaccaaccgtcatggttttttcagaatagaagattttctcaggatgcaggacttacaggaaagtcctgggtaaacca

SEQ ID NO: 169924 - DNA, 276 bp, Homo sapiens
agccatacgtgcagtggaaaaggcacgggcgtcgaagcagaagcacagtttgaaagcaagctctgtgaggtgcaagcctgcacccctggactagttcctggatctcttggcactccagtttcttcatcttcaccatactgccacctaacctcctctgccacttcctgtcacatgaggtcatctcacacaggccaggtggctggcagagtcctccatccattgaaatcactgacttgtccacagttaggattcagaagtgcttggcatcactcctac

SEQ ID NO: 169925 - DNA, 386 bp, Homo sapiens
catttgcagttgtagatgtgggagggcttaggaaaactttaaagcgccatataaatgattatcaaggatctcaagaatgtaatgtcttcatctcttttgcccagataacactctacatgtgaataggttggacctcaatgcgtttcaaaggtagaattctagaaatatgacagggtcagtgtgaaacacgtttttgacaaaccccaatctgtcccagtaactgattaaagatgcagttgggctttggactaaaatccctatagacatagtatttgatctagcccattcaggctctgccccaaatttactgttaagaaaaaaaaaaactatcaaaataggaggtttctttggaactttctccctcttacgaaaacagtccccaggct

SEQ ID NO: 169926 - DNA, 478 bp, Homo sapiens
tgacaaggaaaggcattaataatggaaatggattgaaggtaacactgacgtgcagatcaggaatagctcacacggtgatgctcttgcactagaagcagaaactatcctgggatctaaagaaatcacttaagaagaaaacatttcctcttcattgagcctcagtaaagctgcatgaggagaattctgcacaattgttcgtactctagcttagaaaatggagttgattaagtggaaggaaactttaaaaatgtgacaaagatgatgaggtgattaaggggtaggttttaagtagcaagatgtggggaatttaagatgtatgactagtagcggtgacagtgaggtttatgatagctgcctataaatacccaattaattgcctaatgtggcaaatgagaagaaacaggcttttaccaccaaaagggaaacttgaagtatattagggaaacagtatttaacagtaggggtgatttggctgcca

SEQ ID NO: 169927 - DNA, 293 bp, Homo sapiens
caacttttggtggggatatgtgactacttaggtctgctggtttctagggtggcaagaaaccccagtttcttttaagacttttcagctggataccagatattgacagactcaatctcatcttggtgttcaaattttaagttgccaaactttagcttttggacttgtgtgacactcttactagatgcatacctagcctccagctaggtgatattgtgtcatccttaagaggccaacgaggtttcattttaaaagctagctcatgttgattgttagtaacttcctagtgtgttgtg

SEQ ID NO: 169928 - DNA, 290 bp, Homo sapiens
ccaagaggttgaggctgcaagtgagctgcaatagaaccactgcactctagcctgggtgacagaggaagaccctgtctcaaaaaaaaagaagtgtgaactttgatgaagtctagtttatctgtcctatcttttgttgcttatgttcttggtatcatatataagaatcgatggagaaatccaaggtgatgaagatttaactctatgttttcttctcagagttttatggttttagcttttatatttaagtcattaattcattttgagttaagttttgtatatggtttgaggta

SEQ ID NO: 169929 - DNA, 360 bp, Homo sapiens
ctctagagcatcccgttttggtgtgggtagagaagaggaacggagagaagtgaaagggaggaggacagggaggtagcgtggtaatgggagctgggggccaggccccggtgcgtggtgatgggagctgggcttggagtcttcagacctgctctgcccaccttccctgtcctcatggataacaccacctccctccacgttgcttcacttgagatgcgagattcagtactgggcctgggagggctgggccgacctaggcagctggcccttcccacttttctcccttcatgaccacgcagccactcctgcaaagcagcagagcccagcggtgcctgcttcctgtcaccctccctgcccctccct

SEQ ID NO: 169930 - DNA, 688 bp, Homo sapiens
  misc_feature (91)..(91): n is a, c, g, or t
  misc_feature (96)..(96): n is a, c, g, or t
  misc_feature (106)..(106): n is a, c, g, or t
tacagacgaggatgttgtaacagaacaggctggcaggtccacacagatgtacgtgccgccagccaaagtcatttctgtacttgcagagcanagcanaatgcctggnacataaaagacactcaatgtagagtgctgagtcaatgcatgggtgaatgaaactagcatcccaaagggaactgaggtgcagttccagtgcttgcagagaaaaggtctgcccaccaaatgtggtccagaaatgctgaggtcagcctccagcctagggacactggtaatggtggtggaagcagctgagagaagatttttctttcaaagctgaatcttcagatctggggaactaaaagaaccctccaagatcacctaacccaattcctaaatgtttcagatagggaacttgaggtcttggtaaggaaagagacttgatcaaagtcacacagtacattagggttacagccaggacacagttccatgtctcttgatcccaacccagggttctctgcaggacaacttttctcatctgggtcccacatggacgtagccaggagagcagctggtaggattaaatggccaccaagaatttctacactgctttttaaattgtcaaaactcaattgctgatagacttgtgatgcaggtttagagaaaataatgggtttgactaaggctccaagctaagaagccacttgcttgt

SEQ ID NO: 169931 - DNA, 195 bp, Homo sapiens
cccagcatcctcttggaaagaaacaccagttgactccagatagagcaacccaccaccccgtctctgggcctgcaggcctgcccggccagggacctcaagtaatccagaggagaaacattaggatgagtctgcctcctccttgagcccccaaatcccaccaattctgcaaatgcccacgttggaaaagatgccagt

SEQ ID NO: 169932 - DNA, 423 bp, Homo sapiens
ccacacaacccagacccatgccctgggacccacacacgctgtgtgttcgcgttgcttcagaaccaggatcagtgtccccctcttggtgttatcttccactgttcctggctcttaaacacaataccatgccaaacaaccttttaactagcccctagcctagggcctgattattttcttaggattaattccacaggaagtccgtctcctgtgttttgctacgcatcttgtgtggctttatgtagtgttctccaaagttgccttggacttagaagcgtacctttgctggaaaatcaaggaaaatgtggggaagaaagctgtgcctagaacattctttcatagccttaaaatgtagaccggaacggtggtaccatgagctagctcagactcacagccaagcttggttggagcctcggagtgctgtta

SEQ ID NO: 169933 - DNA, 179 bp, Homo sapiens
ccacctcggcaaatccaaagtgctgagattacaggcatgagccactgtccccagcctactatattgtctttatttactcatttgatgttaaactgttgattctatattttgacaattgtaaagagtgttgcaaacaacatagaagtgcaaattttttttattctgatgcgaggtggagc

SEQ ID NO: 169934 - DNA, 322 bp, Homo sapiens
gacatctcttagtctgtctgccaaaatgctaaatctgaaagatacctcaaataccgtttccttaggattcacaatagtgatgttatctgtagaagttgttggagaagttacaaatcttgcgacctctgtttgagtgaccctggggcaggaagcaacatatagaaaagccagctaagctaagcagttggcaggtcattgtttatgcttattctttagcaaagttcagaccctaccataactctaacctcggcttaggaatgtggcttcaatctcgaaacaaggaggggggtcagttttccttgcctcatcgtttaactataaa

SEQ ID NO: 169935 - DNA, 482 bp, Homo sapiens
ggtcacgctaatccagcacttggagttacagagacggagtcagacagcctgttcagcatagcaagaccccatctctacaaaaaataaacagattagctaggcgtggtggtgtgtgcctgtagtctcagctgcttgggaggctgaggcaggcggataacctgagcacaggagttggaggctgcagtgaactatgattgcaccactgcacaagagcctggacaacagagtgagacttgtctttaaaacacaagattggtcttcaaagagaataacatctgcggtgtcttgtgaggatggatgaggggctgccaagttcgcaatgaatgtgtcccatttctttttagtttatggacttaccataaactgaagatagcagtttggtgggttggagaagcatgtggtaatggtgggaattataatacattacttacagggaaagacaggcctttgaaaggtaaagcgtaagagtgagaatggaatac

SEQ ID NO: 169936 - DNA, 461 bp, Homo sapiens
ggtcacgctaatccagcacttggagttacagagacggagtcagacagcctgttcagcatagcaagaccccatctctacaaaaaataaacagattagctaggcgtggtggtgtgtgcctgtagtctcagctgcttgggaggctgaggcaggcggataacctgagcacaggagttggaggctgcagtgaactatgattgcaccactgcacaagattgtctttaaaacacaagattggtcttcaaagagaataacatctgcggtgtcttgtgaggatggatgaggggctgccaagttcgcaatgaatgtgtcccatttctttttagtttatggacttaccataaactgaagatagcagtttggtgggttggagaagcatgtggtaatggtgggaattataatacattacttacagggaaagacaggcctttgaaaggtaaagcgtaagagtgagaatggaatac

SEQ ID NO: 169937 - DNA, 129 bp, Homo sapiens
aaactgaggctcacagaagttaggtgattagttctagattaatgatgccaatgaataaactaaatcaaaaggaaagttttggaaatggccatatctatcagacagatgtcaatccagaaatcctgattc

SEQ ID NO: 169938 - DNA, 412 bp, Homo sapiens
gtaaggaaatgcagcagtccttccaacaccccaattctaggagtctccctaagtcccaacattaacattgccccaggaaatcagaccctatcagttgtcctcaaagctcaagtccgtaagcacagagccatacagctaatacccctacttgtagggttaggaatggctacagctacaggaaccggaatagacagtttatctacttcattatcttattactacacactctcaaaggatttctcagacagtttgcaagaaataacgaaatctatccttactctacaatcccaaacagattttcttttccagaaatttcctttaaataaaaattacaaaaagatcattcagaagaaagagcagctagacatttttgtttagtaattttctttttttaaaaaacaagtttttgtta

SEQ ID NO: 169939 - DNA, 718 bp, Homo sapiens
agcgggggcgttcagtgcagtgtggggcccagggaggctggagagaggctggtgttggcctcatcagttgcatctgtgtgccgaagccactctgacccctccagctcacgtggacacgcgggggctcccatccacgccccgatcccctgcctcaggtggcctgggtgctgccgctggcttcttcctactccctgggactcagaaagagggggagacagagagctcacattctgaaaggtgagatcatctcacttctgccagttcttggaaaagttattcgttcccagaaatgtttattagtcacccttttgttgaaagacattttggcaccaccagatggaaaaatcaaaatgcttctcacaggacgatttgtctcaagtattccgcctgacatcccacaaggatgatttctgaggatacaactcaaggaggatgttctgttggcatctgtggggagaagccagatctgttcagctgtgtgtgtgtgtgtgtgtgtgtgtgtgtgtgtgtgactgtgtatgagagtgtgtgactacgcatgtgtgattgtgttcgtgactgattgtgtgtgtgtgactgcgtgtgtgactgggtgtgtggctgtgtgactctgcgtgtgtgattgtgtttacgactgagactgtgtgtgactgattctgtgactgtaagtgtgactgtgtgagactgtgtgactgggtgtgtggctgtgtgactatgc

SEQ ID NO: 169940 - DNA, 589 bp, Homo sapiens
cctggtagtaagtccaagctgtccattaacaatggtcatgttaatgcatgtcaaattcataacaacactaatccttatagcttttaaagcactattctctagtcacaacatgcttcacaaagttattaaccatttcaacaaggttggttttgaggactcaaaaatttaagtgacgttccaatatagaatccaattctctaaaattgaaagggagggttgaacaccacattagtgttcatacaaactgttacagggaaaaaatagacaagaactgtgaaaatagagaagattcaagtcattttaaaaggtagtaaatttgcaagcagggcaatgttgaagctagattaagattaggaactagaaattataagagcatctgaaatgaatgtgaatgaacagaagctacagaaatcaggtgcccaggcaaggagacccagggtcagtaaccaaaacaagggatataggcatcaacaaagctgtacgaggagctgaaaaagactagtattttgaaggaaaaaaaaaatctaccccaggatatccatttcctgtctatggcgtgaactgttgtaaaagtgtatatgttggactt

SEQ ID NO: 169941 - DNA, 641 bp, Homo sapiens
gaaatcacaaggatattgattggggaagtgataagtgtccatgaaatctttacaatttatgtttagagattgcagtaaagacaggcataagaaattacaaaagtattaatttggggaactaataaatgtccataaaatcttcacaatccacattcttctgtcatggcttcagccggtccctccgtttggggtccctgacttcccgcaacagataaccaagagtaaaaattttgtaaaattttaggaaagtaaacggaggtattatcagagtcatatggtatctattgtcttaatgttttatcatactttcatattaatttaaattatggtatcatatttcatcatgctaagatgtaaccaattgtaattatgcaaatattttatgtaccactaagaaaagaaaaaaactgtcaaataaaccaacacaatatttttatctctttgtgttttaacttttcaagtggtcttttgaacttttttagacaagcatattaattatatataatttttgtgaataaacaaaagaaaatgtaagagaaataaattggtttacagattctcaaaacttagtaaagttgttctagttctttcaagtcaaagttaatatatctaactcatttctttcaatgattgccccttgt

SEQ ID NO: 169942 - DNA, 172 bp, Homo sapiens
tacacagaaacataagtgaaggaggagaaaaccacacaatgatctgatagggcagtatttttgatactataaagatgaattaatagaaatgtaaaattaataaatatatgtacagaatacaagccaggttttttattattatatattgcaacagacataaaatcactctgag

SEQ ID NO: 169943 - DNA, 457 bp, Homo sapiens
ttacaagcgtggaccaccacacctggctcattgattcatttattcatctgataggtatttattgaacataaagtgccacagaccgggtggcttaaatgacagagatttattttctaacagttctggaagccggaagtctgagatcaaggtgccggcaggactgcttcctccaagccctctctttttggcttgtaagagctgtcttctctctgtgtcctcacaaggtcgccctccgtgcgtgtctgtgtcctcatctcctcttattacggagacaccagtcctactggattagctcccatgctggtgacctcattctaccttaattacctccataaatgccctatctccaaacacagtcacattatgacatcctgggggttggacttcgacgtgtgagtttggggggatgcaacccagcccacaataaacagcaaatacgattagagcttctcacaga

SEQ ID NO: 169944 - DNA, 359 bp, Homo sapiens
tgaggaattacaaggattagataataggtctgggttaaaaatttaaatgactatttccaaattttcacaaaatataagtggatattcctgtattggactttgctaaatggcatataaattgcctctaccacacttagcagattgtttggattgtatatagaagtaaatgtttaaaaaaatgtaaactcataaggacatttatggactctgaatacacaaattatgtctgtcttcatgtatatgtgtatatatatctgaaataagtttcatagaacaatagttaccctccttaatgtggtggatattaatatttctgtggtattttcatttcttaaaaatattgatcacaactctgaatt

SEQ ID NO: 169945 - DNA, 571 bp, Homo sapiens
ggtgatacatgtgtttaaaggtcagttatcaagtcctgtgttctggaggtgggggcagcaaggcagttgaaacccaggaaaagaataattgactacattactcttttctagtcaacataatcaaggaaaaacagactctgatgagaccagtactgatgcagggaggctcccaaagagacattcattctgtccagaggaaatacctttgctaaagatattgagcctttatggtaggaggaggatataactgattatatataggtaaagatctagcttaacagacttgggatacttaaggcaaaggaggaacatcccagacactaacattcttcctatgtaaaacctaccttaaaactgctcctggtaagcttgcaatcactagctcatttattccttcaggtttaatgtattctttctatcctaattgtgaccatgaattaccctctgcctctttggtaccttgactttaatcaaagtatttttcaaaatatcacttgacttaaccttctcatcattgtaggttaacactgaccacatgtaagttaaaattaagtttatcaacatgtctcga

SEQ ID NO: 169946 - DNA, 225 bp, Homo sapiens
gaaggttaggagagcctgcgtggggtttgggccatcaggggccctgccttggcttttgttcctctgttctgtgcatctcttaccaccgtcttcattccccctgtgtcttttccttaccttggagctctgttctctctgatctgtgatattgagtttgtctgcctcttacctgttctaagaggctagaggagacctagacttctgggttcacatttgtccccgccc

SEQ ID NO: 169947 - DNA, 311 bp, Homo sapiens
tttaagatctcaaagaaatgatgtaatgtggtagtaaagagcaccaacttcagaatcagacaccttgggtttaaatttcagctccaccacttactggctaaggaaccttaggcaagttccttaatctgtctgcatgtcaccctcatctggaatgtggaggtggcagcacttgcttcatatagtgtagtaaggacacgagttagtgcaggtaaaaaacattttctaacacacagtcaacactcaaggattagctgctgttgatactggatagaaactactttttcttgtgttctgtttggcttttactgttg

SEQ ID NO: 169948 - DNA, 242 bp, Homo sapiens
gaaaattgttcactgttgatgattaaaataggaaaatacttcccactgatcattttgtttgatcaaaacttaacctcattaacaagaactacttaaatcaaggaatactgaggactttcctgttttcttaacgataaggtaaaaatcttttttccaatgaaatataacaaaacccaggttttcatatttaagataccatcacagtatttgaattctcttcctctctcatcattagtaaataa

SEQ ID NO: 169949 - DNA, 137 bp, Homo sapiens
gttccatgtggttttcagttcaggcagtgttctgagaagcagcagactataactgtatgtgtgtccttgaagccaggtgcagagttcccagctactgcagcttgggatttggtgggaaactactgggataagcttct

SEQ ID NO: 169950 - DNA, 456 bp, Homo sapiens
tatagagatcccgtgatgttatccccaacactctcctttttctttctttttctgaaaggtagggagggataggattaagtaaaaggttatctataaaagctgcgtgcccaagaagtctgcaagcccactgacgtccttggtttcatggtttaaagtgagatgctgcctagtaaaggggtgaatccttttacttgaacatccctagagctcatttaacgagagcccttttattcacttctaaagaaaatacagtggatattcacatcacaaagtcagatttctttttgtttggacatcaataaggacatacactcgctagtttgttttacacatcaggtaaaaagcatttgcttttccgttttcttctggaatggtccttaagtaagcctagtagatgactcctcagtgtttctttaaattcttgttactagtccagaaaggtgttggggataagat

SEQ ID NO: 169951 - DNA, 150 bp, Homo sapiens
ctctgtgtgctgcttacagttcagtggggcttgcccactgagaagagctggtcccctggcaggccatgtctcatgtctgaagatcattctcctgccttccttttgcccaccactctcctttttctttctttttctgaaaggtagggaggg

SEQ ID NO: 169952 - DNA, 277 bp, Homo sapiens
tggtgtgtttttctgatgttctgtcacagccctgcttaggaatgttacgtaattaaatcattaatagggcaaggcctttcttcataactcctctgatttatgtaatatgcggagacaagcagatgcctgtgcaggtttctactgggatgaccagttaattttcagcattcagactcctttatgttcttacgtacatcccttacccatggtagctttggcaattttttttttttttttttttttttttgagacggagctttgctcttgttgcctaggc

SEQ ID NO: 169953 - DNA, 341 bp, Homo sapiens
attgcatgttccttcccatggatagaggaaccctcctattccctggaggaagggttccttatactgtgttttgagcagaacagtcctgtcccactcttgaggtcctaactgcaggatttctagtggtaaaccaatctggactctcctagagaatgacaagaagagaggggcattcgatgactagttactatttctttccctagcataataataactatgagaatacttgctaattttcctaatatggatctgatcatacagatatagatgcaaacgaaagagaaagaaagaacctctatgaatcataatccgagtcaaccaaatacatatctcagtgtaca

SEQ ID NO: 169954 - DNA, 533 bp, Homo sapiens
ccttatttgaacacctttttctttattgaataccaaaccatgttatggtaacttggactttaataaaagggaaatgagtttgaactgaaattaggtatttgtttcatgtgtttgcattaataagcagaaaattaagtgctgtattggtttcatggttttgctgccctcttacatgatgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaattgtgtacctttccaaaacaggttttaatgatgtttaaaagtggtcactgagatagtcttgaggatgtgctatgcagtagccaagccctcttacggtgtgttcctctcttagtgcccctttcctttcctacctgttcttcccttgcagtggtgtattagccttggacattaaaacatttgctttgt

SEQ ID NO: 169955 - DNA, 711 bp, Homo sapiens
catagattaaaagattttattccttatcaaaaactgccagaaacttcattatttaggaactgataatgttgcaaattattttctatgtgaacatatttaaatcacaaatttctttcgtgacttgtttatccagtaattgtaaataaataaagagcactggcatcaaactgatcaaaacagtcttctaactaggaagtcttataaacacaaaattaaaaaaaatcaagggtctctattgatctgtagctaaaatataagttatgatgagcaactcaacctcttgagtggctaaggttttcaaatacgttgttcatataaattcccgggaccaagtaataatttgctcttttaaatttgaacctattttcaacagtgtgagatatacattttatcccctttaaaaaatgtttttccattgccagagttggataaattacattataattagaagtcagtttacaaaaggtttaagtcttccttcccccctaagatgaagcaatggttattctggtttctccccagtacaagtttgtgaagactgatttagaaatcttagagtgttattaatagcaggtaaaattcaactatatcatccccttttaggaaggaaaaggttcaagttctgaaattacacatgccttaggacctcatttttcattgaaagcatgactaaatatggctaatggttacatcaatatttttggagagctt

SEQ ID NO: 169956 - DNA, 383 bp, Homo sapiens
tcctagttaataaaatggatataatcatgttttaccaacctcataagattgcggtgaagattaaatcatttcaatcattgccttgcacataattgcagtacacatcttcattattctgctgtgctccttttcctttgctttcctgataccccagtgcttggcattcccatgatgtacacatggcacttctatagtgtgataaataagtacacaagtagctaagttagtcaggtgagtgagatcttaaggtccatcttaactagttttactggtgaagaaactcaagtctagagaagtcaggtgtgagccagactggaattcaggcttctgattgagccacgtgctttctgcatggccatgtttgtacaaaaccacagcacata

SEQ ID NO: 169957 - DNA, 192 bp, Homo sapiens
gtcacaggatacgagcatgttgtgagcagtgagagctggctggcaggtgtgaggtggccatagtcagcttctcatctcttctctagaagttgcagatctagatggtttcagaatttaaaggtttttcaattttaggaaggtaaaaaggagtctataccatacattgtacaatacagagtattagagagccac

SEQ ID NO: 169958 - DNA, 311 bp, Homo sapiens
gaggatgaaggaggatacactgacatttgtagccctcccagggctttgcatagagaatggccactgtggccatggctaaaatgttgcaaaggagttggtctgtgcaattatcagatcttgcaagtcacaaatccagctatgcatttttttctggacaggaggcagggcttgccagaggagagaaagactctttgcacacagctggagcttttcagggtgaaagcagaaacatgctccattgacagcaaacttataaactgtcatggggtagttttctctctctttcctccctcgacctcagactgattggc

SEQ ID NO: 169959 - DNA, 554 bp, Homo sapiens
tttcagcatttcctatatgcaaaatactggactaaatgctacataaatccaaagatagtaaagaaacatgcattcactaagaagactataataaaaatttaccaatagtggatcaaatcatatgtattatagaacatcttcaataataatggtcccataaatgtggattttagagaaggaaacattaaaatggaaatacaacactttaaatacgtgtaaaatttagaaaatgaatttatatcccttaattgcatcaattccctccactttattaaaatatttacacatgcaactgataaggtaacttatctcaaatgatttaatgtgattgttaataataatcaggaattccaactgactcattaggagctttactttattaagaagttttccatttcctatttatcattataccctttttttctctatttcgtggacaattgcttttgcccttgggaaacttgttcaatctactgtaattatctttatgacacatggcctctttagcaaaaatgaataatagaaacaggcagaaagatacagacagaatgaaa

SEQ ID NO: 169960 - DNA, 110 bp, Homo sapiens
cgggaacaggtgcagcccagcccaggtggggccggctctcccctccgctgtgctggctcagggctgggagtccctggcttccacctcccagggcccgaaggacagcgccg

SEQ ID NO: 169961 - DNA, 310 bp, Homo sapiens
ccatgtggtaaacttttcagtccccacgtatgaatgagaacatgtgatatttgtcattctgtgcttggcttatttcacttaacataatgaacttcacttctatccatgtttctgcaaaagataatacgccaccataatcaagtgaaatttaccccagggatgcaaggatggtttaacatatgcaagttaatatatatgatatatcctatcaacataatgaaggacaaaaaccatataatcattttaacatatccagaaaagcatttgacataattcaatatccttttatgataaaaactctgaaaaaatt

SEQ ID NO: 169962 - DNA, 166 bp, Homo sapiens
tctgcttctgcccatctctactaaaaaatacaaaaatagccagaggtggtggtgggctcctgcctcagcctcccaagtagctgggactacaggcacatgccaccactcatggtttttgtttgtttgtttttttaattttgtagggacagagtctcgctatgttgtt

SEQ ID NO: 169963 - DNA, 378 bp, Homo sapiens
aaaaaatcttgtgctggtttggagcaagcagcaagattgagcacgtcacttagcctctgagagttgcttacaacagagcaccccctgtccatctgcagcggtcaagctatgggcagtcagcactgcatggcctggatgggagagcccaaggggggcagtcccgaagctcacctggaaaatgccacctttgctctgctgcatcctataactcctggggctggcatcctttcctgaaagctgagatttcagaaggctgcagcttaaagggaggaggtagtcagaaaagcaccatcttgcacaaagtcaaactgggtgctggaacgacgctctgccagtagggagacttccaaccactgcatgtctcttcctacagcagcg

SEQ ID NO: 169964 - DNA, 477 bp, Homo sapiens
ccagagtgataaccgtgagagttaccttgcaaagtgcctccgcctgttccttttatttcagagtcggctgctcccacactctgtgtccaagactctcggacgtgaggctgagagcgggagtggcagagccttctttagcttcacctgcagctgccggccacgtgctctgacacctctgaggcctacatctccagatcgcaccttccatgggtccttgctttgtattttcccgcaactggactcatgcctcctttctcattctgcaaacctgccaaggccatgcaggcactctggctctcaaaaccagctgggatgccaggactgaggctcactctgaaccacctgcgtgcccagggctgggcaaagacctggtgcagccaaacctcagaggaggaaaggcaacgttgtgagcaaattagaaaggggtcgggggagaaattcatacacacatacacatatacatgcatacacacatgt

SEQ ID NO: 169965 - DNA, 493 bp, Homo sapiens
ctcctagaggatccccctggtagcgttttctctatttctggtttgggaatttggctctgaggctaaggctgccacgaacctcagcctcatggatgacatatgcatatttcatgctaattctttcttcgttgtatacattttttcttatttatattttttttgagatgaagtctcgctctgtcgcccaggctggagtgcactggcgtgagccactgcaactgggccgtgaataacttttaaaagaacacatcgacagagtacttgaaaaggtgttcaacatcactaacttttatgaaactgcaaataaaactatagtgagatacaactttacacccattagaatggctactgtcagaaaagctttctaatttttaattagaagatacctaaatgcccaacaaaagggaattgactaggtagactgtagtgtagtcatattttggaatgcagactgtcattaataatctttgcaaagagtaatgccttcgaaaga

SEQ ID NO: 169966 - DNA, 381 bp, Homo sapiens
  misc_feature (7)..(7): n is a, c, g, or t
  misc_feature (22)..(22): n is a, c, g, or t
tagcggncccacggcaggtgtntcagactggttgcacccagaatcagcctatgttcacagtatggcatccagtcaccactcacttgatctggttttggttaatactgggaagacaagagacaaaatgttaattattatagacagtatttatcaaacaccaagctctgcctcatgcttagatttttagccagagatttaaaccctggaacttcagattaaaagtctgatgttttattaagtaagttgcccattgcagatcacaaaatagtaataatagttaaatgaatgggatattgaagctttgagagtcccctcaattagctttttgatgttttgtataactaaaagaaaaatttaagcaacagtacaacctgccggtgg

SEQ ID NO: 169967 - DNA, 491 bp, Homo sapiens
atcgagctcggtaccggcttatcagctggcagcagctggcagtagtgatagctgcaacagagactgcatggcctgaaaagcctaaaatatttactctctggccatttacagaaaaaagtatgccaactcctggtctagtccaacctactatcggacacctaaatcatccttatgtctgtgtttgtcaagactggaatgtatctgccaggcgcggtggctcacgcctgtaatcacaacactttgggaggcctagcgggggcagatcacctgaagtcaggagttcgagaccagcctgacaaacatggtgaaaccctgtctctactaaaaatacaaaattagctgggtgtggtggcgcatgcctgcaatcccagccagatgggaacgtggtcatcgcctgcctggtccagggcttcttcccccaggagccactcagtgtgacctggagcgaaagcggacagggcgtgaccgccagaaacttcccaccctgccag

SEQ ID NO: 169968 - DNA, 224 bp, Homo sapiens
tctactttgttccagccatggagtcatactctctttatcttttgactatccaaaggtgttctgttggacgactgatgccttcctccaaggtactttgggctcccaagtgtgcagttgacatttgctgtgccttctccaccaggctttagtttttgatgaatgctgagcttcagtggagatttgctagccttgggctttctgtgttcttgaatctctcagagtcc

SEQ ID NO: 169969 - DNA, 274 bp, Homo sapiens
tgctgggattacaggcgtgagccactatgccagccaagaatttttaaaaaaggagtttcactcagccgacctcattcctcagcagggcacctgtgtgcagggcaaaactgctcaaccctactcagcagccctgtgaaagctgctgaaaggatgagcagattgaggcctgaactgtatcttggatttagcagcctggaggtcataatggattttgccaagagtgatggggcagaaattggaccagtgtgtgttaaggagctagaagaagtgaaga

SEQ ID NO: 169970 - DNA, 416 bp, Homo sapiens
tactaacattgaatgtgaatggcctaaatgctccacttaaaagatacagaactgcagaatggataagaactcatcaaccatctgctgccctcaggagactcacctaacacataaagactcacgtaaacttaaaggggtggaaaaaggcatgtcatgcaaatgacaccataaacaagcaggggtagctattcttgtatcagacaaaaactttaaagcaacagcagttaaaagagacaaagagggacattatataatggtaataaggccttgtcacaggataatatcacaatcctaaacatatatgaacctaacactggagcttccaaatttataaaacaattactaacagacctaagaaacgagacaatccagcagcccaggaggtcgacgcggccgcgaatttagtagtagtagcc

SEQ ID NO: 169971 - DNA, 366 bp, Homo sapiens
tttggtagtgctttcacaaagtgttttagaaatacaaaagattaatataggaccacttgataattgttacatgcccacagctcactggactttttaaagcacacaccttcctacagacagtagacgtggcatgtaccagacagctgtcaagggctccttatcctttcctaacctcaggagtaagatttgtgatgacagaatcatcatgaatggtgattccaaatgaagtcacatgctgaggtaccaggtccacgtgaattccgggaggaatactatttatcccaatgcagttaggtactgtccctgagcttccagatggacccatcctccctggaggccttcagagctcccatcactgtggctcag

SEQ ID NO: 169972 - DNA, 679 bp, Homo sapiens
tcaagaccagcctggccaacatgatgaaaccccatctctaccaaaaacacaaaaattagccaggcttggtggtgcacacctgtaaccccagctactcgggaggctgaagcagagaattgcttgaacccgggaggcggaggttgcagtgagccaaagttgcaccactgcactccagcctgggcaacagagcgagactccatctcaaaaaaaaaaaaaaattatctgggagtagtggcatgctacttgggaggctgagaggggaggatggcttgagtctaggagtttgagactgcagtgagccatgatcgtgccactgtattctagcctgggtgacagagaccttgtctcttaaaaaaaaaaaaaagaatatgcttttcatagatatcttcctggctggctcccactcttcactcaggtgtccactccaatgtcaccccttcaaagaggccttcccggccgggcgtggtaactcgcacctgtaatcccagcactttgggaggccgaggcaggcagatcatttgaggtcagaagttcgagcccagcttgtccaacagggaaacctcatctcaaaaaaaaaaagaaagaaagaaagaaatccattcaatcagagtggggctttagtgtcaacccatctgtctgcatggggcaggtcacgtggcccttctccccacgtcgacgc

SEQ ID NO: 169973 - DNA, 738 bp, Homo sapiens
gagttgcaaagtattccacgttattaatgtatgatgacttatttaactattgccctattgatggacaatttaagttgtctctaattatatattactttgcagtgtgcactgttcacaatagcaaagacatggaatcagcctaaatgtccatcaatgatagactggataaagaaaatgtgatacatatacatgatgggatgctatgcggccaaaaaaaaaggaatgagatcatgtcctttgtaggaacatgatgcagctggaggtcattatccttagcaaattaaggcaggaacagaaaaacaaataccgcgtgttcacacttaaaagtgggaactaaataatgagacccaatgggcagaaagaggggagcaagagacagtggggactacctgaaggagaagggtaggaagagggagaggatcaggaaaaataactatcaggtactatgcttagtacctggataacaaaataatctaaaccgaacgcctgtgacacgagcttacctatataacaaacttgcactgcacatgtaccccaaacctaaaataaaagtttaacaaaattgcaatatgccattctgtaaatttttttctctaatattatgcttcaaattttatttttaaaattacactaggaatacacaaggaattacgtgaggaatatatgaatatattcttataaaaattgtaaaaatatagaaatgtgtaacaatgagagtaaatgcttatacaggcctta

SEQ ID NO: 169974 - DNA, 230 bp, Homo sapiens
gggggggacccagaattggcaaaggggctcctgggagactcagtaccaaccctgctggctctcttctcgacccatccaccccatctccttagggcaatgagatctgtcctcagcaccacagaaaatccactatctcaaggaacatgacaaaaagtgaggcgtcatttaagaggttttagatgatcagtgtttgatgcctgtttagttgctgtgattgaaatggccaacca

SEQ ID NO: 169975 - DNA, 471 bp, Homo sapiens
ttggatcccgtgcaccgtactttctcaactgtacattttatgaaatctaaatacagatcaagtgcttttgaggagaaatggtctgaaaatggcagtgaggcatgacaaggacaccctgcctacctccaggctgagtgacagtagggatgtggaagagaggcagggaccactttagacagctgcagggcaagttgagtcccaggtttaaagcaagaaggcgtggagaaagaagagacaagggcactggggtggaggttggagtgtcatgtgatgacaggctgtgaattagagggcacagtacaagggtctttgggaggaagtacgggagaagcaggcacatctctttgtctccagtgctgccaaatttcaaaatactggcctgagtttattgcatccattgaatactgtgcagggcatttctgtaaccaggaaactcatttctttcagttttggtaattttctattactttg

SEQ ID NO: 169976 - DNA, 597 bp, Homo sapiens
tggggataaaatccatggtgaacaaaagttgtcttgttgtgcagatataacctctcaggtagcagctctcgggtagcctgaggcaaaacctctctaggtgatgtgttgacctttgatttcttttccagagagaaaatctttcctagatctcctagatctgtttttaggcaaatatggggacctcagagaacctctgcttgcatccactgtttcctgctgtttatcaatcagcataccaaagtgtcatactttggggaattgtttcctgagctgcaacaattgtcatatttgggaatgcgtcacagaattagaaatgatcagacagttttaagaactaagactgatttttatggagccaatgtttacaaagtcctattgggcaaactggtctggtacctgatttataggtttccagtctcacagatgagaaacaaaggtcacttcctggcccaggaaattttgggaacctctagaagagaggaattcatccaaatctctaggaactgtaggtggacagttcttggcttggcttcctagccttgagaaagtgcttcctcagcctcccaaagtgctgggattataggcgtgagcccctgc

SEQ ID NO: 169977 - DNA, 831 bp, Homo sapiens
gctgtttcgcttcctaaatggcccagtctgttgttacaggaggacacccacctctgcccaggaggcccaggctaagagggctgcaggtcacgcatggaaggcccacctgactcagccttaagaggaggaagaagatgaggcttgtcgccctggggacccgcaccacccttgatgacgcccgactggaatccagctcgtgcactccagcctcctcctgcactcggacacctggcactgctctcctggccccaagcttatagggcacagggtgcactgaaggggccccacccagcccctcagagccagcgagactggatgctctgcctctgagccccttcagcccctcagccccactggatccctgtgggaaccacaggcagcccccaccgggtcaccctcccatctctctcctgatgggatcgaccccactcaggctcattcccaagatggtgagattctagaggcctcctgcagggagcagctgtttccccatcaccaccttaacattaaaatgaggctaaatgctctggtttcggggttttctagaaagccaggagactcattttaaaacagcctacaaggccaggtgcagtggctcacttgaggtcaggagttcaagaccagtctggccaacatggtaaaaccttatctctactaaagataacaaaaattagcctggcatggtggcaggcgcctgtagtcccagctacttgggagactgagggtaggagcatcacttgaacttgggaggcagaggctgcagtgagctgagatagtgccatgcaccccagcttgggtgacagagtgagactctatctcaaaaaagaaaaa

SEQ ID NO: 169978 - DNA, 443 bp, Homo sapiens
catctttttataaagaatttatggtggtatctcctctttaccccataatcccctacaattgggcttctttcccactacttttctgattcccctgaaataatgtagttgttgaaccggttgtatcgtaatgtttattccagttctttttcttccttgaccttgagacagtggcatgatgtcataaaagcagtcatctcaccattgcttttactggtggtgtgtacaaatattgaagcatttgaaagagagcaggagtaaatacatgaagatgatggtgttcctatctggtggcctggtttcattttctcgctgtggcatatagaatgtggagtcatttgctcagagtgaaggggcaggagtgggtaagggagcttgaaagagagtggagatttgaaataacctttgtgggtaatggaccagggactccccagaaactcagaaga

SEQ ID NO: 169979 - DNA, 184 bp, Homo sapiens
agagcgtgcagtgtagattccttgcatgtgcagttcacaacagagtttgctctactttgagaatccagtgcagccactgatccgacaggaggcggagctcaggcggtaatgcttgccaggctcccatcactcacctcttgctgtgccgcctagttcccaacaaacaggccacggaccagtagcg

SEQ ID NO: 169980 - DNA, 184 bp, Homo sapiens
agagtggggcttgaggctttttgcaaaaatgttgctgtccagcctagtactgtacctagcttatacttggtaatctttttctcaatcagtctagttaggaggttttcaattttatgaatctttataagaactagctcttacctttattgattttccttacctatttttaaattttaattgatat

SEQ ID NO: 169981 - DNA, 371 bp, Homo sapiens
cttactaaccaacaagacaggtccgtaacaaaatcatagcaaggtatgataggggcggtgatgggggaacagaatctgacagaagaggtgacctagattggcagcgtcagtgaaggcttctgctgaagggcttgaagcttgttctgagccttgaaagaggcagaattagccagacaaggagaatacaagaagttccaatagtaaaaggctggaggtatgagaggagagacttgacaactcagaagagccagcagctccatatccctggctctcactaactggtgaacaaggtgaataagcaggagggctcctcaccagcaaagtctgcttaagttggatgtttttatggtggtaagcgttctggtgagact

SEQ ID NO: 169982 - DNA, 396 bp, Homo sapiens
tattgagtggccatgtgagtggtttgctgcctcctatccgtcaatatccaatgccctgggacagcgggggaagtgggattccagcctttcatttattctttcacctatttgtcctctttactctgtgtacaaaaaagagaggattatactatcatagactgttgtttctaaacagaaactcaggctgggcacagtggaatacgcctgtaatcccagcactttgggaggccgaggcaggcggatcacctgaggtcagcagttcgagaccagcctggccaacatggccaaatcccgtctctactaaaaatagaaaaattagctgggcgtggtggtgtgcatctgtaatcccagctactcagaagtctgatgcaggagaattgctaaaacccaggaggg

SEQ ID NO: 169983 - DNA, 329 bp, Homo sapiens
ttaaaaagggcttcagcaggactctagcgctttttaaagaagaatttggtgtattccactatgtaacgtagtctctgtccaggaaccaggaggatgagtgtcctcagttttcctaatacttggtaacatttaataatagattgagttttgcttttgtttttcatagagactgtatagactctgtacttccatgtaactttctgccttaacctaaaaaggcattccctggaaggagatcttgtaacaggaagaaaaagcgaaaccaggaaaagagccagaaaggatcaacttggagatgggctgtggctaaatagtgggttttcctgaaa

SEQ ID NO: 169984 - DNA, 367 bp, Homo sapiens
aatagaagacttgttttggggagtagcagaaaaaaaagaaagctgaaaagaggaaccatgagatctgagtttgaagggatcctcaagattatcatatccaaggcctgctcctcttattcttacctatttatttccacataaacacagctttccctagtctgcaccaatgttttacatacattttagtggtggttctagattcctaataactttagacacagtaacttcagcatagtagttagaaatagactttggagttagaggcctgggtaaaccacttgctagacattcaactttgggtaagtttatcctttatttcttcatctagaaatgtgggtaatagtatacttacagtcgagggatgaag

SEQ ID NO: 169985 - DNA, 924 bp, Homo sapiens
agttttgaggttgacaactgcaagttgtgtgtagtgccaccgggtcctttgtctcctcctctgtcctgatgccctcagacctcagccaggccagggacgctcagtttgctttgccttctgctttccctcagctgggggatcttgggctggaagtcactctgatgaacatgtggaattcagctctaagtctctcctgagtcctctgttacctcccaggaggcatgatgaggcacagctacccttcacctccatgggtggcatgaagatacttgcaagtatcttttagacgaaaatatataccggtatttactgttacttgaattcctgtttggttcttgcatttcagatcaaaagaaagaagagtttagatagggatttacttgaaaatgtatctgtatctgttccacttttgaaattgtatggcaagaattcagatagcaggcgacacctacactatcattaagggacagatgacgtctttgaaccaggttttaacctgttagctcagacctatatcttcttctcttttggagaaaaaaaaatcagtctttgtgtgtccacactgaattttgctttgaatctggaaagaacacccatgttgcaggcaacttctgttgttctgtctctgagttcccacaaacaagcactaaaatctgcttagccaatagcaagcagcctctaaaatatcaggtcacttggggctctgtttcttatattcttttttgagacagatctcttgaaggctacacgcacaattcaaagaacataaagcctttgatttatttactgccatcagagtggtcctttccctgacttagatgatagagtctcaatagcagatgcgcggcactgtgggcttccactctattgaggccttttctacccactttctctgcttctgtaccgtttctgacacagtggtct

SEQ ID NO: 169986 - DNA, 689 bp, Homo sapiens
tttgtatttttagtaaagacaggggtttcaccatgttggccaggctggtctcaaactcctgacctcaggtgatcttcccaccttggcctcccaaagttctgggattacacacgtgagctatcgcgcctggccattgtgcattttgatatctgtgttataccagctgattttaatgagctgggaaactttccgtgctttattatgcgctgcaacaattcaaacaatgttgaaattatctattccttgaaggttgctgggcccatgaaagtccttgactaacctttcaatgtcttctatgctccctttgtgtatctgccgaggctttcacactaaggcgaagtttcagcatttatgttttacaggaagtcatcagcttcaggtctcccttatctcactgggtctgtcttctcaccctttcttcatcagattttacctctcctgctattctcttcaccccagccccactcttacacacatacacatacatttacatgctcatacccatatgtgcacacacacaggacagttcagtgcttttatgaatacttggctagaaaaactggagccacagtacattagacttacacagtgattcctgtggatagaactgggaccaataagtgaaaacaaagagactttgtctcagtttatgtatgtgttagtccagatgctccaagaagcagacacca

SEQ ID NO: 169987 - DNA, 507 bp, Homo sapiens
cttggaaacttccggaagtcatatcagtgttggggggtagggggcagtgtctgacactacaggcatggaaagcaaagttccccgccctgcatcagagacaaactcaggtgggccaaagcaagttcctgagcacacctgggctgagctgtgctcattcaaatcggtttcttaacagaatctcaagttcatctcaagcttggagcctggtgagcacttcatgaagagcaggttcctgggtcccagccgggtgacagtggccgagggacgtacccgacctccagaagcccgggaagcatgctgttccagagaagtgcacgctgctaacagcccattccagagcgcatggtgcaataattttttgctagctttaaaaagcagcacaagaaagaaattacgcggtttgcaaactgaagtctacatggtggatggagtggccagttacgtgctcagaagaatgcagctgtgggtttctgtttggggtcaagctttgccaaatagtagcactct

SEQ ID NO: 169988 - DNA, 638 bp, Homo sapiens
  misc_feature (410)..(410): n is a, c, g, or t
atgtgctgtaggtgatctagaggttaccgattggcgacatttcaacgtttgttaaaccgatgccatgtgacaggctctgcacttggtgatgggagcacccatgcttccttacagaatcctgatactatggcgaactgcttaacatgcaagaatttgaatctaggctgggtgcaatggctcacacctgtaatcccagcactttgggaggcccaagcgggaggatcacttgaagccaggagttcgagaccagtcaaagcaacatagcaagaacttcgtctctagaaaataaaatacaataaattagccaggtatggtaatgtgcacctgtagtaccagtgctttgggaggccgaggtgggagaattgcttgagcccggaggttcagggctgcagcgagctgtgattgtgccnctggtcagacagtgctgcttgtatttaggacagtgcttctgatcaagccagtgctgcttgtatttaggacagtgcttctcaaactttaatgtggacactaatctcctggggatcttggtaagttacagattctgactctctaggtctagctggggtggggtcccaggtgatacagatactgctggtcccagaccacatgttgagtagctggactgtaggagatactgg

SEQ ID NO: 169989 - DNA, 533 bp, Homo sapiens
agatggagtcttgctctgttgcccaggctggagtgcagtggcatgatctcggctcactgcaaactccacctcccaagttcaagcgattctcctgcctcagcctcccgagtagctgggattacaggtgcccaccaccacacccagctaatttttgtatttttagtagagatggggtttcaccatattggccagactggtctcgaactcctgacctcaggtgatccacccgcctcagcctcccagagtgctgggattataggcgtgagccaccgcgcccggccttgggacaggtctttaaaggaaggaaaccccctgtgcctagaaaggggtggggaccatctgataactgtgtcacctttacactcaaggtgactatacctcccactagcacaagtggtgtaaggtcagagcagaaatcaggcccttgagggccacccccacgggcctgatttggccccccaaccgcctgtgggcataaggctttgtagaaaggcagcacaagaaacagccacatcttgctgtgggctgaggtc

SEQ ID NO: 169990 - DNA, 139 bp, Homo sapiens
gtaggaaagaaatatgatagttcaagttagattactacttctttcagagttttttgacaaatgcaggtacagtgatagtgtcagttcatggtgaatttttgttaaaataaattacaaaaaatttgtgatcctggtatct

SEQ ID NO: 169991 - DNA, 301 bp, Homo sapiens
cacctgtgccctcaaagagttcatggtctagcaggaggtgaaggagaggcagttacgataggcggagaattggctgctgtgggagcacacagaagaggctcctaacacaaaggcgggatggggggaaggcacctagaggaagcactagcaagcctgggtcctgagaggtgaaggcaatgagccaggtgagaagtgaggacttgaaaactcaaggtgcaaatgagcctgaatttggctgtacaacagggggcagggactgcttcaggtcgacgcggccgcgaatttagtagtagtaggcggc

SEQ ID NO: 169992 - DNA, 354 bp, Homo sapiens
cacccacagagacaagccccacaccacacggactcacaaatgcagaagaagagttgaccctgccctcatgtacagatagtatgctggtgtgtagtgagaggcggctagtgttcgccacgcctgttgcatcaataactattccacagaacagcatacatggtcaaggaatatttttaatatttacaatgaggactgagtgtttgctaaatgaagaaatcaaaggagtacattctggagggctggtagactcccagagccagggtttttgagatgagagtgaaaataagcaggctgagagcagaaagaaagaaagttctgcagatagaagttaggatattaccacttcggccccag

SEQ ID NO: 169993 - DNA, 1527 bp, Homo sapiens
atcagcattaagttagcactagtttatagtttccagcatctaattcctctctaccatcacctttaaattaaaacaaacaaacaaaccaagtagtgaaacatttctttttgttttgtttgagacagggtttcaccctgtcgcccaggctgtagtgcagtggtgccatcttggcttactgcagcctccgcctcccaggctgaagcaatgctcccacctcagcctcccaagtagctgagactaccagcacacccaactaatttttttgtattttcagtagacacggggttttgccctgttacccaggctggtctcgaactcctgggctcaagcaggtcccccaccttgtcctcatttctttatattctgtttcaagcacctctcttattctctgtgatttttcagagatgataaacactggtttagcaatcatgtttgttaagttacaggtctatgggataaagcttctgtgaatctggagggttagaacttatttaaaataattgaggtgcttgcttataaatatgggaataaactctttttgaaaaatttaggtatgctattgtttacattttgtagattactcttcttgatagagaagacaaaaagatttttttgcctccatcagaagtcacacctaacatgcagtggtagaacaggaagttgtctctgccataaatatttacctctctaataatttggaatgcttacctccctctctaggtcctgctttccttatgttaagttcttgaagtcaaattaataattagatagctattagtaagcacagtcaatgaaaatggcattaaattgttttttgtgtgaaatttcatctaggttatgatcaaaccctttacccctctagcatatggaatatgactttttagtaaacagaacagtgtccttctgtttgttggacagtgttggataaatcttgacataaacatcctttttatagtctccatgacgacttttaccctaccattatatttattattgccaagattacaatttacctagcactagcatgcttttgcctcttgtttaaaccttcatagccattacttgtaagtcatcacagagtaatttcagaatgacatttgagatgcttaatacaattttcttaactagagagtcctgtttcttaagcctgtcttgaaatttctgggattcaactttgttcttgctgtctatggtaataacactaaaatttaacaattacatagcgctttgtttttcataagcagttcactcttttcctgtttaaatttcatctttacatattatgttaacagtgcacatccttaagtttattcagccagcatccttgtactgttaatgctgctgtttcctgctgttgaaacatgagccctatgaagtaggtagttgtatcttcttttttacaggtgaagaaacagatacagaaaagacacgcagtgaattaactctcagaacttagccttgagcctggatattctgaatttgtatactgggttttttgtttccttgctgtgttatatttaaagtgtg

SEQ ID NO: 169994 - DNA, 1136 bp, Homo sapiens
tgaccctctggagccgctgacggggaaggaaggtaaaaaaggagcgctaaagattggcgggggttgtgggaaagcaagccgagtgtacgggaagggccggctgcggcccgccatgtttgaacctggcaagagcgaaagaagccggttggaatgccttcttcctgcccaaactaataaaaccgcatgcctaccttttgcttagtattggctagggatgactaatcataacatttgtaagtacttacggggtttcctccatggagacacagaagtctgggacgtttctagaagcctgtggcaaatttgaaaagcaagatacaaaatagcgtatggagtctgattatcgctatgtcaataaattttcttaaaggacaaagcactgaaataaaatggaaataataattcttttaaaaaatttttaaattatttttatagagatgggggttttgccatgttgcccaagcaggtctccaactcctggactcaagcgatccccccacccccagccccgtctccgcctcccaaagtgttaggatcacaggcgtgagccaatgcgacccgtctggaaagaattctaaaacatggcctgcttggccaccgcccaggatctgcaagctgcgcgcccacaagtttcggcacccatttggactttcacaatcggagatggcagtggtgaaggcatcaacatcaaaagctaccaggccttggtattctcatccagtatatgcaagatactggcaacattatcatcaagcaatggcttggatgcaaagccaccacaatgcctacaggaaggcggcggaatcctgtttcagtcttccatggttcttccttcctgcgcttcttccccaaagctcttacgataaccaggctgcgtatcctcagtccttctatgaccatcatgtggcctagcaggactccccctgcagttcttcacatttcagagggtctgggcaacatccacatggcagcagtaggatccaggcatccacaagagaagaccaagccttatccaaggaggaagagatggagaccgagtcagatgcagaggtagcatgtgacctgagcaatatggaaatcaccgaagagctccgccagtactttgcagagacagagaggcacagagaagaactact

SEQ ID NO: 169995 - DNA, 165 bp, Homo sapiens
agatgtgctgcaggagacagccagcctccggcatggagcacagccgcaggcgggaggccgtatggttgttccctgaagttccatgtgtgtggaggagatctgctggccgagtggcctctgatggcgctctggcttaggacactcagcctccctccctcgtcacag

SEQ ID NO: 169996 - DNA, 482 bp, Homo sapiens
aaaggacaggagcaagggggaggaaggcagaacagataaatagttgaagaggctcccagacaggtcttccccccaatacagccagacccacggaagcttccaccagcccagacaggctttgcccttgtgctgtcgtgcaagaggagctctggggcctgactgctgctgcgtgggggaagagccagctgtctgggggctctcacaagtacagttctgcttcctctggcttcccactgttgggactcagaaaagagtactctaaaatgaaagcctcagaagttaaaagtttttctctgcatacctgccctcctttctctcaggcgcgttctcccctagtctagccttagaaactagaatccctcttccccatagaaaccagaacctcttttccccaaagccagccataaatcctaaaaatattactcttattttccctctgcctttctgtgtaaaaactggccataaagaaatgatccgactta

SEQ ID NO: 169997 - DNA, 903 bp, Homo sapiens
gtagttatgaagttctgatgagttatgaatgatgttttgaaaataaagtgattacagaaaatttttaaatgtatgcagtgagttataaatattatagtgacttaatatccaccccatcattcatttcaaaaatacttaagcctttgaccagttgaaaattttgcattgattatttttctccctgaaaatatttttatttcacttctaccacaggattctatcataattgaatatgctctatccttcaaagttttttactgatcagactgtatcattagggtcctaagaagcaaattttcttctggattgaactgttactattattagcaatacacagtttaatcaatgtgtttcacaaaatctgataaggaattgtaggcaaaaaaaaaaaaaagttacaagaaatgcatctcttaaataagttatctctgttggtgtcctaaggtttattacacctttctacctcagcagggcagcacaatgtagtaagatttaggatgtgccaggggggagaggagccattatgaaatgccaggtgggcctggactgcaggagtcctcagacagatcacttttagaagagttgggatctgaaaactgaatcccttgaaactcctcatgaccacgtgtccatattctcagggatacgcatgcctccatttgaagattgtttttacagaaataattggggtaaggaaaggagacaaggatgctagggattgagtctggaaagataggcaagaaccagatgacagcagggtcttgggggacacataaggattttagaatttatcccaaaggacagggaagctactgagattttaaggagaggagtgacatgcttatatttgatctttttaaaagttgttcaggcattgtggagagtatattttaaacagtttgg

SEQ ID NO: 169998 - DNA, 336 bp, Homo sapiens
agagatgatttaaagtataagggaggattacataacttatatgaaaatattatgccattttacggaaggaatttcagcatcctccaattttggtattcatgggggtcctggaactaatcccctgtggatcccaagggacaactgtatataggaagaaatttattatgagaaattggttcatgctattataaagacagaaaagtcccaagatctgccagcagtgaactggcaacccaggaaagctagtggttttgaggaaagctaaattcagttcgaggacagagaacctgggagagctgttcgtataaatcgcagtgtgtggcaggagaagaagag

SEQ ID NO: 169999 - DNA, 168 bp, Homo sapiens
gggattggtctaggtggccagaccggcctgagccacatggctgatatgccctcaggtcatgcttcggaatggtgtcactatccagtctgtcaccaagaggctagctgtgggattggatgtagaatttcaagctctcttcttagaggccccaaagacaagcatataggg

SEQ ID NO: 170000 - DNA, 186 bp, Homo sapiens
cctggggcagaggtggatcctgatttggaagagaaagaagttcatctcacccgccagaagcagtctcactgtgggaggtgataactacagtctctcctgggcatcccatcagggcctccctgagacccttggcccctgaattaatttgcattttcttgatttttaatgaagttgaaaatcgtttca

SEQ ID NO: 170001 - DNA, 146 bp, Homo sapiens
gtgagtcgaatcggggagatggacacatgggtgcttgttttattattttatgtgggaaatattcccattaaaaacataaaataaatatgaaaaaggaaaacaagacaaattaggcagtgtaagagaatggatggggttcgcgtggg

SEQ ID NO: 170002 - DNA, 236 bp, Homo sapiens
cctcgccagaaattgaacactgctgggtcttaaactacaccccccagaacttcaagaaaataaatttctattgtgtaagccacccagtgtatgatatttatatggcaacctgagccctttactgacataggaaaatctcaaataacgaatgaaatttacctaggtctccaggttgaaacacttcagagttgagaccgatataggaaaatgagggggttgggtgtggtgactcatgt

SEQ ID NO: 170003 - DNA, 456 bp, Homo sapiens
aagagttcaaaatgtataagccaaaagaactgttctttatagattcaaagttcagtaaaaaaaataatgagcataatttgaagttgagttgaatttgagatgccttctgaacattaagggaagatacttagaaagcaactggaaacacaggcccgcagctcagaggagtgagattcaaaattataacttgcatcaggattccccaactcaaatccctacagaggctagacagggcaaaaagaggactgaagaatgaggaagcacccagaggtggcttggtgagaatggtcaaataaagcttgtgggacagtcagtgaccttggtgttttctctatagcaccttctctaaaaatgaaggctttctatatctgcttcctgtgaaggatactgaatttaaaaaaaaactattccatcatatttgtctcttctagtctcagctttatttgcccatagaaa

SEQ ID NO: 170004 - DNA, 478 bp, Homo sapiens
cttgaaaaccactgtcgtagtgcaaactccttcctttagatgagtcttcagcagatatctctatccaaagatgtttctgttctgtttttcaagatgggccttagtagctctgttgggatatttcgttgtgatgcatttgagaaactctctggaattttcaggaattatggttcctaccataagaatataagaatttccaaatatgttccttctcttacgtgaatacatcccttccaagctggtctcccatcacagttccccgtggccctgcccctccttggccgatgccgtctctgaagcccaggtgtgcgtgctgctgctgctttctctcctgcttctgcgtcccgttcctcttcttagtcttgtggcacctggctgagccctgaagaaggcagtggcagctgggcatgataataatctggagtcttctcatcatggcagtctgcccttccctggggactgtagtaaactggctgga

SEQ ID NO: 170005 - DNA, 679 bp, Homo sapiens
gggacacagctgtgtcagctcccccagtcactcatgtcaccagcgggtagaccttgagagaccagtgggttcttctctcactgtccctccagcaagattttaggtgctggaaaggcaagagactgaatcagaaagcccagattcctaacagtctggagcagcctttccaaaggaaacattctcagtatctagtttttaattcttttggctggcaaaaattagatgcaagttcttgtaagacacctccagcccccaccctcagtttagatcgtaccaagatttccttagcatctggtggtgccctttgcccctgagggtttattgggttatagataggtagttatgacaacccgagtaatctggcggcatggggacacccagatgacagggctacactcttgtgccaagtggcaggaggtggtcaccttccaggcacgccgcctaccaccctacctgtgtgcctggattccagcaccatctccacccgtcccagagccaagcggccctcagaagtcacccagattcctgtaaaacagcatcatagttaacagccccaactctggaaccaccctggaagggccagggtcccaactctgcctcccgccccacagcaaaccatgcgtaatggctcctaccttggagcatggagtgtaaatgaattaatagatgggaaggacgt

SEQ ID NO: 170006 - DNA, 348 bp, Homo sapiens
caggtggatcacctgaggtcaggagttcaaaaccagcctggtcagtatggtgaaaccccgtctctaataaaaatacaaaaaaattatcagggtgtggtggcactcgcctgtagtcccagctacttggggggctgaggcaggagaatcacttgaacctgagaggcagaggctgcagtgagctgagatcacaccacagccctccagcctgggtgacagagcaggacccagcttcaaaacaaaaaaaaaacacaaaacaaaaaaaaaaaactgaggtggggtaagggggcttcactcttaagcctggaaagaacatgctctacccagagccgcttccactgaccaaaaata

SEQ ID NO: 170007 - DNA, 440 bp, Homo sapiens
ggctcatacctgtaatcccagcactttgggaggctgaggcaggcagattacctgaggtcgggagttcgagaccaacctgaccaacacggagaaaccctgtctctactaaaaatacaaaattagctggtgtggtggcacgtgcctgtattcccagctactcaggaggctgagacaggagaattgcttgaacccgggaagcggaggttatggtgaaccgagatggtgtcattgcactccagcctgggcaacaagaacaaaactccatctcaaaaaaaaaaaaaaaaaaaaaaaaagtcatacttttgctttgtttgtcatctttaagaagatcatccctatcgaaggtcataaacatattcttaatattttcacgtgtttattttccaaggttaggtcttagaaaattacaaaataaccatttgtaatttcatgttgtgaaa

SEQ ID NO: 170008 - DNA, 373 bp, Homo sapiens
caaaatgatggcctctaaggaggggaactgagtacctgagggaacatgaatggggagcaatttacccttcattctagactagggagaggttggtaacttttctctgtaaagggccagatcgtaaatattttaggctgtgtggaccacgtggtctccgatgcaacgactcaattctgccactgcagtgcaaaagcagcctcggacaatatgtaaatgaggggcatggctgtgtgccaattcagctttacaaactggaatttgaattttctgtgttaggaaatattgttccccctcccccagccatttaaaaaatgctcgtggctgacatggtggctcacacctgtaatcccagtgcttcaggaggttgaggtgg

SEQ ID NO: 170009 - DNA, 223 bp, Homo sapiens
ataccttatcctcccagcctactgttcagtgtttttatgggcacgctcattcctcaacaatactggtcccacagtatttttctctccaatcacaacagagcataccactgctgcctccaggcatggcaacaccatgtctggccaccaacattgccaaattggacaccacttccactctcctcactggaaatagatgctgtagccatttatgccactgctgccg

SEQ ID NO: 170010 - DNA, 360 bp, Homo sapiens
aaccaaaattcaaaccaaatatgtcaggttccagagtgcaaacttttcaccactgtaatataagctgtctgcatatttggcacagttttcaccatttgttaagcatgtggcccaaacaatgcaagaaggatctattgagcaactacactgtgcccccagcattgcagctgagggaggaagggcagcattctgctttctgagcactgtgacttccttgtcaaagcctaacttctaaagagccatttacctaccaaaagattttgctgctgtaaagaaagccattgcctggtacatgaccatagcaagggttagcaaactgtgacccaccaccagtatggcccataagccatacaaatagtc

SEQ ID NO: 170011 - DNA, 224 bp, Homo sapiens
aggttaggtcggcatcattcttcatcagtggactctacaacttaaatcataaagttctgtcagtaaaaaaaaaatctttactatcaatgtaaatatccatcaattatatgcacatacttccattgtaattataaagcagtcacaggatgagatgaaaaacattctaatattttctttttgcattctagtggatcaacttacattaccacctgggacacacacac

SEQ ID NO: 170012 - DNA, 149 bp, Homo sapiens
gtatgtatgagagaaagagaatgcctgtaagtgtttaaatgtatgtacattgatgaaagacaaattggtaagaaggtatcaggaatgattcaagatttctggaatgagtttagatgagaggttgaggctggtatatacattttggagtt

SEQ ID NO: 170013 - DNA, 223 bp, Homo sapiens
actttccttaaatccttctcgattttataaatattcttcaagtatatattggtgcccagcttcagaagataatagtcttgggtaaacatttttcccaatcacagtgacatcccactgactctcctattgcatacatttcataaagtaagatcttgacttgtctatgaggatttccatagctaagaacctagccagaataaaaatgtactgacaccagcttggt

SEQ ID NO: 170014 - DNA, 319 bp, Homo sapiens
gaaaattaagcggctttttgtcgcttacaattcttgcttagtcataagattcaaaatactgtgtagtttataagtacaatgtttggatggtaacttattgcatggtgttctaggaggacattaaatgtttgaatttaatttccacttgcaactcaccttattctgtagtttgagaaggatcagccagcttttactagtcttcatagaattctttgaaactctcttcatattcaaaacaagtccatataacatgtgaatgtgatttaatgtttagtgactacggagatgattaaggttagcagttgtgattgtataatag

SEQ ID NO: 170015 - DNA, 373 bp, Homo sapiens
tgaagaaagagtagaagatagttgggttggggtgggaggaggcagagaaagaagcatgtgtaaaggctcagagatatcaggtgtgcacgtgcctgtagtcctagctactggggagggtgaggtgggaagatcatttgagcccaggagttctgggctttagtgcacaatgctaattgggtgtccacactaaatttggcatcaacatggtgacctcccaggagtgaggaatcaccagtttgcctaaggaggggtgaactggcccagatcagaaatgaagcacttccgtgctggtcagtagagggatcatgcctgtgaacagccattgcactgcagcctgggcgacaagagggaaactccgtctaaaaaaagaaaa

SEQ ID NO: 170016 - DNA, 408 bp, Homo sapiens
agagcaaaaaataaaaagaaaaaaagaaattaaaaaaagaaagaaaaaattttaaaaaattcttttgaaaaataaattacacagtctgtgatactgtgttatagcaacagaaaatgaactaaggcgggttcccagaacctttataatcacatcagcttgttaactgctgttccacttgtaagcagctccccctcaggccagatattactggcataagtggaaaacctaggcacctgaaagtttctgacagcctttcagaaagttccagaaaggagtgcctttgttttcctcactaagtgagagattaaaaaagaaaatcagtaaaagtcacttcccctaatgcctacagttgtcatcctggaatcacacttttattgaatccaattcagcaaacatttatcgaagacc

SEQ ID NO: 170017 - DNA, 405 bp, Homo sapiens
cggcaaggttgctgtgagcaaagagcaagactctgtctcaaaaaaattttaaaaaattcttttgaaaaataaattacacagtctgtgatactgtgttatagcaacagaaaatgaactaaggcgggttcccagaacctttataatcacatcagcttgttaactgctgttccacttgtaagcagctccccctcaggccagatattactggcataagtggaaaacctaggcacctgaaagtttctgacagcctttcagaaagttccagaaaggagtgcctttgttttcctcactaagtgagagattaaaaaagaaaatcagtaaaagtcacttcccctaatgcctacagttgtcatcctggaatcacacttttattgaatccaattcagcaaacatttatcgaagacc

SEQ ID NO: 170018 - DNA, 429 bp, Homo sapiens
cgtgaaggccccagagagggagccaccatccagctgcagaggtggccacatccccaccaggtgagtctaagtgctgctgcaaaccagctccatataccagcacatgtgtctcagaccaaggaagtttatgatgcagggaggagagccaccttaatggaatgagcaacaaggcagctgcagtcacagggtacttttgggggaaataatttacatttaaaaattttaaataagtagattgagtacaaattgagagcaaaggcttctggctgaagagatgagaagcaaagcatggagcaatagaatgacactagatcatttcattctttcccttcagtgcttgttgtttaagagaaggcatgaaaacatatttgatctgaaaaataatgcattaactcattctacagctgagaagtcggcaagtcagggttc

SEQ ID NO: 170019 - DNA, 594 bp, Homo sapiens
cagcagccaatataaacagagaaaatgtatttccatgtatactttaattccaaaagtccaaacatcattactgagaatgctcagtaatttcataacattaaatgttgggtcatttttgtttgctttctgtcttaagacaaatggattctatttggattgcacccaattctgttactttttttaaatatcattaagttgattttgtgtcaacaagatcaaataacttgaaaaacttaccctctacatgaaaaatccccaatgtccttttgtaaacaaaacttggagttactcaagtgcattaactcttctgagaacaaataaaatgagttaagtatatgctgagaatgtcagattggttcatacacttggaaatgaatttaacaagaatcatttgccatctctatgaccatacacatgaaattaattttgcctcagccaaaaatcttgtttgctacaattaaacactgatgatgcaaatctatagtaaacatacatatttccaaatcctcactctttgttgagcaactgagacagatggaaactctcagctgcacaccatttaacaacataaatgtccacactttggacattact

SEQ ID NO: 170020 - DNA, 251 bp, Homo sapiens
ttaaactcaacatgctcaacactcaattcaccctcttcctctccaaacccatttgtcctcccataattcccaactcaactacagatagcatgcgaagactctaacagccccaggctagaagtctccaagtcatctccaaatgccactgccccctcatactgcaactaatcaaatgccaattccttttgatactatgtctcctttagttcaagtcatcattgtctctgatctcaacaacagcaaaagggtct

SEQ ID NO: 170021 - DNA, 596 bp, Homo sapiens
gccagggagaagccagggcgttcaaaggcagagagggagggacaacaggaacaacaagaaggaccccagacggggcaggaggaaggagggttgaattcaccaaggacttgggctccgccgggctgcttgtttctccttcagagagtcagaaaggagagtcagggacactcagcagagaagggctgaggtcctccaggggccttcggtcacgccacagggggagcagtctagacccccagcttcccctttgacagggaaaaagaggcacagggtgggggtcgaaggtggatgcactcgtgaccgagagtgcggggccaggtgtcggcagcccgtgttcagttcccgggtctatacacactgataacaaagttgagccgtgtgttatccggagccctggacaacacacagctcatgtggtcacagtcctgcatttgaggggactcggggggacccaccagcaccatgcacacgatggctttacgccctctcttcagcagcactcacctggtggggcatttgtctagtctacagctggtgcaaacaacacactccgtggtacctggggcgcctgggcccaggcctttaagtgcctgagc

SEQ ID NO: 170022 - DNA, 588 bp, Homo sapiens
gtattttgtgccaaataaagtactgatttctaaaactatcttttgaatacaattctggaagttttctgctatatcttatgtgcaataggttacatgtcgctaatttgtatcaattacatttggagttcttaaaaacaatgtggtattcaaagtagtcatagaagatattttgtgccttcatggcacttttttctgtcatataacgttgtaattttttggtaagacacatgaaaatttaagttgctttcacctttactgttttctcagagcttggtttctcatttttatgttatagattattttaaaattagatatgaaattcatagaaagtcataaaattgtgactagccatgaaaaagaattgtgcatgagcaaatatttccaagttgacacatcatgggtattcagagaccttcctctgcacaactgttacctatcctcctatgtaattctattaaaagagagtaattccttagtcacaaacctagttcctccctctcctcccacttctgccttggaacacgataaggcattactaagttgaacatcttggggggtccataattaaagattcaacatgtgcacata

SEQ ID NO: 170023 - DNA, 475 bp, Homo sapiens
attttcttaatggtatcttttgaagagaaaatggttttaattttgacaagtccagtttatcatcttttcttctttgtagttgtgtacttttgctgctgtattttaggaaatctttgcaaaatcaataatatgttctcctaagtttacttctaagaccagcactattcaatagaaataatatgtgagccacatatgtaattttaaaaatttttggtcaggcagggctgcacgcctgtaatcccagcactctgggaggctgaatagcttgaggcagataacttgaggccaggagttcgagaccagcctggccaacatggcgaaacctcgtctctactaaaaagtaataaaaaaaattagctgagtttgctggtgcacaactgtaatcccagctacttgggaggttgaagcacgagaatcgtttgaacttgggaggcagaggttgcagtgagccaagatcatgccacttgcattctag

SEQ ID NO: 170024 - DNA, 378 bp, Homo sapiens
atgcgcggtgactctaaggatcccattcactcagctgctgcctgtctcactaacttctctgcaaccttggagttttcagagggaacaccctcatcatcctgtgaccagatagacaaacctgcctgtatctgctcccgtttactcctcttcccttctgttgtcccacttctatcttttgccacatgcatctctcctttttatggataatcagtaaaatgagtaagattctctccagaagcctcatctttaaacaaaacacaccacactgaccttaccttcctagtaactaccacctctgccaggtctcccagctctctcatctgtccttctacattgttttctacttgctcccccatctgatctgttctccatatagca

SEQ ID NO: 170025 - DNA, 716 bp, Homo sapiens
tatcataaaggtgaaaagagcccagcagtaagctgtattagtccattctcacactgctataaagaaacagcctgagactgggtactttataaacaaaagaggtttaattgacttccagtttcacatagctggggagcctcgaaagggaaatttacaatcatcgcagaaggtgaaggggaagcaaggcacatgttacatggcagcaggagggaaagagagaagggggaagtgcgagacacttaccaaacaagcagatctcatgagaactcattatcacgagaacagcaagaggggaatcttcccccatgatctaatcacctcccaccagatccctccctcgacaagtggggactacagttcaagatgagatttgggcgggggcacagagccaaaccataaccgtaaccaactctggttgcagggtgaacaccctgaaacagcagtgctcatttattctgagagtggagctcctttttctgaaactcctcagagtgggacccttgcagtggctttgttgtcagcccttctggcagacgggcccctgttggagtttgccttttgttttctatgcagaacacacctctgcttccccacactgtggctacttcctaccttttccttgctcctcaaatctgtcacccctcctgctgcctgtctcactaacttctctgcaaccttggagttttcagagggaacaccctcatcatcctgtgacc

SEQ ID NO: 170026 - DNA, 656 bp, Homo sapiens
tttgagacagagttttgctcttgttgcccaggctggagtgcagtgaggtgatcttagctccctgcaacctccacctccctggttcaagcgattctcctgcctcagccttccaagtagctgggattatagacgcccaccaccatgcctggctaactttttgtatttttagtaaagacagggtttcagcaggttggccaggctggtctcgaactaggtgatccacccgcctcagcctccaaaagtgctgggattacaggcctgagctaccatgcccagcctgcattttatatacagacttacttgttttcacttcatgtattatggagggatttccacgctattatatgaagatattcaataccatttttctgtggctgcacagtatcctatggtattggcaataaagcattatgtatttaattagacacacattgattacattgtttctaatcttttcttattaaaaccacagctgcaattaaaaaaaaatacacctttggttacattttactttcttcctgcttaaattgccttatctgaaaatgaagatactatcagtcccacctcacagagttttttaaagaatgaaatacatgaaaaatatgtaaaattcttagttccagaaaccaggtaaatcctcagcaagtgttagatgt

SEQ ID NO: 170027 - DNA, 669 bp, Homo sapiens
tactgctcaaggtcatggccaaggtctgattgcaaaaattcaaaaagattgcaacctcaggcataaatggattaattagccatggaccaaacccttcatccagataaggggtaacggacagggaccgcaaaaggagtacttaaaacccggaaaactttgtaactgagccccttcagcctcttgctcaggcccactcccaccctgcgtagtgctttctcgctttaacaaatcccagctgtctgcttccttcctgtgtgtcattcgtttgttactttctgggttttgttcaattctttgttcgaaacgctaaggacctgaacaacgcacactcctggccttccctctggtaacaggatgaggggcaggctttgcgtggaagtagcagcaagccctggagcctaaggcttatttgttagccaggagtgatagcccctgtgccacgctgcgtcctgcgttccccgcacttgctgtacaagattttcgaaagctggagtgcggctcttctctatttttcccaggggcaccaggacccctaaaagcgcccgtgtatgtgcctcctatgatagggtagcccaggccctgggataagagtatgtgtggtttcttggcttggtgacactcccaccccctccatgaaccctccctcctttgacggccacgtttgaaata

SEQ ID NO: 170028 - DNA, 533 bp, Homo sapiens
aaagtttatgtcaaaactggctgaggacaaagaatgtgtaaagtcaaaagtgaaagaaaagttaaatatttagtgtataagaagtgtgaaactaaatggcaggaggtcgccaggagctctaacatgaaactggggagtgaggttagtaggcagagtcctgcattcccttccctctttgtcaatcttattggcagtttttcctatcacttccaatagcatttccagggtgggggaaaatcatacaccacacagtaagagtgatattctgtgttaccactggaaaggaaaccactaaagggtgtcggtagaagaactaattctgacctgttactagcttcttctgaggaatggtagaggtattttttttcttctattctattcctactttgtaataaacaaattttttttaacatgagatctttaaactgaaaaattggcagctagatagctgtacgaattttctaattaaaacattatcacatctctattcatcactaaaatcaaagagcaaaaaacaaaacttgtaagattcc

SEQ ID NO: 170029 - DNA, 497 bp, Homo sapiens
ttgactttccactcagattacaggtgtggaacttaggatcagaaaaggggagtgatttctgtaaaggcttgctaagttagcaagacaatatacccacttcaagagcactctcctgtcaacatgtattgaaaatttttaatatagaaggcactacattggcaattttgatgatcaaaagataagtttttctttattgcatgaatgtataatccattagaaaacatatacttgactaaaatttgcaaacatacagcatggggagtgattagcagagagggaaagcaagtatcatgctgtggcaaaacgaggaaggtgagagcatcaggaaggacagccatgagaggtgggcatgtgtggggaggcagcgatgatgtggagagcctgccagagagcatgtgcagcaggcacagtgtgaacagaggctcccaggtggattgtgggagccttagggggaagtttagataagagttctcctgggagaactatcgcactctata

SEQ ID NO: 170030 - DNA, 288 bp, Homo sapiens
ttggtgttctttacaacaacttgtcagtatacttttatggtctgatgttgtataacacaaactatgcattacattgcaacagaaaggatggcacagaaaagattaaaaaactaaagtaacaatgctaaaagttgaatattaaatgttaaccaaaattttatggtgcccttggatctactagtaataaaaaatttgaggcctcaatcaatggctgattttatttcaagtacaggttgaacatcccaaatccaaaatctgaagactccaaaatcatacactttttgagtg

SEQ ID NO: 170031 - DNA, 333 bp, Homo sapiens
agtggggggccacaagggcccacccagtccggctttccagaggcatcccttgagggcggccacatactctcaactccccgccccatgaccaacgggaccctgggaggacgcaagggagcttctaccccattgcagttgcacaaaagaaattgaacacttttgagttgcccttagcaacctaattgcatcagtacattgcacacaggagccaaagtaactgaattttgatgaaaagacggcggtaatttacggcatcacaaaattagttgtcatggcgacgggttaattacatctcaaattaacaatgcaagtgtggtgaaattaaatataaat

SEQ ID NO: 170032 - DNA, 369 bp, Homo sapiens
tcaaaagaaagaaagaaagaaagaaagaggaaagggagcacatgtagacattttgcctgatgatttgcagttattgcagctagatatagaaaaatactgatttacagttttgaaggaaggactgacagagacaaagaaaagcacattactcataataatcctaataacagtagtgagagtttaccctttgaggaattccaggctatgtcaggagaacagtgcatctgtttgggaaccagcatgaaattttggcagctttgggtcaaaagcgactgtgtctaacaaaagcaggaataatgacaattaacaatatgcacagaacactcagctaaacatgttatatgcattcactcatttaatcttgctagg

SEQ ID NO: 170033 - DNA, 411 bp, Homo sapiens
tctcgtattgaactgcggtttgtggcttgggtgactataaggataatggtgacattaatcagagataagggaatcaagctggaggaggatggggtataggaaacaatggagaggtaggaatgagacatcacatttaagtttgggcacagtggctcacgcctgtaatcccagcattttatgaggctgaggcaggagaatcgcttgaacctgggaggcggaggttgcagtgagccaaggctgcaaaattgcactccagcctgggcgacagagcgagactccatctcaaaagaaaaaaaaaaaggaaaaagggaggggaagtgtatttaaagatcccaacctaaaagggtttttccctatggagccaagatggccgaataggaacagctccagtctacagctcccagcatgagc

SEQ ID NO: 170034 - DNA, 589 bp, Homo sapiens
tatccatcatattcatcttcgtgaacgaggccctgtcggtgatcctgcggtccgtgcacagtgccgtcaatcacacgcccacacacctgctgaaggaaatcattctggtggatgacaacagcgacgaagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctgggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggaccccagccatgataggctgctcgttcgtggtcaacaggaagttcttcggtgaaattggtcttctggatcctggcatggatgtata

SEQ ID NO: 170035 - DNA, 478 bp, Homo sapiens
cctcccacaagtgctgggattacagatgtgagccaccacacccagccagtaaattttcctcaacaaaatgtttcacaaatgatctttaccaccagcagggtcaaagcatattttagttcaatgtacaaccagctgaacaatttaataaccgagcacaaagacagcctttggcacaatttttcacaatccctctcaaacttaagagcaactactagttcttcatgggctttatctctgatttactgcctcagaacttcctaaggaggacagagctcaggaatctgtattacaagtttcccaggcaacgaaactggtttcagaaccacagccttaatacatttggtatgtgttggagagcagaaagataagggccatacttcagagctctagtcccataaaaatcccacaggaggagccactgtcacggcttctcctcacatagatgggcttgcacaacttaagagtaccaaggcataca

SEQ ID NO: 170036 - DNA, 181 bp, Homo sapiens
  misc_feature (62)..(62): n is a, c, g, or t
gaatcgggactctgtccccaaggaggatgggaaggaaagcacaagtagtgactgcaagctgnccacgtcagaggagtctcgccttgggagcagttcttttcactatgaggagtgacaagatttcatcacttgaaggaaagcctctgaaggaaagctccttagcaacactttggtgcaatta

SEQ ID NO: 170037 - DNA, 151 bp, Homo sapiens
tatgattagacagttgtggagcttgttggactaggatgtggatatgtgtattcctgttaacacatacatctccctcagttctcagggtaggatcaactcgtttagcaaactacccaggtatcagttttcttcttcctcactccatatgctt

SEQ ID NO: 170038 - DNA, 236 bp, Homo sapiens
tactaccatcaatactgttgttcactttggctgtctgtgcagaataccgtctaactaagcaaggataaaccaagaattagaaaaaaactaaaataactttagtgtgtcttctgcgaaacagagtgtgacattagttctcagattcatgagacatcagaatgtctgatgtgtaatgaaatatgtctgccactacagtgggaaacttatagttactaagtagacttgcaacaaaagca

SEQ ID NO: 170039 - DNA, 210 bp, Homo sapiens
atacaaaacaggactgagagggtcagagaattggatttgagacctaataagcaaatgactaaacctcacttcttccagtgttctacagttccataaatggcacatctccccaaatggtgaaaccagaaccctaggaatcatcctttttttctttcttctttttttttttttttttttttgagacggggttttgctcttgttgcccagact

SEQ ID NO: 170040 - DNA, 901 bp, Homo sapiens
agttcaaagacgttgaatcatgacagaggaatagagaagggccactaagtcttctgagagcagaaggtttaagattagagagaaaaatgcttcccagagggatctcaaattcatgggacaaaattcagaggacaagaatatccatacaggaaggcgcaaagaatgatgaacagaatggccaggcgcggtggctcacgcctgtaatcccagcactttgggaggccaaggcgggcggatcacgaggttaggagaccgagaccatcctggctaacacggtgaaaccccgtctctactaaaaatacaaaaaattagctgggcatggtggcgggcgcctgtagtcccagctactcaggaggctgaggcagaagaatcacttgaacctgggaggcggaggttgcagtgagctgagatcgcaccactgcactccagcctggcgacagagcgagactctgactcaaaaacaaaacaaaacaaaacaaaagatgaacagaaagatgccgtgaaggccacaaggacaaaatgcacgtaaccaaggccatgtggccaggccacctcgctgaacagctctggcaaccaggtttctaaacagaagaaccttacatttcttttcagacatttccaagggaattctgtcagaagcacgtcagaggtcacattttgtcatgtgaacatttaacagcaatgcatttttgaacaagtgatttttagaacatctttctgctgcttacagaaggctcttcgttattctcactaggtgcttggggtaacagcatagtcacttccacagtggctctttcctctcttataaatcatactaggacatgaaattctacctaagctactaagtaactttcctttgatttctaggtaagaattaaaaggatcacgtagtttttcagag

SEQ ID NO: 170041 - DNA, 380 bp, Homo sapiens
aaaaaagactccatgatttgttgctatttaaatttaagactgtcagaattatatctcagtagagctatgatttcacaaaaattggggggcataactgagctgaacaaagacctaaatggtatttacttagcgtttccctggccccactggacaggcccccctcctcacccctccagtttgcagtcactgcccgcatctaagggaaactttcattttgtcattgtttcgctcttaagtatacactcattttaatagttaaatatcaaacttcatgtgtttatttgatatttcagatcatgaatttttgttatttagagtatatacttgtgctgtgctaaacaaacaataaatagtataaatatcaaagttattaatttgct

SEQ ID NO: 170042 - DNA, 593 bp, Homo sapiens
ttaagactgtattttaaaatattattgatttaacgttggactagagacattaaagcaagtaaacatctttaagaatctgggaaccccttgctccaattaatattttaggcagtggagcttgatttaaaagtgcacgttttcttaacaactaatctagttttcagggctagtattctgttgactggtctgtcttttgggtgctaaataaaaatcggcatctcattgcattttaattgcctcatccgatatagcatattgtaaactggacattttctgaggagaaacaacatgcatttgcccatgcactggtgcatttaaatgtcaagtatgttaaatttattgctttcataaattgtatcgatagtaataaatttgtaatttgaaataaattacaaatataaataatatatttcttaaggtttgtgttacctcatgaattttccccactaatcatattacaagcaaattacttgccaatattaattgtgcctctacttgcaggcaacgttaatagtaaaataatgtaggtgccaacattaaaccttgaagggaaagagtactccctgaaaatggcctctcttttgttatcaggt

SEQ ID NO: 170043 - DNA, 297 bp, Homo sapiens
taagtttcgttactctgaccctacctaatattaaaaagagattaattaaattgttcgcaacaaaaataatatatttcagtgtttgtaacacgtagaagtgaattgtatgacaatagcataaaggctggaagagcagaaattgacatgtatttgcgctgggcagaataatgctcccctctttccccaaaagatatcaagtcctaatccctggagcctgtaaatattactttatatggaaaattgttttatgatgtgattaaattcaggatcttgagatgagggggctatcttggatga

SEQ ID NO: 170044 - DNA, 233 bp, Homo sapiens
gattgtatccgaacaggacactgccaatccttattttattttccagagtcaaggaaacttgtcttaaactaaatatactcctgtaaatattaggatttaaagatgtttgtttctctctgcctagttcctctagaatttgaaaactagttataagtattcttaaaccacaacaatatagttgtgtgcatcagtgcggtaagaatatattttcttgcgtaacagaacacaattgg

SEQ ID NO: 170045 - DNA, 282 bp, Homo sapiens
gcagagccaggattggaatttaggtctcaccatactctgcaacttcttagtttctccaacttgttttcttgtgcagcaaagtaaagaaaggtcatggtgagctggagagaatagggaaagtaaaggacacagcattgattctgaaaaaagtgctgatgctattgggaaaatcagaagagtattagcaggaggggaattaaagaaaacatcatttaaaaaatctcaggccaggcacaatggcacaggcctgtaatcccagcactgctggaggccacggaggct

SEQ ID NO: 170046 - DNA, 572 bp, Homo sapiens
aacaatctcacattcctcccaccctttctggctcaggtaagcttaccttgcaaaaactctacctatgagtatttgccttagaaagagacagagtgaaaggaggatgctctgctaccccacgctgagggcctgggttatttctgttatattggacttccccaaacccctgaagagttcaaatactgtattgtgctgctttaaccgacccctccccttaggtgcttgggatgggtgtgagacctacactgtgagctgcaatgagggagaaagtgggtatggccctttccacagcaccaaggctcttctccacccatctctttcatagtcttagggtgtgacaggatttaggggattaaaaggaaagtccagcaaaggtgcctgcttttccattcctcctcctgtgaggtgtgcaccatgttgggtcttggatgaggactcctcctttacatgcctggattagcaggatccgctcagaagacttaacatgaggggagattttccaaggagaggccaccctgccttccacatgaggagggtgtgccccggcagaggggtctgattcttgtcaggag

SEQ ID NO: 170047 - DNA, 352 bp, Homo sapiens
ctggggcctctcttcaggtctttcatcttccagtgggctatcctgagcatggtcatatgctgatgggtgcattctctgggcatgagcaagggctgcagggcttcttgaagccaaggctcagaacatgcataacatcacttctgccatattccctggtcaaagcaaatcacaagcccaccccagaagtaaaggaggaaatagagaagagaatagagatgcctcctcttgatgggagaagctgcaaataatttgtgatattttttggaacccaccacactaatttcagtgtggtcctcgcaattgcttggctgtctaaaaacatactccagtctagtgtgcatttctgaaaatg

SEQ ID NO: 170048 - DNA, 275 bp, Homo sapiens
tgggtggtttggacagtgagccagtatagtaacatactgtacaggtttatagtctaggagcaataggctataccttacagcctaggtgtgtagtaggttatactgtctaggcttgtgtgaatacactctgatgtttgcacaacaatgaaatcacctaatgacacattcctcaggaggtatacctgttgttaatcaatgacatgactgtatctatttttaatatcaagttaccttaattagaattcactctatctttcagggaactataaagattg

SEQ ID NO: 170049 - DNA, 120 bp, Homo sapiens
ccggtacctctctccacactggcccactggcacggtagctagtttccctgtctattccagttccatatgtcccttcactgtaatttagactaaaacacaagtgtccctgggcaaatatga

SEQ ID NO: 170050 - DNA, 511 bp, Homo sapiens
atcacttgaaactaggaggtagagattgcagtgagccgagattgcaccactgcactccagcctgggtgacaaagcaagactccgtctccaaaaaaaaaaaaaaaaaaaaaagatggaaagatggattaggtctccaaaaaaaaaaaaaaaaaaaagatggaaagatggattagaatcccattccactgtatggctcagtttgcatcactccctgtaaaacaggcataataatgcctacttcataggtttgctgtggggattaagtgaaagaaaataaaagccttggtacacaggaccaaataaataagtctatacatagcagctaggattagtattacaaaggtgttactaggtttttctgcttgccacctgagaaactgagatagaaagaagttaacagacatgcgtgtcccagaagcatgcctaaccatgctgccaaccactccgagaagacatttttttaagcttttaaccttcagagacaagttgtatttaccacttctgagaaaaa

SEQ ID NO: 170051 - DNA, 468 bp, Homo sapiens
tcattgtactatctagaaagaaaatgagatttaaaagtaatgctgaagatgcccacctttacttccctgcttgggttttaaaggagaggtggctttatgtacatatgaccctgctctcctggccacagcccatcagaacagaaatgtaccccaccccacacacctgggccagttatcttctctcctgggaacttggaaatgagacacagaactaagacagtaaaggttaggacagtaaagacaactaagcgttggggctcaaataatgttaattagaggctagaaaaaccaaagccacttaagaaataaatttttagaggagcaagaattaaaaacattgcaaagggactgaagtatgcaaagtaatatggagcagaaatgtgaggaaaaacagacgaaagaccaggcagacccaggtggaaatgtggatgaaagggctgcctgaaagccttcagtcccagtgaaggc

SEQ ID NO: 170052 - DNA, 524 bp, Homo sapiens
cagggtgcaaatgtgctatggagatttcagagcctgggcttcccagaggaggcctttgccccacagaatctttgctccatttctccactttgctgcctctatgaatcaatgattctgtgttgtccatttttcctttgcaatcttttgccatctcttcattaaaaatggtctccatcattctggccaagcacagtgactaacatacaataggtgtgcagtaaatgtctagtggatgaatacccagtgtgaacattaattgagcaccactagctgccaagcagccaagcaccctatatctgggagatgtagaatttaaggctgtgtagtcactgtcctcaagctgctcacagctttgtgtaagacactcaagggaacatgcaaagctcagggcagctcaatttggggcgagggttatggagaaaatacagtctgcatgcttttagtacatgcagttctgcatcttggggtgcagtgctagagtgaatgacacagtagaggtgacaggcttaggatttaaatttgat

SEQ ID NO: 170053 - DNA, 276 bp, Homo sapiens
gcccaccccccacacactgcggacacagggaaggaagccacaggacaagagcttggcaatgccgtgtcctcagggctccggcgcctacccatggatgtagtgctcgccctcccaaggccggtgtcctggtgacgatgccactagtgccaagaatgcttccctcctgcaggccccgctcccttccccattccagcagccacttcccaccctgcatttgttccctcctacctggccctcaccaaggcatccacccaatcctggcggggcctcagcaca

SEQ ID NO: 170054 - DNA, 356 bp, Homo sapiens
caaacgtaaataagaatagctacatcagcataattaatcagtattatggtgaatcacattttaaattaatccaatttcagtcatcagaaaaataaaatacaatgttaggactaggttgaacccaactgaaatagtctacattaatctgtttctgacttacagaaaagataggtcaaatttcatattttgatctaatgagaatacttgtgtagctattatattccttataaattctagataaggtttatttttcccaaacattttattatgaaaaatttcaaactttccaaaaaaagttaaaaactgttcagtgactacccatatacccaacatttagattctataattcttattct

SEQ ID NO: 170055 - DNA, 166 bp, Homo sapiens
gccagagaagagaagtctgagaatagagacctagagctctcaaatatttagaaatcagcttggcagaaggattcacaaaagctgactgagaagcagcagtcagcaagggaggaggcaaaccaagagactagatgtcttgaaagccacatgaagaaagtttatttag

SEQ ID NO: 170056 - DNA, 340 bp, Homo sapiens
tattagatggtaagagaaggcctctctgaggagctgacatttaaactgaggtttgcatgctgagaaagatctgggggaagagtatgctggttagatagaccagtgagtagaaagatcttgtggcaggaatgaatttagcatgattggagtatagaaagaagaccatcatgagttgagcacagtaagttggaggttagagtatgaaatgaaacagaggtggccaggggccagatcatattctccatataaaaaaccttaataaatttaactaaaaaagaatccaccaatcattttgagaagaccagtaagatatgtaaacccttatttgcctgatcaaagt

SEQ ID NO: 170057 - DNA, 399 bp, Homo sapiens
cttatgtttagatacacatggagaaaatgtttaatccacttaattcaatttagtatactttaatgaaattataatgaagatagatgtttctaatataaaatccaaaaactaggcaaggtgcagtggctcacgcctgtaattccagcactttgggaggccaaggtgggaggatcacgaggtcaaaagtttgagaccagcctggccaacatggtgaaaccttgtctctactaaaaatacaaaaaattagctgggcatggtagcgtgcacctgtaatcccagctactcaggaggctgaggcaggagaatcacttgaacccaggaggtggagattgcagtgagccgagattgcaccactgcactctagcctgggtgacagagcgagactccatctcaaaaaaa

SEQ ID NO: 170058 - DNA, 114 bp, Homo sapiens
gaactttgatatatcctaacaccatatgaaaatattaactcgaaatggatcataaataaaaatgttcaatctaaaactaggaaaattctagaagaaaacataaaatacctttga

SEQ ID NO: 170059 - DNA, 200 bp, Homo sapiens
aaacacaaaataaaaacaccccatcagcatcttaaccagcaaaccacagctgttctgagtgcattcagcatccagggttgtcatgtcctcacatgtttctcactcctcctgattcatatgcccagtgattagttaagatataaattcagtggttataacaaagtctccacaatttaaaaatggcttagaccagattaagg

SEQ ID NO: 170060 - DNA, 234 bp, Homo sapiens
tgactagcagcacaattgagctgctaataaaaagcagagtcaactgcttttcattattcacccactcaactctaatggcacttaatactaatgagtaatctagtggcaggtgccaggattgaggctttggttggataattcttctgcccgatagtgaaatgaagtcagagtttctaaatatgcctgacagcctaagggtaggtttgctcataggtagtcatttgctaaatatgt

SEQ ID NO: 170061 - DNA, 1027 bp, Homo sapiens
actcgagtgggtgcgcatgcgcaagaaggtgcctgcgggactggagcagagcgggctgcgagggtcttcccagcgcaggcgggttttccagtgttacttgcggctgggcgtgggggactagctgcctttctggcagcaggcaggaagccgcaaaaagtttctgagcccccgaacctgtagcggacgtggaaaaagaacgcccctcctcaagtgtctggctgaaagatgccacccagggaagggaactcgggctagctaaggaggccattcttgatgttgcttctagatctcatgtcatcaccgagccctcagctgctggtggcagctgctcagcagacccttggcatgggaaagagacggagtccaccccaagccatctgccttcacttagctggagaggtgctggctgtggcccggggactgaagccagctgtgctctatgattgcaactgtgcaggggcatcagagctccagagctatctggaggagctgaaggggcttggcttcctgacttttggacttcacatccttgagattggagaaaacagcctgattgtcagtcctgagcatgtatgtcagcacttggagcaggtgctgcttggtaccatagcctttgtggatgtttccagctgccagcgtcacccttctgtctgctccctggaccagcttcaggacttgaaggccctcgtggtgagatcatcacacatttgcaggggctgcagagggacttatctctagcagtctcctacagcaggtccattcctcagactggaatctgtgtactgtatttgggatcctcctgggctatcctgttccctatacctttcacctgaaccagggagatgacaactgcttagctctgactccactacgagtattcactgcccggatctcatggttgctaggtcaacccccaatcctgctctattcttttagtgtcccagagagtttgttcccaggcctgagggacattctaaacacctgggagaaggacctcagaacccgatttaggactcagaatgacttt

SEQ ID NO: 170062 - DNA, 461 bp, Homo sapiens
agtagctgggattacaggcgtgcaccaccatgcctggctaattttgtatttttttagtagagacagggtttctccatgttggccaggctggtctcgaactccagacctcaggtcatctgcccgccttggcctcccaaagtgctggctgggattacaggcatgagccaccatgccgggcctggtttttgtttttaattctgtttatgtggtgtgtcacatttattgacttgcagatgttaaaccatctctgcatccctggtatgaaacccacttgatcctggtggattatctttttgatatgctgctggattcagttagcaagttttgttgaggacttttgtgtgtatgttcatcagggatatcggtctgtagttttttttgttttatcctttcctggttttggtattgggggatagtggcttcatagaatgactctgaaaggattccctctttctctgtct

SEQ ID NO: 170063 - DNA, 425 bp, Homo sapiens
atgtgagctcgtttttaattcagttgcgtatgtgcattgagcttgccctgatgatgttctcgttggggcatgtcccacagagcagctcaggtcgttttgactctgggtacttctgcttacgctgtagctaagggcagctagaccgttcttgcagagcctaacattttgggtgccattttataatgcctgtggcaatttgcatattgacgtggcctccctgctggaagccagatgtccctgcaagccccaacgtcttcctttcattcaactgcacccaactctggacttgacttggttgattttctttgctaaagttcagagtctttactgtttaaaaatcaggattaaatagatgcatttcagtttcgaaggtattatttgcagtaaaactgccaacataaacattttataagaaagccatgtat

SEQ ID NO: 170064 - DNA, 133 bp, Homo sapiens
ttgcctaggctggtcttgaattcctgggctaagtgattgttctgccttggcctctcaaagtgctgggattacaggcataagtcaccatgccctgcttgccagcaagttttatactgctctttttggtagggaa

SEQ ID NO: 170065 - DNA, 393 bp, Homo sapiens
tctctgatagtgtcttctgtgtttaagatctgaaaaatggagaatgtgtggctctgaattctcctggcacctaattagagcgacacagctcttacggtcttggctgcttccctctcatgcaatgccacagctagaagacagttcaacagaaagggataaaaatcgattccttcaaaactcattatcattatccaaaacagtcaaactgtaagccttggaaccccatgttacttggtttcttactgatttaaggaatgaaactaggaatctcctcttatctgtggaggatacattccaagacccccagtggatgtctgaaacttcagatggtaccaagccctatataccgttttttcctattttttcctatacatacatgcctatgataaaatt

SEQ ID NO: 170066 - DNA, 323 bp, Homo sapiens
actccattcttttgcatgtggaaatccagttgtcctagcaccatttgttgaaaaaactattctttgccctattcaatggacttggcacccttatcaaaaaccaattggccataaatttatgaattttttcctggaatcttaattctgttcctttggtctgtatatgtatctttatgtaataccatactattttaatttctgtagcttagtagtaagctttgaaatcagaaagtatgagtcctttaactttgttctttttccagtttgtttctggatcccttacaattccatatgagtttgaggattggcttttccattactgc

SEQ ID NO: 170067 - DNA, 248 bp, Homo sapiens
cgagctcggtaccggctgagcagctggcagaacaactaagccaagacatgttaaagaagtttgaagagaaacaactgtaaaatttcaagatgggggattgttaaagatagtgaactccaagtttcttttcaaagaatcagtatgtcagtatgttcagctctcttattctttattctccatttttaagtctaacttcctggttctcttgccctccccccttgcctctagtttcagtaaacaactttcct

SEQ ID NO: 170068 - DNA, 441 bp, Homo sapiens
actttgctctttttcaagattgttttggctatttggggtgccttaagattccatatggattttatggtggatatatattttttttaatttctgcaaaaaaccttcctcattttttgtgttccatctgccacaggaccgttgtatatactgtatattcctggtacacttctctcctgtagtcagttgtctcaactcttacttatttctgagagctcagcttaatcatcacttccctaaggaagctgttcctgatccttccctcagacaatgccaggttctcacgttactatgaacctgtccttcatactctttttgtagttgactttacatttgcatactgtatttggtaacttacttagtgtctagatttcctctatatagtatgctccatgaaggtaagacctgtgactatttttgctcattgctatatccctaatgcct

SEQ ID NO: 170069 - DNA, 456 bp, Homo sapiens
tgagacagagtcttgctctgtcacccaggctggagtacagtggcatgatctcggctcactgcagcctctgcctcctgggttcaagctattctcatgcctcagcctccccagtactgagattacaggtgtgcgccaccacacctggctaatttttgtatttttagtagagacgtggtttcaccatattggccaggctggtctcgaactcctgacctcaggtgacctgccggccgcagcctcccaaagtgctgggattacaggcgtgagccactgtgcccaaccagttttgcctttttaaattatagaaacataatgtcaaatatattctctaaaaataaccctattggttaaaaagtaataactgccacatcaaactgtcaaaagcttagaaaggattaggccagcctatctgtttcctcaaaaaaaagaacagacattttagtcgacgcgggaatt

SEQ ID NO: 170070 - DNA, 404 bp, Homo sapiens
agtttcctgataccctatcattaattcagtctgcccttttttcatatcattctactgttttgtctcatcttccttatactttattcagagactgtgttttcatgaagtttgtgaaaaacattttaaaaattgtttaaaatgtactctttgtctatttcttgctattttttctttttgatattctggaatatatccacagacctgtgttggttttattttgtttaattcttgagagggaaacattctgttcaggtctgaaatttgcttttgggtcccttgttgtatacccgaatattgttagaatcagctcttagttcttaagctagatgcagggctgaaccacattgacatctgggattagttgagtggggctggaggggtaggccttaggccctctcagggga

SEQ ID NO: 170071 - DNA, 327 bp, Homo sapiens
gtcacgactgcgggagaaagccaagctcatttgcaatagcagcgtccaccagagcactttgcagagcctgaatgctgtggaaactctgggtctcgttcctgtcactcactcagaaagagccagagtgaaaagatgtgaactgtgcgtcctgcatgtggaaattgcctttcagcagagtccctgcccgtggagtaactcggctttcagggctagatcttaacaggcgccacactggttgtatttggagttggctcttcctttaagtagctgcgggtccccaagtcgatgggtctgcaccgtcatcattgtcacctaagccacctacgg

SEQ ID NO: 170072 - DNA, 490 bp, Homo sapiens
tagattgtcagaaagctaaaggtatgtatttatgaactaaaatgagcagcttcttgagtctcctggggactctgattcagtagatcaccagagtctggtgttctcacactagttggcacatagctgaagctcctattatgtgtgtggatacacagagagctgggattcctggaactttgaggaatatctgtgttaccaacatggcatcattgttgtctggagtgggtcataatttcaactgctgatcttcgtgaatgaatgaagatatttgcagactcacacttgtttatcattttgtgtttaactcatccagtattacatattcattgttattatgttctccaataccttgttaatactaagcattttttccacttgagacaggaccaagtcagacagatggtcttgtctccattttgggagctgggctccagagagaaaagaactccaacttcaaatacctgcataaacagccagtagtctggtttga

SEQ ID NO: 170073 - DNA, 459 bp, Homo sapiens
gcggccgctcccacttcagattggtaacacagatattcctcaaagttccaggaatcccagctctctgtgtatccacacacataataggagcttcagctatgtgccaactagtgtgagaacaccagactctgggattcctggaactttgaggaatatctgtgttaccaacatggcatcattgttgtctggagtgggtcataatttcaactgctgatcttcgtgaatgaatgaagatatttgcagactcacacttgtttatcattttgtgtttaactcatccagtattacatattcattgttattatgttctccaataccttgttaatactaagcattttttccacttgagacaggaccaagtcagacagatggtcttgtctccattttgggagctgggctccagagagaaaagaactccaacttcaaatacctgcataaacagccagtagtctggtttga

SEQ ID NO: 170074 - DNA, 234 bp, Homo sapiens
tctgaggcaggtcccattatatcccccatcgtatagatgaggcaaatggggttcaaaaaagttaagtaatttgctcaaggtggcagagcacggatctgaactcaggactgtctggcttcaaagcaagtgctctcattcactatgcctaacagtgcctgtcatgtggcaggcagtcagtaaattcttttcctcgttccctgagttccttgattacagctcctttagggcaagatc

SEQ ID NO: 170075 - DNA, 221 bp, Homo sapiens
atactttaatatttatatataaatatatatttttttaatcagcttttaaaatatttacaaaaaagcacactggagtctttattggaattacattgaagaaatgtacatcttcaatttggagaaacttatatcaatttcgagaaacttacatcttcaccgtattgggtcttccaatccatgaacatggtatatatctctccatttatttatttaggtcttct

SEQ ID NO: 170076 - DNA, 867 bp, Homo sapiens
  misc_feature (47)..(47): n is a, c, g, or t
  misc_feature (57)..(58): n is a, c, g, or t
  misc_feature (277)..(277): n is a, c, g, or t
  misc_feature (302)..(302): n is a, c, g, or t
  misc_feature (319)..(319): n is a, c, g, or t
  misc_feature (327)..(327): n is a, c, g, or t
  misc_feature (329)..(329): n is a, c, g, or t
  misc_feature (336)..(336): n is a, c, g, or t
  misc_feature (344)..(345): n is a, c, g, or t
  misc_feature (349)..(349): n is a, c, g, or t
  misc_feature (351)..(351): n is a, c, g, or t
  misc_feature (362)..(362): n is a, c, g, or t
gcggagaggatcgtggtactgctatggcggaatcatcggaatccttnaccatggcanncagcccggccagcgtcggcgaggcaatgatcctctcacctccagccctggccgaagctcccgggtactgatgccctcacctccagccctggccgtgaccttccaccatttgaggatgagtccgaggggctcctaggcacagaggggcccctggaggaagaagaggatggagaggagctcattggagatggcatggaaagggactaccgcgccatcccanagctggacgcctatgaggccgaggnactggtctggatgatgnggacgtanangagctgncggccagnncagnanggccgcagcanagcgggccatgcggcaagcgtgaccgcgcacgcctgagcccgggccaccaagcagaccgccacctacacccagacagagacatccctgccaatgagaccagccgatcgaaccgaacgacggacgccagcctcgccccttgctcacagcaaagccgcactggcccacgaaccgccctcccgggagccccccgcggaaagatacccgtaccaactgcggtcgcgcaccccgcagcggctggaatcgggccttcggcaggaaaggccatcttccgccccgcacccccctggggcaccggggttgccgtcccagctcgggcgcgccgcgagcccccagtggcgaggcggcctgtcccgcccaaaactgctctgcaccctcacggacacagcccgcatagtcggcccccgcggagagagcggcctcccccacggtgcgacacctacggcgcgtcgacaaaaataccgaaacccccacaacaccccctgcaccacagtagctccacacgcc

SEQ ID NO: 170077 - DNA, 514 bp, Homo sapiens
gctgatgaaaggcatggatacttaatctagtcacttgctttcttgatgaaagtcttcaacaaatcctgggagctgataaagggccagcaagggcagattctgtcttcttccttgctcacactatgggatctgatgacccacagctttcacttgggcttttggattacttactataagaagttgttccatttaattcttttaagtgatggaaaaaggatatttcacaaagagagccacaggttactggggtgctaggtggaggaagataactttttaagaaaggcagtgtagtgcggaagacaaaacaatgagctgagattgataaccgggttctacgtacttgactttgcactaaccaagtcaggttgaagtgattagctaacctcataggactgcagttttctggaacatcagaaagttagagataatgaatgttaaagttctctcaatcattagatttacaataaggatgagctttagaattacactaaactatgggcccaagtttgtattt

SEQ ID NO: 170078 - DNA, 352 bp, Homo sapiens
gagaatagacacttctttatatgtgcttttttacctactgtacaagcaaagtatgtttgttaaaattttcttttaatatgttgcatatgcaaagtggttttccaaacgctttcactaaactgttcaatgtcaactcctcaatgcccttaggaggagcgtgtgtcagaagttcctgccatttaacaggaaacagtgacccagaaaagctttggcatccctgccaaccccgaattaacagcagagacagcccagaagccacagctcctggctcctaatctctttttctccctaccagacttttggggcccctgaaaaggtgggattgccccatgataaatgttctatagagtca

SEQ ID NO: 170079 - DNA, 598 bp, Homo sapiens
tcatcagctcggacccagttctgcttcttgaaagtggtaagaaacactgggcaggataagttattttccctgttgtatcaggagctcaataaatatttttcagttgtttattgagttgattctcacagcagcgggtttcaccaagccttgaaaacctccattaacaagccaggaactcaagatggagttttctcccactggtctctcctgtagggggcggtgggaagggccgataaatagcactcctctgcccagcctgagctctgtaccaatcgagaatgaagacaaaaggcaagacaaggcagctggagaacaaaatgtcatggttattactaatcatagtgacagtggagcgtgtgggctcgcaaatgctgaaggccaggatgggctgagttgcccactcaggtacaggcagtgctgggctctgcaggaggtggcccctccctgtccttcctgggagagagtggaaaggacgcatgctccctgcaggcacgctggctccccacagaagggactgagttatacttacttgcctatttcatctctcagattcactcatagatacagtcaccaatgcaaggactggggaggagccatt

SEQ ID NO: 170080 - DNA, 140 bp, Homo sapiens
gtgaaaagaacactgagtctggtgacaaacacacaatttatggtttcactttcctcagctctaaaatatggctagacagtacataccttttggatgattgctatcaaaaataaatgaaaatgatgtgtgtatatatataa

SEQ ID NO: 170081 - DNA, 284 bp, Homo sapiens
tgtggggggggggtcctctatcatgtatctagctgattcaaatcatttttttctaaatgataggaacaggtgaaaagtgatatccctgggagtccgagcaagtagggatgcatttcttaaccagcagttctttaagtggaagtctgtgaacctctaaagcagcggagtcatgaaagacatttagaaaaatacagtcacctgggtcctgtccccagaaagtctgatgtcatttttctgggtgtctggcccaggcatcagattttttaaagttccccaggtgattg

SEQ ID NO: 170082 - DNA, 151 bp, Homo sapiens
catatcaggcatttcattaaacccaaaccaactgctgaagtggaagaaagtgacagaagctcaacagctgtgtgcctctgtctgagtgactggcatgactagatatgatgacgtggggactgccaccagaatgccttttggaggagtacca

SEQ ID NO: 170083 - DNA, 414 bp, Homo sapiens
ctttgtattagttttttattgttgccataacagattattatgagttcagcggctaagaaaaacatccatttattatctaacacttctgtgggttagaagtcccacacagatttctccaggctaaaatcaaggtatcagcaaggctgtgtccctgactagggctctaggaaagaatctgcttccaagctcactgacattggcagagtctaattccttgcagttataggactgagattccatttatttgcaggctatcagctgcgggccatcctcaggttccacaggcctctcttcagtccttgcacgtggcttcctccatctcagaaccagcaacagcgcaccaaatccttcttatgcttggaatctctctgattttccgttctgctgcatctccttcctgcctcctcaaatatg

SEQ ID NO: 170084 - DNA, 388 bp, Homo sapiens
acatggtggtaatcccagctacttgggaggctgaggcaggagaatcgcttgaacccgggaggcggaggttgtggtgagctaagattgcgccgttgcactctagcctgggcaacaagagtgagactttgtctcaaaaaaaaaaaaaaaaatgcttagagtcgggtgtcaaatatattagagtttaacttcccactccaccacttactaacagcgtgaccttgggcaagatacttttcctcctctataaaatgagggtgaaaataatttaatctatcacataaagttgtgataaggattgatataatacatgtaaagtggttaaccagtgtctagcacatagtaagtactcaaaacccacgcgtccggttctagatcgcgagcggccgct

SEQ ID NO: 170085 - DNA, 437 bp, Homo sapiens
tgccctcacagagtccttggttcagtcctccttcaccagggacatggggcttcagaaaccaccatcactgatccctgggtacacctccaacatgcagacccctcctggactcagcccgccatgcttgggtcaggtgacctcccacatatatacacacacacgcacacgcatacacacacccctctggagagctggacactgcccaccagttcccattcccgaaacttccatgctggctgtctggacacaacctctgtctgccaggatcccaggcacccaggtcccaagtctgagaagccatgcagaggagctgcccctcctgcactccaggccccatcagttggtcattttctgtgacttcctcggcaactccaggcccctcctctcccatggccacagccacgaccatggcctcccatcaatgagactgtagctgt

SEQ ID NO: 170086 - DNA, 355 bp, Homo sapiens
gttacaggatcttaggggcaggacactgtgggagagagtcgggcagctgaattcccgcaggtgggaatgccagggcccgaggatgttgcccctgtcctgaaggctgtcgcccgatcgctctatccaaggctgccctggggcagcgtcacctgggggtcctgcgggggcttctcagcacagcatccagcactgccacctagtgtgttcccgtcacgtctcctccccccgcctgcaccaggcaccagagacccagatgccaaggcctgtcagcttcctcaatgggaaacttttcttcagtgaacaaagctctgttttatagactttttaaattttcagctcaaaaaccaaagtctgc

SEQ ID NO: 170087 - DNA, 554 bp, Homo sapiens
  misc_feature (120)..(120): n is a, c, g, or t
gggagtcgcggtggctcagggcggttgccctggcactcgaggaggcgaggctacacgttcgaggccaacctggtcaacattgattaaaacaaaaaagaaaaacaacaaacaaaaaaaacntgtgtgtgcgggccgcgcctcgcggccctgaggaagaagagttttctaaagacacactccggtgggggcgcgcgggggccccagtatgggttaggttgaaaccgtgtgtcatagagtctgtgctccctaaggaagaatccgggcgccaaggaaccaggcggctgggagttctctccccacataaaaaaaacgcgccggggggcgacaccaggagcgtgttcgtgagaacaaactcccagaaggggagagttccgggagggcccatagcgggagcttccatataagacgaagggagcccaaagcgaagaacgcccagatattaaaatattaacgccccggcgcgcaggaacagacaacacaacgcacgatacacgataccagacgagactacacacgagcaccacacacacaaataacaacacaagcaaacggcg

SEQ ID NO: 170088 - DNA, 462 bp, Homo sapiens
gggagtcgcggtggctcagggcggttgccctggcactcgaggaggcgaggctacacgttcgaggccaacctggtcaacattgattaaaacaaaaaagaaaaaaaaaaaaaaaaaatttgtgggcggcttgggcctctgaaaaggtttttaaaaccattggtgggggcgagcggggccccatgatgcggctcagggtgaacagtgggcacaactggcgtggttccatagagggagacaccgcgggcacagagacatgagggcgcggggaattttctctacccaattctaaaaaagcggccgcgggcgggcaaaacccgaagcgctttttgtgaacacaaatctcccggagaggtggcagttctagggagaggccctttacgggggactctttctttacaagagaggagagtctcagagggaggagccgaaattatctaaattttagcgcccccgatcgctgga

SEQ ID NO: 170089 - DNA, 185 bp, Homo sapiens
gaggaccagctggaggcaggtggtggcggaaggcagtggaaggagggaggaaagggctcccttctcacgtggcccgggtgccacccccactcttgggggatgttttgtatctttcagttctcagacaccttgcatcagagtcacaagggccgaaggatcctgaggggccgggaaaggcctcccct

SEQ ID NO: 170090 - DNA, 364 bp, Homo sapiens
cagcctccccagtcctattttcgcattcatataactaaactctttttctttcttggtggagttttgaaatttatatttttaattctttgctcccttttttcctcttacaaaatgagtgccaagcagctaagttgtgctgagtggtagagtttgagtcagtcttggctggtaagctgtggggttaggagccgctccctggataccacctctggtgtctttgctatacaaagactttcatttagcctcctttgtatccagcaaaaaaagattcagtacccaaaatggtggtattttggtatagtatgtatcttacaaaacggcaaaagacttcaaaagttcctacaattttatcttgggggtttcc

SEQ ID NO: 170091 - DNA, 269 bp, Homo sapiens
agaagaaagaaattgaacaactttcactgtttgtattatttctctgtatatatgatcacgtttcttctttttgatgtttgtaacgcacttatcattggagacacagtgttagcactttgaaggaaatgtattgtgagattcttagactgcaaaagtgcttccgttttgtagtggtgatggtgtagagccaattacatatagaaccactctttattgcattccacttaacttgtcaccagattaactgatgcccacattcccctgcagaa

SEQ ID NO: 170092 - DNA, 319 bp, Homo sapiens
ggacagccaggcaaggaggtagaataggccttgtctggacagtggtcacctgttaggtccacagcttgtcctccctggcctgaccagccaggtgaggagagatccaaaccatccacctgaaagcattcagggtgcctgatgacaagaccccagccactgtgggctctcatgtcctggtaggaaggtatacctaaagcaggtggacctggtagtggtggacgctgtctgcctccccggggcttgtctgtttatgccagaccgttttcccatttgcttccacctccagctcagagaggaatcaccttcacacctctgctaa

SEQ ID NO: 170093 - DNA, 448 bp, Homo sapiens
tcaatactcaagagtcagctgatcatgtccttagatgcaccagaaatgatggtaaagcttgggagtgcggatacctttgattctaattattagcgaatgcctcagctcagcatcactgggctatatggggcctaaagcagggcagagccaatcaagaacactcaaagacagacagatgcagaactgggaatggacgtgtagggacgggaagctggagaaagatgggagcatgaatatgcatgtaagggtacatagatttggccgggcatggtggctcacacctgtaatcccagcactttgggaggccgaggcaggcagatcacctcaggtcaggaattcgagaccagcctggccaacaaggagacaccccgtctctactaaaaatacaaaattagtcaggcatggtggcgatgcctgtaatcccagctacttgggaggccaaggcagg

SEQ ID NO: 170094 - DNA, 518 bp, Homo sapiens
tgacaaatctttggggcttgggaaagtctactctacatcacttggggcagggcatgacatagcatatatttgggatacacatgcctgacagcccagtcttcatttgaggaatctgggatcaatacatgatccaaatcttggtactgtgggtcttgcatttggatttccatgtggatttcatttcggccagggctggagttactgtccctgttcatgatggtggtgctggtgacctatggggcatcctaacttccttcccaggcagatgtccctgctgcattggccaacatgtggctccaaaactagacttaaaaaagcataaagatgttcccatcattgatggggacaatctgagccatttgtgttttgaaactaattactagcccacctatccaagagctatagtgtgctcctgaatatgtggtcagaatctgttacagttatcacagctacttgtccttttcccttgaacaatgctgtagcaaaggcagaaacacccatcttccaatatgatttcc

SEQ ID NO: 170095 - DNA, 242 bp, Homo sapiens
tctaaactccaatctgattttactgccttgatttttaaaatccttttatagtgtcccagtgtctatagatgatgaatacctgaatgtggcaggagaaaggagtgtaaatggagaggttatatggatttcagaaagatttaggaagtggaatcaacagaccttggtgattgattaaatgtgggttataaaagagatgaatcaagagctgaaatatgctaataccgtgatgcgctttgattacg

SEQ ID NO: 170096 - DNA, 237 bp, Homo sapiens
aatcttttctcattcacttttatagtcttctcacacacacacactctgtctctgtctcaggaaataagaggaaaggaaaggaaaggaaagccagtgtgctttgaaaggaatctcccttgggctcaaaacctcagttctggccataatcccagcactttggaaggcccaggcaggtgtatcacctgaggtcaagagtttgagaccagcctgaccaacatggtgaaatgccgccgtctc

SEQ ID NO: 170097 - DNA, 481 bp, Homo sapiens
tattagccgacgagttgtccgagttacctccttttagaaaataatgctgtgtggttgtgatgtgtatgtgtttttctattttagggtggggtgttggaaagggaggggtggcttgttctgaaagaaagaatcctggttcaggctgttttcatttaaatttatattaggcaagagtaggtaatgttttttatttcaaatgtatctattttctttagccattagggctgccagattttagttagtataaagtaagctaaaattgatgagaatgtagaataataaatgattctactaaacattgtagtaccagagaatcataggtggtgaacaaacctcaattaatttctccagatctccgagctcctacttccttgtattgtttagctcataattttttttttttttttttcgctaaggtgctgtaatttgtgttccagcatgattttattggaaataactcggacaactcgtcggggatcct

SEQ ID NO: 170098 - DNA, 558 bp, Homo sapiens
tcttgattttaaggtggtctgcctttacttcaactgtctgtcattgctggaagcaagagacatcatgcagagtttctataatttttttatacgcaacacttggcatttaataaaaaattataccatgcatattagaagccaggaccaagaaaaacaatataaaacaagaaaggatagaaacagtctcacagtaatctagatattggaatgattagacatggactattaaataactgtaattggccaggtgtggtgagtcatgtctgtaatcctagcactttgggaggccgaggtgggaggatcacttgagctcaggagtttgagaccagcctgggtgacatagcaagacttccctggtctctacttaaccaaaaacaaacaaacaaacaaacaaacaaacaaacaaaagctgggcatggtgttgcatgcctgtagtctagctactacagaggctgagatgggaggaaggataatgtgagcctgggagatcatggctgcagtgagctatggtctaaccactgcattccagcctgggtgacagagtaagaccctctctcc

SEQ ID NO: 170099 - DNA, 178 bp, Homo sapiens
taggaaagttgtagagtttcattaatatgcacatgaacacgatacaagtgcctcccaaggaagtgatcgcctccaacagctgccagagtgagactgcatgaacgaacagacaaatgaaggatgttaagtgatgatattttctacaaaaaaaaaccccaagaattttatatgctgcaat

SEQ ID NO: 170100 - DNA, 269 bp, Homo sapiens
cgctggacttctattgcaaccatacacgtttctactggaaggaacgctgcagggacccaggggggaaaccgaggtccaagacccggccctgggaccagaaccatgcctcctccttacctctagttacctttccaaggctgtgccctggcagcggtgacctagaggagcaatttcaaaaacccaaactcccaacgtcaccttcctttccgcctgacctcactgcagtcgtgtgtactagggcttggccattctagaggatctcagtcctt

SEQ ID NO: 170101 - DNA, 204 bp, Homo sapiens
gttattttcttagttttgataaatataccatggtcatgtaaaatactaacactagtggaatctgggtgaaaggcatataggaactattttgcaactcttctgtaaatctgaaattatgagcaaatgaaaagtttaaaaaagtggacaatgacccaggagttgattttttaaatgaaaagttgtaacacacgcacatgctcatag

SEQ ID NO: 170102 - DNA, 726 bp, Homo sapiens
aggtgggtggatgatacattggtgtttgacacgttaatctctatactttatgtattttgctagtctaacataagcaaatgaatgtttcagttaggtaaccgaaattgaaaacaatataagcttcccatttcgaagaaggatagaatagttcacagtagggtaagccttaactaaaaacaaatagaaaaattaattaattacaaaaatagcaagcagaacttttcagaagtgagctgagaatctgcagtgttccctcaggggcagttactcaatctccacacaggttacaagttgcaaatatggactaggcccagagagaaggtcactgttaggaacaggaaacaagcagagctttttataaccctattgggctggagaaacaaaaatggagcttgagggttttcaaatgcatgtacatttttcaactctgacatttcatggattctaaagctgcacaagatttgaacaaaaactttgtgaaaacagagtgcgtttcttgcatgtatgcactgttcaataaataaatacctgccaagggttggagcaagggaaggtacatgagatcaataaatgagagttgaaagtacttgtaggagtaccagtttgaccttgatcatctcctcaacctctttttccctaggttcacttaaaaatctgaacgtatttagagggtgataaaccaggcttgcaccttgagggaagaccattgctgtggtacagggagaa

SEQ ID NO: 170103 - DNA, 214 bp, Homo sapiens
gtaacatctctcttctgcctccctccaggccccagcagctcgtaatctaggaatacatcaggattttcaaatcatcctatagtaattctaaagaaataaccatatattattatgagtgtttgccaagtataaagcactgttctggataccatgggagacacagaagagacatagcctattacctttttttttcctttttttctttttttttttt

SEQ ID NO: 170104 - DNA, 652 bp, Homo sapiens
ctgtctgcgttcagaggatcccgtctgccacttatccaagattatgagttgtgaccatggatcaaagtacaacatagcatttacttttcagttgcctgggcttattggggctaattttctattctcgttaaggaacatagttggatgaggaattaattagatggaagggagattttgacagctggaatttcatctttgcttttgtttaacatctatcatgggtagtgctcagggaggagcatgtgagggtgagatactaaaaaatatatatatgtatatgtgtgtgtgtatatatacatatatatatacacacacaccagaaaagaagtggaaaatagaaaattcagttatgtcctaagtccttagcattacaggaaaatgacagcataaaacctgaaataaaactacaccaggtacctcaatttgtagaagtcttataagaaaaaaataaataagagactcacttggaggttttatttttaactgtttggcttagtgtacacatctgattcttcatgagacacggatgactaaaattccatctcatctaggaagcctttctcctcctctagtcatatatcatcattccatttatggcactcctatttatggcatggaatcttacatgaaatttcaactaagagcgtgatca

SEQ ID NO: 170105 - DNA, 510 bp, Homo sapiens
ttttgaaatatacaatacattgttgttaactagagtcggccattccgctatcaaacattataacttatacctcctatctaagtgttgtccagagaacaaagtcagagccaatgcaagtctcccacatttagtcttgagacctgagtgttggccccctaaaatcttcaagaaatgaagctagttggctgaaaccaccttataccacaatcaagccctcaaagtcatcaaatagaataaaagaaaaaaaaacccacccaaaggtcaccagcctcaaagattaaaggaatataagcccacaaagatgagaaagaaccagggcaacaagactgacaaatcaaaaagccagagtgccctctgtcttgcaaatgaccacatcacctctccagttctgaaccaggctgagatggctgaaatgaaaaaaaatagaattcagaataggtatagacacaaagatcattgagctacaggtatatgttgaaacctaatctcctggttctgaaccaggctgag

SEQ ID NO: 170106 - DNA, 359 bp, Homo sapiens
tgatgaagaaatgaacctgtaatattagaggcgggaaaggatctcctgttgaaggaaacacagtctccataaaaacaaagtctgaacagagactgcaggtttatccctctaagcctgaaattccggctctaggaatccagcccaaggagataaaccctggttgcaccaccccaaattcatgcctaatatatgctggcacaaaattatatgtactcgcaaaattacgaagagccagtaatagtaaaatggtggttaaaagaaaaccaaggtagattcacttaatagtatttaatattacttaacaacatgggagaagatcatggtacaacattaggcagtaaaagaacagtcaaactatg

SEQ ID NO: 170107 - DNA, 548 bp, Homo sapiens
tgctatggtctgaatttggtggtgtcgccaaaattcacatgtagaaatccttactccaatatgatggaagtgagggctttgggaagtggatggggggagccctcataaatgggattagttcccttataaaagagagctgagagagaccccttctgtgtactaccatgtgagtttagagagagacagcgactgtctgtaaggaagaaggcccttcaatctgctggtgccttcatcttaaacttcccagcctccagaactgtgaggaataaatttctcttgaggagccacccagtctatggtattctgttatagtgaagggagcagagcaaggcagtaacccgacagaaaacagcttgtgttacttaaaaggggacacttccttcagttggcccaaagggtctttctcgaaactgctccagagcctggctgaagcaccctgcagccctgctgtgcagtatccaaagcagcctcttccaggacacacggcccccattcccaactgctccagctagaacagattcctgaccttcccgagcaccaccaataca

SEQ ID NO: 170108 - DNA, 154 bp, Homo sapiens
tggtgatattgccttgatatttcatattaactagggctcccaggtagtaatactgaaaaaaagttcaagaagctccagatgtccaattctccaggccaaaataaaggctggaagtctgtagatgtttaaagggtgtgatgctgaatggaggatc

SEQ ID NO: 170109 - DNA, 378 bp, Homo sapiens
tctaattgtttggtacttctgagataagacccttctgagtattctactgaatgtcctgtatatatttttttttttttgaggagtctctgtcacccaagctagagtgcagtggcatgatctcagctcactgcagtctccatctcctagtctcagcaattctcctgcctcagcctcctgagtagctgggactacaggtgagcaccaccatgcctggctaagtttttgtatttttagtagagacggggtttcaccatgttggccaggctgggtctcgatctcctgacctcaggtgatctgcctgcctcggctccccaaagtgctgggattacaggcgtgagccactgtgcctggccgaatgtcctgtaaatttttccattc

SEQ ID NO: 170110 - DNA, 545 bp, Homo sapiens
tgatgagctcggtacccttccaccagcaaagacaagtcaccactgtgcttgggcatcctgcccaccagccccaccgggcagccagagctccacatggtttccatcatggttacaaaataaacaaatgcaagtcactctgtcccttctgtggccccccacagcccgacatctgcacatctgcgagaacattctctcgtcattagagagatgccacttggggatctcagaagccatgtggggaagacagaaaccttcagctctagttcaggaacattaaacacaccatgctatcccagtttgttcataaaattcttgtgttaatgtcctaggggaaacaaaaaggatagctattttagcagcattctctagtttggttgggattctgtgtggaggagaagagctctgttttccttctggctgcaatgtcttgattctctgggtctttgtggttctccctgcatggccctgccgggctctggtgagggaagataagagtgtgctccaaggctggcgaggctggggttttcgtctgcacctggtgaaag

SEQ ID NO: 170111 - DNA, 520 bp, Homo sapiens
ccttgaggaagctgaaggtcagaaagggagagacgattgcctgaggtcacacagctgatggacagtagagctgggttatgaactcgaatgcatctgagcatacaggtccttctttgttacttgtgacaccttgatccacccaaaggtgccttaatcgggggattccaggcattgggaaggggctgtgggagatgggaggaaggaggattagaggagaaaggaaagggagaaggaaatgaaaaaataaggaggtataagaaaaggagaaaaggaagagaaaaatgaaggataagaaatagaaggagaaagggaggattgagaaagggagaggggagggaaagagaaagaaataagggggatgaaggaaaaggaatataaaagtaaaaccagaaaagatcgaaaagtagatagaagggaaaatagaaaagggaaagaaagtaaagaaaagggaatataaaaatgcaagaagagtaaggaaaaaaaaagagaagggttagatgagagagatagaaatagaaaa

SEQ ID NO: 170112 - DNA, 399 bp, Homo sapiens
atttcctgaatggaataggtggaattagggctaggctgccagagactgtgccaatgagcatcacccgtcatgtgtgagagagcagaagatagcctgtgagccagtgctctagaaaacatcatgtaggaggccggtcacggtggctcacgcctgtaatcccagcactttgggaggccgaggtggatggatcaagagatcgagaccatcctggccaacatggtgaaattccacctctactaaaaatacaaaaattagctgggcgtggtggtgcgcgcctgtagtcctagctgctcgggaggctaaggcaggagaatcacttgaacctgggaggcagaggttgcagtgagccgagattgcaccactgcactccagcctggtgacagagtgagactccgtctc

SEQ ID NO: 170113 - DNA, 213 bp, Homo sapiens
tttgggaggggaggtgaaggtttggattattgagtactttttccttttattttgatgatcctgttgggtttttaagtcaattttagcaatttatattttttcataaaatccattttattttcaaatttattacacattcacagattacattttcttatttttttatgcatatatacacacacacacaccccagttccctgtctatccagttct

SEQ ID NO: 170114 - DNA, 426 bp, Homo sapiens
cagccccacatcatcccattggcatgatggtgttctagagcagaaaaccacaggcctgtggctttccttacacagagttcccatccttcctaacagcttacttaattctcactcagttcatgtgcttagaatttaagttttcttttctccccatgcaagctacacgtgttgcatttacacacagtgaaaggactttatttttcatctgagtaattttactttggcgcattcaggatacgcccatgcaaacaaataaaatgttttgccacccaaaagaacatttttagaaagtgttcaagtgcaagtgtagttggaagaatcttttgtggggagccaaggtggctactgagtgtgcagaaagatttggattgggctcgcaacaacatggaggcacggggcatggtgcaacatgcttagtgacttatt

SEQ ID NO: 170115 - DNA, 207 bp, Homo sapiens
tggcttagaataaatgtctctttctaagtgtttattagagttaagcttgaattagggttggatacatgttatcatgttgttaagcggtaagagtttgtcacaggttaagaatagtctccatgtttgataaagcagctagtcagaaattaatagggaaatctgtggataggttcaaaatggtattgggggcctgggaaatagcagata

SEQ ID NO: 170116 - DNA, 314 bp, Homo sapiens
tggaaatcagactgcatttttaaattcatttgtacatgtaatatgatggcattttaattgtttttctcctaatctaaaggctattagtcattttatggcctgtgtgtcccaattgatgctttattagaattgagaaagtatgttcatttgctgcgtactgatgatcagtatcatgttattaccataccataaccatggtaaacatccctgacactggcaatatgaataggtatgatgtccagaagaaggtactttctttgtagaattttctcaacaattaagatagctgcccctaggtagctactatatgttgt

SEQ ID NO: 170117 - DNA, 473 bp, Homo sapiens
gcgaaggataggcaatgacttggggctcccgtccactcggctttgaggtccccgcggcccgatgacccggcctcggtgacagcagccgcgacggcggcaatctcgacagggagctaggcggctcatggtgggtcagggggcgaccgaggagggaccacgcggcctgtagggggcagcgccgagctcgggaggagacagcagccggcgggtggggtgggtctgggctgccccctccgggagctgccccggggccgcacggcgattgtcatacccggccgcccctgcccgccgtgggcttcctctcggcgccgcgggccttaacggggctctgaggggacgtgacagagctcggcacgcggcagcctctggggagttagggtccggagagacccacgcgtcgccccccgcccgcccggggccgggagatcctcgggagccgcctccgcgtgtccagagagtgtcggggcggccgc

SEQ ID NO: 170118 - DNA, 572 bp, Homo sapiens
ttccaagatacaatgggagtacaggcattgggtaaatactccatttccagaaaggagaactcagccacaacacaggggctacaggccccatgcaagtccgaaacccagcaggacggtcattaaatcttaaagctccaaaataatcttgactctgtgtctcacatccaggccatgctgatggagggggtgggcttccaaggccttgggcagctctgcagggtacatcccctgtggctgctttcatggactgatgtgagtgcctgtggattttccaggtacacagtgcaagctggggtctggaggaggatgaccttcttttcagagctccactaggcagtgccccagtggggactctgtgtgggggctccaaccccacatttcccctttgcactgccctactagatattctccatgaaggctctgcccctgcaggagactcccgcctggacatccaggcctttccatacatcctctgaaatctaggtggaggttcccaagcctcaactctcatcctctttgtacttgcaggcttaacaccacatggaagccaccaaggcttgtggcttgcactc

SEQ ID NO: 170119 - DNA, 242 bp, Homo sapiens
aagaataaagatataaaaagagaccactgaataattatctgaaataagaccaaaatattaagaaaattataaaagctcacaatacatgtaaaagtacaaaatttgcctttcaacattaatggccactaatttcgttttaacaagtagtttttgacattcacacatatgggagccatatttcttgttttgcaatgtgataaactgaagcagtaaaaggctcaatggaataaatatgcaccata

SEQ ID NO: 170120 - DNA, 263 bp, Homo sapiens
tacatgtgtttaagaaaagcacgggccagataaaaatggaggaaattactatatgcttttgaggtgtttatcagaaaaaggaaatagagaaactacaaccttctgcttctgtgttggtaaataaaatggaatgcagcaagagaaaagaaaaatatagaaatgtacatatgaactgagtttaggatagattttttctcttgatgccgaggttaggcatcaaatgagggttcaaagttgactccctctcatctagataactggta

SEQ ID NO: 170121 - DNA, 183 bp, Homo sapiens
ggcacctacatcgtgcgagagcaggtttgtggccagtggtctttgatcatgccccggtgtttagattaggtgtccggcaaacgaacagtgcttggaaaacaagtcctgctgatctcctacctcaaatggaatgtgaggtgacaatagggccagcaagcaaaaatagaaatctgagattgaagt

SEQ ID NO: 170122 - DNA, 500 bp, Homo sapiens
ttgaggcagtagtagctatagttcagttttaacatttgtcgttcactacccaaaggcatatcacttgaaaccataccaataaatactagtctctgagcaaacaaacaataaaaattacttttagctagacttgagcaaagaaaaactcttctggtaagaaggttttaagcatgcatgccattccaattgaattttgttttatttgattcttaccccaggacatctgagttgatctgtgtgcacactgaataaaggcaggggagagggcgtggggaacaaggcacctttctttaaaactgatttattacctaccttcagagatccaccatcataaagaaaggtattcaaatcatattccataaaagactgggtgcattttagtgaatggcttaatttaacaaatgatactaatactactaatacataccctgtcactttctcattgagaattgcttatgtgattaaatggacctatttttgaaattttagatttagtaaaa

SEQ ID NO: 170123 - DNA, 254 bp, Homo sapiens
ttatttcttgtggtacacagatgatggtatatcgacagacttaaaagaattttaatagagttgactttatgtgtctcagtctcaattgtatattaaggctgagggcaaggccaaatttaaaaactaagtcagtttagagacagaatcaaataagtgataatactggtaatgtttagatatgggaaaaatgtaaacatcatggtacttgaatgattcaggaaatagtggtggtttttttttttgttttggtttgg

SEQ ID NO: 170124 - DNA, 418 bp, Homo sapiens
tatgctgaatacttaattttatcacttctccattaactgttataaagacaagactaaacctacagtttgaattcattaaacaatatccaagcaaacagaaaagaagaggaaataggcaagccatgtttttctactagagtgactatacttatccctctttaaaaagaagtgatattttcaatttcagaaatttgattaaaaaactacatctatttttcctaccaaaaatactcaaaaaaccctctgctaattactctcaaaatactgcagatgtattcctttgaaaaaggaaatacaggatgggcacggtggctcatactggtaagcccaacactttgggaggccgaggcaggaagatcacttgaggtcaggagtttgagaccagtctggccaacatggtgaaaccctgtctctactg

SEQ ID NO: 170125 - DNA, 153 bp, Homo sapiens
atgtcagtgtctccctaatctacatctgtgagccctacctccattctgaaatcttaaatctgctctcaaatgcctcaaaaataccttgaataccttaaagatacctcaaactcaatatttacaaagcaaacttattttcatcattcttttcct

SEQ ID NO: 170126 - DNA, 408 bp, Homo sapiens
tgaaaaatactacgtgctgggcatggtggctcacacctgtaatcccagcactttgggaggttggggtgggcagatcaagaggtgaggagttggagaccaggctggccaatatggtgaaaccgcatctctactaaaaatacaaaaattagcgaggcatggtggcacaagcctgtaatacagctacttgggaggctgaggaggaagaattgcctgaacccaggaggcggaggttgcagtgagttgagatcgtgccattgcactccagctctgggtgacagagcaagattccatctcgaaaaaaaatagtacaaaatattttaaaaaataataaaagttgtctattctggctgatcatggtggctcacacacatattcccagtcgacgcggccgcgaatttagtagtagta

SEQ ID NO: 170127 - DNA, 328 bp, Homo sapiens
ggagagcaaaattaggacaaaagaaaggattctgtggagaatgagatgagagccccagaaaaggggagagtggggagatgtgagttcagtcctaagaagagagagaagccccagcaacatgacaggaggttgaaggccgtggagaaagaggtcctgtgggaaagtcctgctggagagaagccaaaggactttccacctccatgtgcaacattcgattaggttgtgtttcatgatataaacttcccctacccaaaacaccttcagcaagccaaactgcaacacccacccccacatcacaatatgaaacttactgttgtccggggttgtt

SEQ ID NO: 170128 - DNA, 618 bp, Homo sapiens
tatcctaagtattttaaattctttgtagctattataaatgggattgctatctatctatctatctatctatctatctatctatctatctatctatgtttgaaacacagtctctctttgtcgcccaggctggagtgcagtggtgtgatcttggctcactgcagcctccatctcctgggttcaagtgattcttgcgcctcagcctcccgagtagctgggaccacaagcgcatgccaccacacctggctaatttttgtatttttagtagaggtggagttttgccatgttggctgggctggtctcgaactctgacctcaagtgatccaccggctcaacctctcaaagtgttgtgattacaggcgtgagccactgctcctggccttacctcaatttatttaacagtcccctcacccaaatgtgaagatgataaacaattctttcctgtctgaattattctttctctcatgctggaattttggaacattttacaacttacatttaagaaggctagtttaaaaagaaacagtggaaatttccaccttttaaaaaaacttaatttctggtctattaactgctttgcaggaagaaagaaatatgaagaagaaccgcagacattctgga

SEQ ID NO: 170129 - DNA, 363 bp, Homo sapiens
tcggtatgagcatgctgtcttacttcattttctgccatgagcaaaactccctgagacctcctagaagctaaacagaaactggtgccatgcttcctgtacagtctgcagaactatgagccaaataaacctattttctttataaattactcagcctcagatattccttcatagcaacacaaatagagtaagacagccattaatatcatgcctatacctgagacagtggtatgcattaaacattacatctgcccctacttttctaggtcattataattttgggggtggggtgggagaagcatatgactagtgctaaccaataggctgtgggtagaagtgatgtgtgtcacttctagactgaagtat

SEQ ID NO: 170130 - DNA, 491 bp, Homo sapiens
cagttcctataaacttgataaattaatgagggaagaagagaagggagaaacaaaatatgcccagcttgcagcccactcggcgttcatcatgaggtcagctgctctctgacgcttcttctgagctgcatagtgcctgttgtgctgtagtcgtgtagaccctgtagtttcccttaactgctctatagatagagtttcatgatgttcaagttacgttttccttttgggagactgcttcaggtcctgtatactgatgcagctactgactcagctggtcttaaggaccccatgaggagctgactcaaaagaacagtttctacatcctgatgatttcatcccccataccccatccaatcaacaaccctaattttccaacccctcaccctccacagtcctcttaaaaaccccagctcagaactcctcagggagatgcatttgagggtctcctcccatctcctcacttgatgcactatgatcattaaactttctctgca

SEQ ID NO: 170131 - DNA, 352 bp, Homo sapiens
catccccatccctgaggccaagcagagaatcaaggctctgcacagccagggctgagtcatgtgctcactgatggaaccaatgagacatcatctccacccaaccttgtggattaaatacagggaggagtggtcccccaagaaaaatggaggtgctgttgccagaagaagagggggtagatgtgggccagaaaaacaacagacaccgtctgctcccacatttcttcaaagctactgccaggtgcttgcctctggcatggaggagcccttcaccctccaagacttcacactggccatttggccactgagggaggcccagaccaagctgacacctttccccagagccagccacatc

SEQ ID NO: 170132 - DNA, 494 bp, Homo sapiens
tttacttccggcagcaggtggtggggccatggtaaggaggcgggtggcgagccttgagggggtgatgctctttggggtcggggtcagggctggggcgggcaggccgacgctcgggtttcggactccgaggatccgtgggaggaagctctggcgtgtgttacagttcgcttttcccgggctttctcttgccctccttgggtcacatgcgcacagtagtagtagctaaaactcgccgagctctcacagtgcattaggtactaagttgaggactctgaaaccatcctctggttcactgtgttctgagtccccattttgaaaggcgaagaaaccgaatctcaggggtgtggagtaatttgctcacaaattactgttggagccagaattggaataagagcttttactgcttcactacccacctagtaatacccttgtgctacgtgttggggcctccctgcctcgctccttctccttctccgctgtttccccttccccag

SEQ ID NO: 170133 - DNA, 402 bp, Homo sapiens
tttctttttctttttctcattgccagtggagggaaatagtcttgggtgtttttgttcttgtttttttcttacagcagcacaaatgaaacaagatagacctttatggagatttaaaggtctaaattacaattaactgaggccataagggtggggccctaatccaataggactggtgtcctcataagaagaagacacagcatacaccagatatcttcctttctctgcacctgcacagaggaaagtctatgtgagaacacagcaagaaggtggctgtctataagctggaagagaggcctcaccaggaaccaaactaatggcacctgatgttggacttccagcctccagaaaataagttgccattgtgtaagtctgttatggcagacctagtagaataatacaccc

SEQ ID NO: 170134 - DNA, 768 bp, Homo sapiens
ctagaagaggttcaatatttgttctcatacacataatttgtctctagcttgggtaagtccctttctctttaggcctgtttcctcatctgtaaaataggggcagtaattatctatctcatgcaccaagacactatgtgcatctatacaactgtgagggcaccatccacgtcaactatgagcaatgcaggactactgtgtgatctatggcctgagaagggaagggtctttattgcactagaaaagtctgtgtaagtacattacatttttagtttgcatgaccttaagccatatactgtcatttgttatgagtttccttatgattaaaattaaggtgttggacttcacgatttcttaaggtcttgttcaattctaatatttaaaagtattacagtttattcacacattcgactaaaattcaagtaggacctaagacaagtgcagaaaattaaaaaatagttgaaatatgttcctttcctttaagagttcccatttgggtggactttatgctaactatataaagtccttctaggtaagacatttcatgctttttaactgtattttcttaggccctgatatgcaagtgcaattatcaaattatagcattgtaaaacattaagctaataagactaaacaattgcaaattttaaatgacatttaaaattaggcaaaatcttatctttagacaaataaaattgcagttgatccttcaacaacataggtaacataggtttgaaatggaggttattggcatgggatcctcgagagtcg

SEQ ID NO: 170135 - DNA, 811 bp, Homo sapiens
ctgcctcagcctcctgagcatctgggactacaggcatacaccaccatgcctggctaattgtgtatttttagcagagacggggtttcaccatattggccatgctggtctcaaactcctgaccttgtgatccactcgcctcggcctcctaaagtgctgggattataggtgtgagccaccacgcctggcccttttttgttttcctttatctgccatctcatctcacctccttgtgtaaacttgttccattctaaaattctggttttctccatatcagaacagtcaaacccccaccagaaagcaccaccccgttagctgggtccatgggattttgctgagcccctgccatgtgccaggcaggtttcaggcccccttggggataaggattgagctgtcgatatgaacgtccggttaatccctgtgcgcccgcctcacgtggcagtggggagaggccctgctgtggggcaccgcatgctgcttccatggtgcattgggttggagggctcttctcccgagggtgggtgtctcccatctcttgccttcacacacctgctgtcttgtttcatttgggactggacagtcccacaggtgacagctgttgggctgttgtatgcctgtttggtgttgcatcaaaggagtgggtttgaatcagcaggtgctctcaaagctgtctcctgggagacacagtactagtgagcatttattgagcacctactgtatgccaggcaccattttctgtggttaaatgcactgcctgtttacacaacagccctctaaaggaggaaaaacatatcagagtcccatggatggaaga

SEQ ID NO: 170136 - DNA, 472 bp, Homo sapiens
agtcctggtcccccactaaaaatacaaacaattagctgacatgatgatgggtgcctgtaatcccagctactcgggaagttgaggtgggaggattgcttgagctcgggagttaaaagctgcagtgagccgagatcactcccctgcactatggcctgggcaacagagcgagaccctgtcttcaaaacaaagccaaaaaaaccgtgtagggtggaaaatgatggcactgttggagcagcaaagatggagtgctgtgggagttcacttctttctcccagagattgcgctaggcaaggtatggtttatgggaagttttaatgcaaaaggtggcagttgtgcagaaagcagaaaagtgggtaaagcttgaatgagtggagatggaggcaagagagacagagaaatagtaaaaatatatattttttatcttttcaaaaacttgttgtacattggaattttccagtcaaaggctgagatt

SEQ ID NO: 170137 - DNA, 403 bp, Homo sapiens
gtcgcagtttctctgtcctgtgaaccatttctgaagtgaaatgttcagaaatgaatagaatctgattacaaaagaagacaatcaacagaaataaaaaggctggatttgggcaaatatgttattcttaccatatgggataccccatgtgtattttatttgcatgctctggaaataaataaccaaggcttgatagtgacatctggaaagatatacgttgaacaccatgactcagcacacacacgtgtttacatgaaaaaaaagtattcatgaaatgtgtcctgtttcattttcatttcaacaaaaattctttttcattttttttttttttgggggggggaaaggaaacggggacccccaggtgacactcagggggcccggggctcagaatccggaactcaggggc

SEQ ID NO: 170138 - DNA, 488 bp, Homo sapiens
tttctaatggaatcttttactatgtctgatagaattccttcatgtatgtattgctttgtttctaaatataagcatgacaggctcagagctgtccgtggtcacgtaggggtttttggaaataattttagcttcgggcatacccctgaacgtgggcagcgcctacacattgtcatctcagccccctcttacccttttgggaagtcctgataccctcatgaggaggttttttttctgcttcattctcaaatcaacgtggggtttccttatacccttggcccaactttaacttacacaattgtaacaggcagcattatattgagaatgcatgttgtagaatattggttctcacctctggccacaaatttattcacttagggaatttaaaaaaaaatccatgtctgagccttgtccctgagattcagatttaatttgcctaagacatcacctctgatcgtggatgggtgtcttaatgtggattccattggggg

SEQ ID NO: 170139 - DNA, 422 bp, Homo sapiens
ttttaagaggaagagacaccagagatctctctgtctccaacatgtgaggacacagcaaggaggcagctgcgtacaaggcaggatgacagccctcaccagaaccaaccacactggcacccagatctcggatttccaacctcaagaactgtgagaaaatgaattcttgttatttaagtcacctagtctgtggtattggttttttggtttgtttttgtttttgagatatgctcttgctttgttgccaggctgaagtggagtggcacaatcatagctcatcgcagcactgtactcctgggcttaggtgatcctccagcctcagcctcctgagtagccgggactacaggcacacgccaccacacttgattagttttttaaagtttttgtagagatgggagtcttgccatgttgcccaggctggtctc

SEQ ID NO: 170140 - DNA, 321 bp, Homo sapiens
ggtgttcctgccctcctccctccccaggagcgcaattcccatgaggagcccggctcctcttccaggagggcccaaacctgaagaaccccagccaggctgctggatgctttgtctcccctccacacacagctgtgagacttgcagaaagcctgacagactcccacctccaacagggttggagcacgtggatctctggcctctgcacccttgggtgggcaaccctggtgacttctcaaagatcacatagcagggtaggatccaagtggcaggaagaacctccatgttctcctttccactccttggctgacagatcagcctgtg

SEQ ID NO: 170141 - DNA, 270 bp, Homo sapiens
agcctgcgtcacaatcacctgaagggcttttataaaagagatttcttagtttttcattcagaggatttgggatagagcctaagaatttggatgtctaacaagttcccaggaaatccatgttggtttgaggatcacactttgagaaccagtgccaccattcaaggcctcgctgagcatctagtacgtgtaagaatccaaactgatcactttctccagctaaaaaacaactttcgtggaaacaaccttactcaacttaactcttactagcat

SEQ ID NO: 170142 - DNA, 241 bp, Homo sapiens
cagctcactaattaaaagactggaattctaaaattatatacatatttaaatattttagcatatatatacattcatatataattaaatatttaattcatatataattaaaatatatatctatttgtatatgatgcatatacatagtatttatgtaatatccattaggtatataaatatatattagacattatatatagtatgtgtttttcctttttttcttggccaacatagtctaatattg

SEQ ID NO: 170143 - DNA, 1690 bp, Homo sapiens
gcgctcggaattgtgggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggcaatcgttctttgttttcgactacacttcacaaaagataatattacaaataatacagctgctgctacagtgcgacaagttgttactgttgtttttgagaggatggttgctgaagatgaacgacacagagatattatagaacaaccagtactggtacaaggaaatagtaacagaagatctgtcagtaccctcaaaccttgtgtctaaagatgtatatatgcttttccaggatctttgtcagttggttaatgctgatgctccttattggctagtgggcatgacagaaatgactcggacgtttggcctcgaattacttgagtcagtcctcaatgattttccgcaggtctttttacaacaccaagaatttagtttcctcctcaaagaaagggtatgtcctcttgtgataaagctcttttctccaaatataaagttcagacaaggttccagcacctcatcttctccagcaccagttgaaaaaccatattttcctatctgcatgcgtttgctgagagtagtatctgttctgattaagcagttttacagtcttttggtaactgaatgtgagatatttctgtcacttctggtgaaatttctggatgcagataaaccacagtggctacgagctgttgcggtggaatcaatacacagattctgtgtgcagcctcaactattaaggtcattttgtcagtcctatgatatgaaacagcattctaccaaggtttttcgtgatattgtaaatgcactgggatcttttatacagtccttgtttcttgtcccccctactggaaatcctgcaacaagcaaccaagctggaaacaataatttaggtggctcagtctcagcaccagctaactc

SEQ ID NO: 170144 - DNA, 1131 bp, Homo sapiens
gcgctcggaattgtgggcgactcggctaatggcgtcggcgagtcttaggggcctggggagctggcgctgaagcttcttgccaggttggctggtgacacccggtgtggctgggccccgcggcagcggagggacctgcccgccttgtgggtttctcggccagagtcggcggagcctagcgggacggtgcgactgcggggggcgcctccgagaaaagccagaggtgttgcggggaagctgctgggggacgctcgagcaggctccgggttcgcagcccagggcccaagaagcgggctgctgaaggaccagagacaccgggagggagctgcctgtggccctaaggagctgaccgtgccagagcttgtttgtacctctcggaaattggctgggaccttggaggatcatgtccggcaccagcagccccgaggcggtgaagaagctgctggagaatatgcagagcgacttgcgcgccttgtcactggagtgcaagaagaaattcccacctgtcaaagaggctgctgaatcaggaataataaaagttaaaacaattgctgcacgaaacactgaaattttggcagcactgaaagagaacagctcagaggttgtacagccttttttaatgggttgtggaaccaaggaaccgaagatcactcagctatgtttggctgctattcagagactcatgtcacatgaagtcgtgtctgagactgcagctggaaatataattaacatgctttggcagctaatggagaatagtcttgaagaacttaagctacttcaaacagttcttgttcttttaacaaccaatacagtagttcatgatgaggcactttctaaggtaggaaaactgtttgccagagttcatatgtgctttgagacagtatttgaataagctggctgaaagagaaaagcttggtgccatttgaaccaaaagcaacttccctacagctatggtgatgattgacattgcatgttaataactgttggtaccttattttttccaggttagagttgaaatcacgttggggtgcttaagcaaagccccttgggtacagccaacaggctgagttgtgaataggaaatggaaaaaagagagaaagtagcccaagagtaagaatagggaaggagggaact

SEQ ID NO: 170145 - DNA, 370 bp, Homo sapiens
gttccccaaatcatttatatccagaggtcaggcatatggagctcattaaattccatacagcaacattgtaaccatgtgaaactttttgtttgcagtgcaatttaatgttgaatttgatttatgaggcactgcacattcttagtcctaggatgacagcatacacttctacaagcttaagtcatggtttggggcaagggggaaggcctttgaccagatgttggaattggaaatctgggcttatgctaagcatttgcgaagaagggagagcaccacatcttagagaaggtctatcccaacttgactgttatatcactgaggaaaccaagacctagagaatttcttttcctttttcttttcttttctctctttt

SEQ ID NO: 170146 - DNA, 850 bp, Homo sapiens
cccagtgtcttggttacccgcccccccggagttatggatatcgtcgatcctgtcgctcgggcatcagcaaggggagtcctactcggtcacaagaacactcagatggagatgattcacagtggggcttcaggtccagcctgactagggctcagaagacatgggtttgtcgattttaagcatatctttgcccctggagccaggcttatggctgactgcctgcaatccccaggactctctttccaaatcccctgctcaattcctaaccctgccctccttaaatcctttctattgttactcacttcaagctctcatttctctctatggattcttaatcctctttattttatttatctatttatttatttattttatttttatttatttatttgtttattttttgagacagggtctgactgtcgcccaggctggagtgcagtggcacaatctcggctcactgcaaactctgcctcccgggttcaggcgattctcgtgcctcagcttcctgagtagctgggattacaggcacccgccaccacgcccagctaacttttgtatttttagtagagatggggtttcggtgtgttggccaggctggtctcaaactcctgacctcaagtgatccgcccacctcagcctcccaaagcgctgggattactggcttgagccaccatgcccggctggatttctaatcctctttaaaatgatatatttataactcagtagctcagcgacatttatttatagggcaggtcatgggcaactgacccacatgaaaaaccaattgaattttaaattcctcggccagaggttaaatcaagttatatttcactcataaaatttcttaacttgg

SEQ ID NO: 170147 - DNA, 320 bp, Homo sapiens
aaactccggaggggagtactcgaacccggcgcaacgtcagtcccggcccgcagccgcgtcggcaccaccccggagcccacggttcacgcgctcgcggcggccccgactctctccttgataggaatggttgacttcacagaattatatggagtgactcgtcccactggattggaaactattttaagcctgaataatgttatatacaatgaattctaaatttcccttcaaagaaccggtatgtcagtatgttcagtctttgttctgcattttaaagtctaacttcctcgcagttgcaataaacaactttttccaccagttct

SEQ ID NO: 170148 - DNA, 219 bp, Homo sapiens
cagataaatgcctggacaagtcctgccaaggttggccatcaatggtagataggaaacaagctgctcccaactcagtagcccaagcatcactgaagccacagtgaacctcctccaccacctctacaggaaagtatgagcagatatatgggcgcctagaaagaagaccccattctgtcaccccatgggcaacagattccacagttgccctgagaagatatc

SEQ ID NO: 170149 - DNA, 808 bp, Homo sapiens
ggtccccgcttccccacgcggccccgcgcactccaaggaccccaacctgttaggtgagtccctgccccggggaggggcgctgggggcggcggcgaggatctagttgcgcgcgcgcatgcgcctcccgcccctctcccgggacaccagggctgcgcgtctcccaggaggcgccgacgcccctccctctacaggcgggaaaactgaggctgcggaggggacgctcttgcccaaggcccacggcgaggtgggccgaggaaggggcgggaccccggccccgagactcccaggcgcctttccagcaagcccagcgtactctgcgtgtcgcgggccactttaggtctaactgtcgcgcgtgggttagtgtcgccgcggtgtgcgcctcgagccgggcagcgaccgcgccggcgtatctgtgcctcggcgcgtctgcgaacggcacgtgtctttacagccgcgcgtgtgcccgcaagtgggtgtgcgcgccgtgccgcccgggaagcgggaggtcctgcgggcgtgcgccggacctgttgtcagcaggcctggcagatgggaactcagctccggaattaattgcttgtttgtctccggctgggaggccgcccccccgcccttccctggcgaccagttgctctgtgcctagccgggccccaaatgtcgccggcatccgcggccgcaggcagctccgggccaggctccgggtcagccccaaagcccgggtcaagccaggcgggcgcggcgggcgggctccccgtgacgcgagtgccccctgccggccgctgcgcacacggctccgagactggggaga

SEQ ID NO: 170150 - DNA, 101 bp, Homo sapiens
ttaacatctaggaaaccatcatatatgtgaaaggaactctgaggcttctcattttcctccatatttgctttggtcccttagctaaaattcacatttctatc

SEQ ID NO: 170151 - DNA, 704 bp, Homo sapiens
cattttaaaaggcaaataaatgcatataataataattacaactcaaagagatgacacatgaacaactatgattatctttgagcttgtacaggcagctgtctgccggtagcaattgtaaaatgcaccccaatttcaaagacactaaaatgtgaatgggaaaaaaaaccaatcttagaagacaaaatatattattatggagaaatttaaatatactccaatatgatactgttctgtcagaatctaatgacttccattggattggcctttcttcatgttaaacacaaggattccgataactaattcaagttcacttctcaaaatatttattcaatattaaaaaaataaatttccaggtgctgggattacaggtgtgagccaccacatccagcccctgaaccattttagagcaagatgcaaacaccaggactcttcatccctaaattcttctaagaatggaaagacattctgtcacataggcattactaagccctcaacaccagtgagtttataacactggctcttcagctaacgtcacctggaattagtctatgttcatattttgccaggtgtcccaatattgtactaggtaagcaggtttttttttttttttcctgatccaagggccaatccaggatcatggctgatcataagtaccatgactgaagaaaaataacatccagatctttctttgtaaaaatgtgctc

SEQ ID NO: 170152 - DNA, 624 bp, Homo sapiens
cattttaaaaggcaaataaatgcatataataataattacaactcaaagagatgacacatgaacaactatgattatctttgagcttgtacaggcagctgtctgccggtagcaattgtaaaatgcaccccaatttcaaagacactaaaatgtgaatgggaaaaaaaaccaatcttagaagacaaaatatattattatggagaaatttaaatatactccaatatgatactgttctgtcagaatctaatgacttccattggattggcctttcttcatgttaaacacaaggattccgataactaattcaagttcacttctcaaaatatttattcaatattaaaaaaataaatttccagggccgggcatggtggctcatatctgtaatcccagcactttgggaggccaaggcaggtggatcacctgagctcagaagttcaagaccagcctggtcaacatggagaaaccccgtctctactaaatatacaaaaattagccaggcatggtggcgggcacctgtaatcccagctacttgggaggctgaggcaggagaatcgcttgaacccaggaggcaaaggttgcagtgagctcagattgtgccattgtgctctagcctgggcaacaagagcg

SEQ ID NO: 170153 - DNA, 756 bp, Homo sapiens
ccatgagccaattaaacttcttttctttataagtattacccagtctcaggtagttctttatagcaatgtgagaagtgactaaaacagaggacaacacaaagatgaggtattgacaaccaatgttaacagtggggcctctcccccaccagatggatacagtcattctacctttccccgatttaaaacattactgtatcatatgttaacttcctaaatagatcagaacccgcctttagacttactattcagttctaaggcattgtgctacatgctaaggtaaagctgagaacaaggcagccccagtacttgccactatgaaatctacagatatacctcatcttgcctatttctgataaactttcttttacgaataaagatgcaaatatttgcttccaaacagttttctcaaatatccacaacatccctggccaagatatatgactgtaaatgaacaaaaagagaaagcatgtaccaatttctaagtgatgaaagtattattactacaatctcacatttatgtagcctaatcttcaagtttaaaatatcttactagttctgactgaaccagaaaagaaatctataaatcccaggaccttatcgtacatttgggtcatggcccaccattttgcttcctgtggcagtggtaagaaaagaacattcctctctctttccctacaaaacaactcattttgttcacaggaatatggaggaaggcatataagaaagtactcagtgagctgggtggggtggtgcatg

SEQ ID NO: 170154 - DNA, 438 bp, Homo sapiens
ttttattttttgtagagacagggtctcatcatgttgtctaggctggtcctgaactcccaggctccagcaatcctctcacttcggccttcccaagtgctgagattacaggcctgagccacaattacaggcctgagccaccgtgcccagccatgataccctttttaatttataaaacagactagccatttccacactgtcgtttcagaaactctttcaagacattttcacatcaccaaaggtagatataaaagtaacccaaagagtctttacctacatgtcattttattaaacatacaaataccatagttaccctcttttcatctttttaaatgaatggattaaacatgcattaaatcatgttaacaggtttaaaattgaatagtctttcacttaaatatatgtgtggttaggtttgtttttacgagcctctgaaactta

SEQ ID NO: 170155 - DNA, 361 bp, Homo sapiens
cacttaattcactgactttgtgacattgattatctaatagttctctaatagctcccctccatgaggggcgggtttatgtctttcttgtcaattagcccagctcagtgcctaaaagtagataaacatatggtgctgctgaataaatatttgataaatgaatacatacgtaaagataatttgatacatttattttttttaatttttttatttccataggttttttttgggtaacaggtggtgtttggttacatgagtaagttctcgagtggtgatttgtgagattttggtgcacccatcaccagagcagtatacacagaacccagtttgtattcttttatccctcacccgcttcccaccctcg

SEQ ID NO: 170156 - DNA, 585 bp, Homo sapiens
ccttggaaacaggccatcctgacagcatgtcaaggaagttgttatagggaattatttcagccagaagagatctctgcaaagcaatctgttccagcctactgtgtcatggagtagtccccacgtccccaatttttttgctggaaatgcagcggcagccagcgtgaagcctacacctgtcatgagctaatgtttgattcctgccaaagtttgcacttgggttccattaccagggtagagagtccttccagggaagcgtgttaatgtttaaccctttacccacaaattctgtctgtctcccggagaaacctaccacttgccaaaccactaccatgccctttggaattttgcttttgctttttaacattttttggttttgcaagcagactagagaaaggaaaattaatagaaactgggcttcacatgcaaggtccataggccgttttgaaaagtcaaggaagagtgaagctcatccttggccaggagaatatgcattggcagaaatgatataaagcctgatataggaagcaaacctgttagtgtgttaaatgtctcctttcttgccagccgtagaaagagctcggatct

SEQ ID NO: 170157 - DNA, 481 bp, Homo sapiens
tagaggagtgtgaagtaagtgtcctctggacgtgagacaaggtattagtaagcaggacattgtaagtttcacattttatctttaaaaatgtgcctttatgcattttactccacaacatatctgtttattttaatgcaaaagtgttacaccctcatccacaaattaaaaaccgctaaaactttcaaaatcatgctttgtatattctgttacttctggaatgtccctggtgccctgtctccttaccccagggacatctcaactgctgtttgagaagtattaatacttgtttaatacactttttaaaataaattttagcttatcaccataaaaaggtgattatttagaatctgttaccagactgtcacacttttacttgcttaagtaacttttgttccaaccaggaattttagaatatagttggttctagaatggaaaccatggtgtaagcaccatgaacataactcaaagtggttttacttta

SEQ ID NO: 170158 - DNA, 303 bp, Homo sapiens
cctgtggggcagagtatagaacatataatgaaacagaaatagaattctgaaaaaaaaattattaccttatctggaatttacatgaagtgttaacaggaaattatgcagcagttataaatgaaaaatatgggatttaatgtacttattaataaagatttgttacatacatgataccagtgtcccaaatctgctgtccgcagctgtccccaatttctaatgtttctgtcctcagatgcctcatttggagtcatcttattaccatgtaagctaatgccagtttctcttcagtgagtattccattcc

SEQ ID NO: 170159 - DNA, 357 bp, Homo sapiens
cggccaggactttcggtggaggtcgcggtggactgtcccgggaggtcttcctctctaatgtccttgtcctttacggcgtgggggcgatggtgatgctgaggcctgcgtctccctgcggcatctccatcccgggcgcgctatgggctgtgtctccccgcggcatctccatcccaggcgcgctatgggctgcgtctccctgcggcatctccatccccgggcgcgctgaggcctgagtttccctgcggcatctccatcccgggcacactatgggctgtgtctccctgcggcatctccatcccgggcacactatgggctgtgtctccctgcggcatctccatcccaggcgcgctatgggct

SEQ ID NO: 170160 - DNA, 306 bp, Homo sapiens
atataacatttctgatggtggtggaagcagaggccatcctttgctgtttcatgcccaattctgtaggcctgcctcagagagaaggggagcacaggtctcagcatccacagacttttcatggcggtgaagctctactatcaacacttggaaagagggaatcagagggtcttctactccatggctgcaactttttctcattttaaagatcctcctctagtctaatggatttatatttctctggctgacgtaattttgaccctacttcttggtaatacccgagccttaatttgatgaaagagtatcact

SEQ ID NO: 170161 - DNA, 255 bp, Homo sapiens
ctgttatatgccaggtataatgctggacactgcacacttattcattttatcatagaaaattaaagagaaaattatatgattattaagagcctgaatctcatactaggggaagtagtcctctgggttttatgtgatggtgggatgagataactgatgttaaaagacaaacgtggtatctttctggcatattagttttactcagagattttgagtgggaggagtggaagaacttagacaatttaatgactagagtgg

SEQ ID NO: 170162 - DNA, 404 bp, Homo sapiens
aggtagggctgacgatcaggagcgggtttttgggccgagtcctctgcagtgcccatctgacacccactggatgcgcagagtgggcagctggctatgagtctggaactcagagaagctgttcgctccggaaatacaaacctggggctcatagccatataaatgtcatttaaagccacgggactggatgagatcattaaggcagaaggtctaggtcgaaagaagagggccaggaccactacctgtaaaatgagccaatgacacctacacccacggggctctcgcgaggtgtcacgtgaacgcacccagcgagccctggaaccaggcagagaatcgcggcagccccgggggcggggcttccagggggcggggtcatacgggggcggggccgagggaccaagcggccg

SEQ ID NO: 170163 - DNA, 275 bp, Homo sapiens
tgttaggctcctggagggaccatcctaagaacaagcattctaaggggcgggaagcagaaactgccaggctagccaagggttatgcctgggactggcatagtgtcacttccaccatattctgttgacccatgtagtcatagggtctgcccaaattcaaggagctggaagaagagacaccaccttttgatggggagtggcaaggtcacatagcagagaattgtaggatgggagatattgctgtgattttctttggaaaatctgcctcagtgaggcac

SEQ ID NO: 170164 - DNA, 305 bp, Homo sapiens
ggaaaaaaaaaaaaagcagaacccaaacctaagacaagaatttgactgtaagtagttacaactaatgagtggataaacaaaatgtggtagatctatacaataaaatattgtttggccataaaaaggaatgaagggattaaaaaggctttcaaaattgtaaagccccacacaaggtgcttccttttaggttatttctataggctagcaaaacatctgtcagttaccaaccttggtccaatctaagagtcaataatggctgctgatatccatacccctgaggacaggggcctcaatatgtgaatgaa

SEQ ID NO: 170165 - DNA, 290 bp, Homo sapiens
tggtagtgttgacgcataacatttttctaaaattgtttcctcacttagtttccataatatcaaactaatctatttcttatattagctaattgataactactgaattgtcctttttcccatccttgaaatattggttgccccagaattcagttctctaactttttatctttcctgtctttactctctccttgggttatcttacggtttaaatattaatataatttgtatgctgacaactctcaaatctctctcaactaatttcccgaactccagacattgcctgctccgaa

SEQ ID NO: 170166 - DNA, 158 bp, Homo sapiens
atgatttggttactcagaaagataaaactaccaaaatatagactacataaagcagcaactaagacgaatgcataagccacggcagctgttgcaccttccacatgaacaaagacaacaagggcaaggaagctcctaaggaacctaaccccatcccctcc

SEQ ID NO: 170167 - DNA, 431 bp, Homo sapiens
tacccggcccgctatccggttcaatctttgtacaaaacttgaaatttggttattttagaatctagacctggccaggcgtggtggctcacacttgtaatctcagcactttggcaagctgaggcgggtggattacctgaggtcaggagttcaagaccattgcttgatgtttaatagcagtagttggcatttagcaagcagtcattgataatattgaccaattttatgtaatgtgagccttctaataattagtgtagttacaaaataattggagccatgctcaaactgtcaaatattgagaaaactgaattcctggtatttgaaagtgtctaattatttgcgttaattggtaagcccctcctgattttctacttaaccatgacacttcttccgtggcgcccatcttcattctcttgaacattgatactggaaga

SEQ ID NO: 170168 - DNA, 378 bp, Homo sapiens
cattgctcaaaactttcttagaccttattaatgaaaaactctccagaagcaaattctgagccatataaaaaatcagcattattgtttttatttgactgaaaatcaagcctatctttgagggggcgaagaaagtccaaatgagatactctctctcatttgaaagagctttgcaattcataagaaactatgtagatatgaaatgtcacagaatgggaagtgttaatggataagtatatccttactgagaatattaacaattttgccttaggcttttaaagaaattctgaaaaccccagtgttttaagctctagtaacaccattattgcttatatagtccccaaagtgcccacctgcagataacacccatctgagcatgta

SEQ ID NO: 170169 - DNA, 247 bp, Homo sapiens
tgtgccactgaactccagcatgggcaagggtgagaccctgtctcaaaaaataaattatagaaatcttcagtaatatttgtcatgagtgaaaaaaatccagtttatgatgggaaaagatagaaaataaaccccccaaaagaaaataactataatcttatctctcagagatcattaacattttggtgactcttcctattgtttttgttggtagacatatccatacgtgcatgtaatatgactagagtgg

SEQ ID NO: 170170 - DNA, 178 bp, Homo sapiens
tagacactgtgggtatagacaatcctttgacagcatttggctataaaggaatggagaaaatttgtattggaaagataggcatcaaaggaaagtttatcttttagttttgttttaatttttaatgttggtgatagtgcaggttatgtgcctcctaaagaaaattatccagctgagaggg

SEQ ID NO: 170171 - DNA, 272 bp, Homo sapiens
gtccgcacggtggcagcacgggggcaggacactggtgatcagtgctgctagggtgaggcaggaagggctgtggtgcaggacaggtgttggggtaaaggtgtggggtagtgcctttcatagagacagggtctgggcctctcgccagacctcacaccacactcctctcggatggagctaccgttgactaatctccctctttcccttctctctcttgtttctctgtcttccttcctggctttttctctctgcatgtggctgcctgttctcttcac

SEQ ID NO: 170172 - DNA, 1096 bp, Homo sapiens
cgcagtcttggctcactgcaagctccgcctcccgggttcacgccattctcctgcctcagcttcccgagtagctaggactacaggtgcccgccaccactcctggctaatttttgtatttttagtagagacggggtttcaccgtgttagccaggatggtcccgatctcctgacctcatgatctgcccgcctcggcctcccaaagtgctgggattataggcgtgagccactgcgcccggctgattttaagagattttctaaggtatgattagagaatgcagaatcacgtggattttatgcaggatccatctagacttatttcaaacttaaaggcttttgttaaaacaatttaattaagttgaaaagtgttatttaatttaatttatttatattttattttcagaagaaaggggagtagtgttgctttcttgtaccagcctgcagcttactgtcttttaaagcattatctatatacttaccctttcaaaactaatgacaaaaataattgcttattgttcttatgcttttagctttctagaagaataattccaagaatattagaaatctccttctctattgacaatttgtaggcaagttaccaaaacaattcatttcaaaggataatttgtaaaatacttggaattgcattagaaaccacatagaggtattactttgtataataaactgtgaaatatgcgaaaatatttgagtgggaggcgttgcaatttagttttctgttttaaaacttaattcttaaagagtagttatatgaaagtatgttatgaaatgagttgtactttgttcaattcaagaagttttaattcctatttgcgtacctagcacataatttttttcttgtaatgtgggcgtgttggtgaagtggagagatggttgtcctagcacgtggttgctgtgtgtaccttcccttttaaatatctcaatggcctttttaaaaggtgtttcttgcttgagtccttaattggcagtgactcctgtagaatcattgtttataattaccattaaaaatctactaatagaaggaatgtaagtttgttactgtacaggtatacttcattttatgtaataattttattttccg

SEQ ID NO: 170173 - DNA, 416 bp, Homo sapiens
cgcgcacgcctgaccggagcaccccgcttcacgggggcgttctgcgcgtccttcctccccggctgcctagatcacacggccccgtttcattcatttttactgaataacggtcgttggacaatttagagaagcagcagaaaccacgagaaaaacagtggagtcaaacggcggtaaggaccgacaaggctggcggggacattgagcaaacggcggcttctgagttggcacctgtccttcaccacgttgtgtgggaagtgtggggagtcgggattcccactcctccccagccttccggaaaaatgctcggaaatttccttccacattgacacctgattacagtctaaatagtaaccttattctgattgttaatgtaaccctctcgtaatctctacaaaaatactttagtttttctagct

SEQ ID NO: 170174 - DNA, 400 bp, Homo sapiens
ttgtaagatggagtcatcctctgttgcccaggttggagtgctgtggtgtaatcttgtctcactgcaacctctgcctcccgggttcaagcgattctcatgcctcagcctcctgagtagctgggaccgcaggtgttcgcccccaccctggctagtttttgaatttttaactttcaaatgattgactgcaaaaatcaggtagtcaatttaaaaataaacatctacacatgcgattctttttttttttttgtatttttagtagagatggggtttcatcatgttggccaggctggtcttgaactcatgacctcaggtgatctgcccacctcggcctcccaaagtgctgggattacaggcatgaaccactgtgccccacctaatttcttgttattcccatgatact

SEQ ID NO: 170175 - DNA, 223 bp, Homo sapiens
gtattaccatcagaggctccacctccctctgtagtcccagtcccttgggaaaatctcagagctggagcccttccctcatcctctggctccccaccccatggcttctcgaacagtgttcccaccaggaccttgggacaggagagaacgcctcacctgaaggactcccaaaactcaggtttctctaagctgctggggcagatgccaagagcctccactgctctct

SEQ ID NO: 170176 - DNA, 337 bp, Homo sapiens
aggaaagagagagacagggattgcttttaatatcttgatacaccaatggggaaaattgtatgcagtaaaatgaggaaaacatcccagattattttctggaaggacttgtcatctgaattcaaagtgggtcttgaaggtatcccagggacctgcctgctgtcagggctaggagagcaatgttctctttcctgcaattatttcaattctgccacacaataaggagtcctgggggccaaggaacagggaactgcattactagacatacatccctcaaagaagaccagacaaaattaccaaagtttcaggtgaccagactgaatttccaggagctacagtc

SEQ ID NO: 170177 - DNA, 310 bp, Homo sapiens
tgtttgtatcaagagttatttctgtctggtttgagtgtactgaactgaaagttggtaaagctctcgctggagagtaacaatcatcatagccaaaataggcttccatctgccagggtgtgtgtcaagcattttgtatgcatttgatgattcttcacagcaactcaataaagtaatactattgttaatcttacaaataagagaactgggttgtagagaggtgatgtaatctttttttttttttttttttttttgggcacccctggctccatccttggggggcccctaaaaagcccccgggagggtttgcaag

SEQ ID NO: 170178 - DNA, 143 bp, Homo sapiens
aaactgaggtgcagagaggtgaagtgacttgcccaaggtaatagagctagtgaatggcagggttggcacctgaaagtcagttccttctgcccccaaagcccatgctattaaccagtgggtcagcatttcctagatctgggtcc

SEQ ID NO: 170179 - DNA, 286 bp, Homo sapiens
atcgctttttccagctgtgtgtgtatggactaatagctactcatattaaatctgcatcagtttctatgggccaggttgctgtaaccaacaacccctaaatctctgcagcttcaaacaacaaatgttcatttctcatttgtgctccatgtgcatctgggcttgctggaggtgctctttgaagaggtctgtctttgggaggcaggctgatttctggggtggctgtcatcttgagagttgctggtcactgttagggaaataagagaacatggcataacaccacacaatt

SEQ ID NO: 170180 - DNA, 506 bp, Homo sapiens
tttgaacacattcagaagatcccatgggccctaagtattttaataagccttttcatctggcccgtatttctgaagaagaaaccaaggcaattaaaaaccattaaatggttggttcaacatcaaaagaagaatgatatcaggattggcccccaccaccagactgtcaactccaccctaagatctactgctgccttcaccgaatgatagaaaaatatcatctacccaagataaaagtgatagaatttacaaaacaaagccagatgatgaattagtatttttaaaacaatgacatgccagcctatactgttttacatagaaagaatgtcatctgtatcaccctaaggagattttaaatcatcatctaataaagcctttgccatttgcatgtgctggaatgtttacctgttttcaaaaaacagtcaacatagacagttttatagaaaagtttatggctataagagaaagagaaaggaaatgatgtatgtttctagtcgatttaaatcaag

SEQ ID NO: 170181 - DNA, 311 bp, Homo sapiens
gagccacagtgcccggcccgaaaagtctttattacatacccttgaactaggcactggagaaaagttctattagtcttcatctactttatgttctgaagctaaaatcagggtttatgctcttgccaacaagcaaaatatttagaattcagacttgtctagaacattagagatgtctgggcatagttgatcctaagatccactgaatgtataagctagtagctgagactagatttcttcataaaaagatgagtagggcatccccggcttagaatcaaatgtgtggtccagatggcagtataggatcagaaagt

SEQ ID NO: 170182 - DNA, 445 bp, Homo sapiens
aatggaatttgagaaatgaattcaaatgagttttcttagatgtttgcaattctttcttcctaaaattactatgatttacatgtatggagcagtaaatgcaaatgatttccaatcaccacgggtacgtgtactcaattacaaagtctcttaatgagcattgaaaagatttcagcattcactgaacaagacataaagcaaatgaactcttcagtgccctccccttcccacagagggctgaaagggactcactcttgttacaagaacacggccactcctccctctcttcctcttcccagtccatccctcaccccagtttcagccaccatccaaaaagaaatcgcagcatggcccttgaagcacattgagcttaaaagtgcctagaagataaagcctaaactgcagcacgacaggcaagacctttcaaaatctggcctcgaccatcctc

SEQ ID NO: 170183 - DNA, 536 bp, Homo sapiens
tgagtaaggtcctgggtataagtggatgggaggttaacaagttaatgtagctacattattacccaggagtttataaagcctggatacattcaggatacacaggcaagcagggaagcatggaaagtaaagaacacttttctaaaagaaaaaaaaaaccctccaaaaactaaataagtaaatcacaaaaacaaaacaaaacaaccactaatagcagctatattctcacctcctacttaacctttggatgatatctcttgtttacaggggtgagatcagactgtgtgtgtgcataattttgagtatggttgttttctcataagactatataaaaatgctgtgttctttaaatctgtatgaaaattatacatggatagcatggatatttttataacattccctgtagaaaatttgtaaaatatagaaaaataaaaaggaaaaaaagtacccataatcataccatctagagatcacattgtcattttggtgtttctctttctagacctttttatgcataaatattgatttctgaacaatag

SEQ ID NO: 170184 - DNA, 811 bp, Homo sapiens
agaacagggaaatgttattcacactgagcatctggtcttcactaaaaattcaaccaccatttcttgagtatttactatataacaagcattcggaatataaagatgaaaaattgtgtggaacaggagccacatacataaggggataattccaaataaagtagtacttgctatgagaggagtgtgtccagaatggtgcaagagctctgagggggacgtttactaaatctgggatttatagcaaaggaatacagtgggatcagtgggtagaaaattactaagaggaaacatcaaggatagacggccagagagtttctggccaaactgacttgatggggttagacatgaagaagacaaagtgcaagatgagtactaaagactaaagaacaagcaagaattaggtctgagatgaagcaagattccaagcagagagatccacttcagcagtggctcatggcacaagataacatgtttagtgggagaataaaattcagtgtgacattattataaagtgcaaagtgggaaatggcaggagctgcaggttgaggccgggttcaaagaaggaatgtttttgccatgctgatgaatttgaactttattatagaagcaaagtatttcaatatactgcagtattttaattgctggagtaaaactgtcagatttgcaacttaaatgagcccatttggcaatgatgtgagacaaaagaagaaacagggagcctggctcaggggttactaatagaaaccaatcaaaaagaggttagtgcctggactggggcagtgttagtatgggttgagaggaggttattgcacat

SEQ ID NO: 170185 - DNA, 545 bp, Homo sapiens
tctcatgacttcaatttctaaatactttcacatctctatctctagtccacatctcctgtctaaactatatgtgtgtccagacgccttttggacgtcttggtttgcacaataccacagtcttctcaacttatttaaaacttgcccaatctgctcttcttaactcagtgaatggtatcaccatcacccattgcccgagctagacactgggaatcaagtttttgcagttctttctcttgtttcttcaccacatgttctgttgacactgtttcctaattacctgtaagatccatccacttctttttattgcctctgctactatcctaatttagactatagccacctctcatttaaattatttgcaaaggcctcttaaccagttgcctgtgctatcttcacaccttcagactacaaaaatcacagattgtgtgctgggcagggtagcatgtacctgtggtccctgctactctggaggctgaggcaggaggatgacttgagccaaggcattcgagaccagcctgggcaacaaaatgagaccccctcctatc

SEQ ID NO: 170186 - DNA, 669 bp, Homo sapiens
agcctccccgagtagctgggattacaggcgactgccgccaccacgcccggctaattttttaagtatttttagtagagacgggtttcaccgcgttagccagcatggtcttgatctcctgacctcgtgatctgccctcctcggcctcccaaagtgctgggattacaggcgtgagccaccgcgcccggccgacccctgtagggttttaaaggagagaggcagcatcccagagggcaaaaagggcttcattcatggagaaagcaactgagctgggcagagcacagacggaatttgaattggaggccagaggcaaagggaactccaagtggaagaagaaacggcatgaaaaaagggattgagaaggaaaaggacaagatggtttggagagagagcaacttcagcctggaaaagcagaaatgagatgcggccaagaaaaagactccagcccagcctgccttggttctaaccctgactgttacttaacctctttctggctcagtcaagaaacttgagcactgcaagatgatcatgtggaatacctacttcaaacggatgttaagaggagtaaaagtgttcttgtttctaagtgcttgaaatgcagctggcatataattaagctatgcaaatatttactttttttttttgaaatgctgagtttactgatcactctaa

SEQ ID NO: 170187 - DNA, 280 bp, Homo sapiens
cagatctgcacctatatttagagaccattaacttctttagtactggggtgcagggcaaagggactcacacaaagtcatgaattatagagttagaaggatcctttgggttcatctctcatactttttgaaaaaagaaactaggggccaggcacactggctcacatatgtaacccgaacactttgggagattgagacaagaggactgcttgaggccaggagttcaagaccagcctgggcaacatagcgagacctgatctctagttgtctttttattaaaaaa

SEQ ID NO: 170188 - DNA, 379 bp, Homo sapiens
ggatcatgaggtcagggaatcaatcgtttttaggcagaaaaaaagaggacaatcaattaaaacccaagatggaaccattcccctggaattctagcttctggctctgcctatgaattggaccgttcaccaaaaatgaaatttttacaacagagatgagcctttcatttgctcctagttgaagctgcaaatcccttgtgccaagtattttgctggtgtcaattaaggcaggcttctcagattgccacagggaaatcacaataatatcatactctcttcagaaataacatttaggatttttgttagggaaacaatcaaataaagccctgacaaaattgtttctaggggaaaacatgcctgtaagggatgtctttggaaatga

SEQ ID NO: 170189 - DNA, 336 bp, Homo sapiens
atcattgccatagatccctgagaagcactccccctcccacagttgccattccaatcttgctacacagtataagagccctcttggcttctgagggttaaatgttgccatccagaatggttaaatgccattccagaatcgtgtcatccccaagacactaaggagccaagttccatggcagcatctcctagccacagagcacagccaccaccagctttctatgacaccagtgccccctcacgtccacattctgcattgccttagtgaagagcgcctcctctgggcagctccatgaaacaccttctggtctcatgtaataaatccgttctaacattccca

SEQ ID NO: 170190 - DNA, 737 bp, Homo sapiens
aagccaggtgaagtacctgtgtcatggatgctgagggcagtggagttcaaggtgtagcagtcacgatctggagatgtgttcccatgaatggtgtgcaaccggggagggagtatggctgtactcaggatcctcgtactggcactttaaaccaagatggtaagcacaggtttcagtatctgggtctccagggaggtgaactagcaggagcatggatgagattccatgatgtaaggcccagagcccagtgggagacaccataaggacctggtatctcctctgagttggagaactagggaggagcgagatttactggggttcctggggattgagtctgctcatgatttcatctgcccccatcatgcagggccatgtgacctttgaggatattgctgtgtacttctcccaggaggagtggggcctccttgatgaagctcaaaggtgcctgtatcatgatgtgatgctggagaacttttcgcttatggcctcagtaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatgttttcatttggttctaacctgcaaca

SEQ ID NO: 170191 - DNA, 731 bp, Homo sapiens
tttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgaatacgccgcagattcccatggtaacagaagagtttgtgaaaccatcacaggtaagtggaagaagtcccaggtcttcactggccctgttccctaaagccatgggtctggcccacagatgcagggccatgtgacctttgaggatattgctgtgtacttctcccaggaggagtggggcctccttgatgaagctcaaaggtgcctgtatcatgatgtgatgctggagaacttttcgcttatggcctcagtaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatgttttcatttggttctaacctgcaaca

SEQ ID NO: 170192 - DNA, 660 bp, Homo sapiens
tttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgaatacgccgcagattcccatggtaacagaagagtttgtgaaaccatcacagggccatgtgacctttgaggatattgctgtgtacttctcccaggaggagtggggcctccttgatgaagctcaaaggtgcctgtatcatgatgtgatgctggagaacttttcgcttatggcctcagtaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatgttttcatttggttctaacctgcaaca

SEQ ID NO: 170193 - DNA, 1343 bp, Homo sapiens
aagccaggtgaagtacctgtgtcatggatgctgagggcagtggagttcaaggtgtagcagtcacgatctggagatgtgttcccatgaatggtgtgcaaccggggagggagtatggctgtactcaggatcctcgtactggcactttaaaccaagatggtaagcacaggtttcagtatctgggtctccagggaggtgaactagcaggagcatggatgagattccatgatgtaaggcccagagcccagtgggagacaccataaggacctggtatctcctctgagttggagaactagggaggagcgagatttactggggttcctggggattgagtctgctcatgatttcatctgcccccatcatgcagggccatgtgacctttgaggatattgctgtgtacttctcccaggaggagtggggcctccttgatgaagctcaaaggtgcctgtatcatgatgtgatgctggagaacttttcgcttatggcctcagtaggtaagatctcttaaaaccacaccatcaacctctgctggactctgctcttcccctttttccaggagtttcctgtctttcccagagttggacatgggcccttcttctttccttggttcttgacctgtggaagacataggcgttgtggttgccaggcctgggttttttctgccccaacatctactgtcctgaagccttttagttaagagtttgggttcagactcttgtaacttgcccaaccgacaccacttggttttgccactccttgctaaggtgactgttcagttctgtggtggacctgtgttacaggttctccccctgcctttagtagacgtgtctttagacctgcctttctcaggaattacaggtacttacatggttgctatttgtagggaaccctagactatgacagcaagaccccctcccaagggtttttttgtaataaatttccctcctgtagtctgtcatgggttggcgcaccctgggccagtgttgttgacccacctccctgtttttcccttaggatttcttctaccttccaggacccagatagtctcctgacttaagctggggacaggggagaggcctgtgttcctgaaagcgtagtgaagtcttcagccacagcaaggggggttaacagggtttgggacctgtgagtaggagcagtgggagggcatgatttgagggctgaactcaaatcataccaggcaaatgtcctatgttccccactattttggtgccagggctcatggccatacctcatttttctcttttctctgcctgcttgacaatttgcctacttgtcgtttctactgtgattgtcccctacctctgttctccacatctctcctgttc

SEQ ID NO: 170194 - DNA, 1337 bp, Homo sapiens
tttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgaatacgccgcagattcccatggtaacagaagagtttgtgaaaccatcacaggtaagtggaagaagtcccaggtcttcactggccctgttccctaaagccatgggtctggcccacagatgcagggccatgtgacctttgaggatattgctgtgtacttctcccaggaggagtggggcctccttgatgaagctcaaaggtgcctgtatcatgatgtgatgctggagaacttttcgcttatggcctcagtaggtaagatctcttaaaaccacaccatcaacctctgctggactctgctcttcccctttttccaggagtttcctgtctttcccagagttggacatgggcccttcttctttccttggttcttgacctgtggaagacataggcgttgtggttgccaggcctgggttttttctgccccaacatctactgtcctgaagccttttagttaagagtttgggttcagactcttgtaacttgcccaaccgacaccacttggttttgccactccttgctaaggtgactgttcagttctgtggtggacctgtgttacaggttctccccctgcctttagtagacgtgtctttagacctgcctttctcaggaattacaggtacttacatggttgctatttgtagggaaccctagactatgacagcaagaccccctcccaagggtttttttgtaataaatttccctcctgtagtctgtcatgggttggcgcaccctgggccagtgttgttgacccacctccctgtttttcccttaggatttcttctaccttccaggacccagatagtctcctgacttaagctggggacaggggagaggcctgtgttcctgaaagcgtagtgaagtcttcagccacagcaaggggggttaacagggtttgggacctgtgagtaggagcagtgggagggcatgatttgagggctgaactcaaatcataccaggcaaatgtcctatgttccccactattttggtgccagggctcatggccatacctcatttttctcttttctctgcctgcttgacaatttgcctacttgtcgtttctactgtgattgtcccctacctctgttctccacatctctcctgttc

SEQ ID NO: 170195 - DNA, 222 bp, Homo sapiens
ccaggattgaaagtcctggaaggaagaaacccaaaaagagattgaggaaaaaatcaaaataattcacaattctgtccaggccccatccttgtcagaaagccagattctacttcaatgactgatagtgctgaatcttttttggaaagaaaaaaaaaagaattgaaatagaatgctttggatctaccaagtaggaaattttggaagacaggaaactattaaata

SEQ ID NO: 170196 - DNA, 757 bp, Homo sapiens
caggcacaggagtcgctcctcatagcgagtctggtgcggcctacgcgcggcgcttcctttcggacctgaggcccagaccctcaaaatagagggagcggataaggaagtcataatattaatgaactctgaggactgctatgaggataaaatgggatcatcatcatcatcatcatcacttactcaatgcgtactacaatcctggcactcctctaagtgttacaaatatattaactccaacaataactccagaagaaatcctagtattgcataagtgatcttcatgaagcttcctattccctgtggagtttggaaggagaggcattcctgtaggcttctgctgagaagggaagaagagtcttcctgcttggacactgggcttctgaaaaggccatgtgctctcctatctcacagttttctttcttttactttttttgtttgtcttttttctctttttttattctttttttcttacctcacagtcttgtatgtgttttgactgtcacaagaatgagcattggatgtggtagaaaaaattcttggattagtgcctctcattagtccctaaaaataccatatgtatctggcccaactcctggtgactctctaagcttatgatgcattttttggtatgttctgtatacagttttgagcttccgcaatgatttttaaaacaggacaaaatcccattatgaaacttctgttatactccattaaattgtcaataccagagatacaggaaaattattttctcattcta

SEQ ID NO: 170197 - DNA, 848 bp, Homo sapiens
caggcacaggagtcgctcctcatagcgagtctggtgcggcctacgcgcggcgcttcctttcggacctgaggcccagaccctcaaaatagagggagcggtgagtctggcaagggttgcatacccgctacttctcctcgccagccttttcactgaacctagggatcctgggactcatccctccgaccgaggataaggaagtcataatattaatgaactctgaggactgctatgaggataaaatgggatcatcatcatcatcatcatcacttactcaatgcgtactacaatcctggcactcctctaagtgttacaaatatattaactccaacaataactccagaagaaatcctagtattgcataagtgatcttcatgaagcttcctattccctgtggagtttggaaggagaggcattcctgtaggcttctgctgagaagggaagaagagtcttcctgcttggacactgggcttctgaaaaggccatgtgctctcctatctcacagttttctttcttttactttttttgtttgtcttttttctctttttttattctttttttcttacctcacagtcttgtatgtgttttgactgtcacaagaatgagcattggatgtggtagaaaaaattcttggattagtgcctctcattagtccctaaaaataccatatgtatctggcccaactcctggtgactctctaagcttatgatgcattttttggtatgttctgtatacagttttgagcttccgcaatgatttttaaaacaggacaaaatcccattatgaaacttctgttatactccattaaattgtcaataccagagatacaggaaaattattttctcattcta

SEQ ID NO: 170198 - DNA, 153 bp, Homo sapiens
ggcggcgaggactgagccaggagcgccgagagttccagctgctcccaggctgggttctaattaacactggacccctgctgtctttgccagttccatgctgtatacacataatgagccgttacgactccagcaccaaagctaacgccccgggaa

SEQ ID NO: 170199 - DNA, 127 bp, Homo sapiens
atatatcaaagcttatcaaattgcatactctctgtgatgtttatcatacccccaatgtacttcaataaaactatttaaaaaaccaacgtgcaaaaatccaagtttacgggaccaggcaaatgactgc

SEQ ID NO: 170200 - DNA, 441 bp, Homo sapiens
tgtacgtactgtgtgttaccgtatttatacactgcattcagccaagtataaggcctgcgttagaccagcctacaggatactaatgaagcatggaatctggtacctatgacagaacaattctgagacagggagtcacgtaccagagggtgatcatgggctggttagggtcaagtggtcctgcagctagtcagtactggaactgatttttacttgttgtcttttctattggaccacgacttctctctggaatgaaaggaatcaacccaatgctattgtgcctaagtaattgaggttttagggtcagaaactcaaatattaccgcaggagaactaaaaccacatgggagctctcaaacaaggttgcaactctcacatctgggcagttagtcaagcaaaacagtgaagtggtaaaatgaaatactcattacacggtgacaccaca

SEQ ID NO: 170201 - DNA, 193 bp, Homo sapiens
cagagatcgcgccactgtactccaacctgggtgacagagcgagactccgtctcaaaaaaaaattaaaaaatgaagtgtacaattcagtggcattaaatacattcaaattgttctgtaacctcgccatcatccatctctcttcatcttctcaactaagactctatacacattaaacaataactcatcatttccc

SEQ ID NO: 170202 - DNA, 328 bp, Homo sapiens
attcccgtttccaaagacatcttcggagaggtccacatatccacttgcagattccacaaaaagagagtttcaacactgctctatccataggagggttcaactctgtgagttgaatgcaatcatcacagagaagtttctgagaaggcttctgtctagattttatgcgaagatatacccgtttcgaacgaaggccacagagtggtccaaatatccacttgcagatcctacaaaaagagtgtttcaaactgctgaatgaaaagaaaaagtaaactctgagagttgaacacacacatcacaggtcgacgcggccgcgaatatagtagtagta

SEQ ID NO: 170203 - DNA, 338 bp, Homo sapiens
gggtgtggtgtgtgtgaatgcggagtgtgcgagtaaacgtccgtgtgtgaatgtcagagtgtgggatgtggcatgtgattgtcagagtgtctgaagtgtacgggtatgaacgggcgtgggcgtggggccgttggacgagtgagtgcacatgcgtgtgcgtgtgccagtctgcgggcgtgggtgagggactgatggagcgtgtgccttcccagcaggggctagagatcagcctcgggcagtgacgctggggcacctcccctgccagccatcatcttccccaggctctgcaaggctcagctgcatgctggccgagggggcctggcacacagaagccgatc

SEQ ID NO: 170204 - DNA, 205 bp, Homo sapiens
catcttctaagatgtaataatagtatacaatgaaacatcaggaaaggagtcaaaacaattatttagtaccttcttcccgagaatgaaactaacatttgaaaagataaccgataaacaatgataacattgcaattgatgtagaactttgttccttagttcagctaaaaccgggtccttgtcacacaaccaggaaaagttaggcacg

SEQ ID NO: 170205 - DNA, 551 bp, Homo sapiens
atcaattgaggtcaggagttcaataccagcctggccaacatagcaaaacaccatctctactgaaaatagaaaaattagctgagcatggtggcgggcgcctgtaatcccagctactcgggaggctaaggcgggagaatcacttgaacccctgaggtggtggttgcagtgagctaagatcacaccagctactcaggaggccaaggcaggagaatcgctggaacccataaagcggtggttgcagtgagctgagatcgcaccactgcactccagcctgagcaacagaatgaaacttgtctcaaaaaaagaaaaaaaaagtaggagtagggatgtttttgtcaaatctaggaaatgtgaaatttcttctagaaaccacctgaattatattaaaaatattgacaatatatgagtttttaccttgatgaaaggagatatttctttttttttttttttactaaattgcttttatacaaagtctacaaattaaatctgcatataaggagagttaaatttaaatattaattttaagatttttggaaaatgcggcaatcgtt

SEQ ID NO: 170206 - DNA, 120 bp, Homo sapiens
atgtgatggagtggtctggggtagcaggacatgtgacaggcctcgaagttcagcactacaagcatggagcccatatccacaacatcttaaagcgcagaagctgggctgtggggtggagta

SEQ ID NO: 170207 - DNA, 82 bp, Homo sapiens
aaggggcagacccctaaggctgactgagcaagtctgagggggggtcccaggaaatagtattttaaacaagtatttcaggtga

SEQ ID NO: 170208 - DNA, 355 bp, Homo sapiens
tgatataggcagcaggtgaagatatgaaatttgtggtccaaaggaatagaaattccagctgggtaattccaggagttactcaagagccacaacccagtgagagagcacgtgcatctctttggccaggacacagagcaggcaagctcttttgtggtggagatgatgctctggacataagttcaaagcatcagcagagaatctggcctgagtccactatgaatccaccctggggaaccttcagataaatcgctttagtcactctcaagtcagcaagtagaatccaggggtttttattccccttacttttttccagtggaagtgcaaaatactcccatgtcatgtgcagcagtatacg

SEQ ID NO: 170209 - DNA, 310 bp, Homo sapiens
tgcctcagcctcccaagtagctgtggttacaggcacacgccaccacccccagctaatttttgtatttttagtagagacagggtttcaccttgttggccaggctggtctgaaactcctgacctcaggtgatctgcctgcctctgcctctcaaacaaagtgctgggattataggtatgagccaccatacccggcccagctcctttagatttattccctcttatgggatgtttttagagttcacgtaagtgcattgttccttggacctcctgtctaggcgttcactgccaatctgtagggttgccattggctg

SEQ ID NO: 170210 - DNA, 298 bp, Homo sapiens
gcaaacccttcctctcatgtctttgtgtttctaatggaaagactttttattgtgtgaaggaaggaaaaaaggaacttgtcttctagtaattggttatttgcagactctgtaagtatatgtactgaacattaagggtttatagccctggggtttgttcctaaatgggctacaaggagttttacacaaaacttttgcttaatgcttttttttgtgtggagaggacccataatccttataatactctcaaagatggctcaggatcccccaaaatgctaaaaatcacggcctaaaaaattcc

SEQ ID NO: 170211 - DNA, 460 bp, Homo sapiens
ttgagagggaaaggggggcacgaaggcctgactcatggagtggagcgccagaacaggaagtgggctacgtcatggtttcctggggagggatttggacaagcaggaggccccccaggtcccactagagatggagaccagaaaggtgggcactggtgcttaatgctggtgaaaggttcgttccacaaatcctgctcactgaagtggctgtcggttttgcattcactccggacagggatgttaatgtccccggccctcggagcaattccgcagccgtcaacccagatgctagttactcggtgaaataaaagagtggtcgagtctctcccgaggaagataatatcctgtcacaggcagtatgatctgccggccatgtgacagccgttccctaatgtttccaaatagacttttgaatagactcttgtctagaagaaagcaaattgcaagagcatttttggcagcc

SEQ ID NO: 170212 - DNA, 412 bp, Homo sapiens
cagtattgacaggtggggtctttaagagatgattgggtcatgagggctttgccctcatggattaatgggttttcacaggagtaggacttgtggctttataagaagaggaacagagacctgagctagcaccctcaggcccctcaccgtgttacgccctgcgctgcctcaggactctatagagagtctccaccagcaaaaagacgctcccacatgcagcccctcaaccttggacttctcggcctccagaactataagaaatacattttgtttctttataaattacccagttttaggtattctgttacaagcaataggaaatggacgaagacaaccatttaaaaccgtatttcccaacctttttttccactgtgacacacatgacagataaaatgtatgtatcagacaaccactt

SEQ ID NO: 170213 - DNA, 234 bp, Homo sapiens
gtatttacaaaagtcacacaacatggtgaacgcaggaggaagctgcagagatggttctagacttacagagaggaggctatatgcaaacccctgtatgacttgcaatgtcccatgaactctgcctagaaaaaaccaggtgttatcttttcacttcttgcctatagttgaggaagctctatacaaatccgaccctttatctgagtttctccccctccctgttcaccccatatttag

SEQ ID NO: 170214 - DNA, 470 bp, Homo sapiens
ctcttgtaagtcctattcaacgtaagaatatcataaaaccaggtgacttattaaaactacatttgcagctacccatctatgtgaatcaggattttcctcaatattaaatagctaaattaaaataagtgaatgccatctgaggcttttattaaataaaaactttcctccctatttctcaatttaaaatgtgaatttttcatttaaaaagcctctctgttttattggttgattgtataagaggcaactgtcatgatcttctgagtttaacaatacattgataagaaaatactgcctttatgtctgttatactggagtttcacagagattttgtaaaaaagttttgctgttaaaaactttgaaaaccaataccatagataaatttgtatagattttttgtcttaaaatgcacttttttactataaaagtaatatatatgcattgcaaagtatgaagaataaagaataataaga

SEQ ID NO: 170215 - DNA, 275 bp, Homo sapiens
ctttaatcaaatatagtatccttctcaacttcaacaacatattgatattaagcatatttaagaaagttgctttgtaaagtctttgtgtagtaagtacaatgtctggccttctcagggacatgttctgtcagttaatttcgttcctttgaatgggctatactttttccttatatgccttaggattttgttgctgttgaaaatggggtgtttgaaaattacagtgttgtgtctctggaaatcagagtctcctctttcaccgaggtttgctttttttg

SEQ ID NO: 170216 - DNA, 293 bp, Homo sapiens
tccttggaatgtagtagcatgataatcagccaatttaaaagaaagaaaatataaaagaatgaagaaaggatagaaatgtaagtaaaagagagtctgttgcagatgtactcaaagccaaacatttggaaataaaatgtgcaaataaccaaaaataatattaaaagtatagtaaaatcaaaccaaggaataatagccacttttacaatagtgtaattgcaaaatgacttccatggatgttcaaatgggctatcagtgtgaatgcaaaggatccaaaataggaacaaacgaaatgg

SEQ ID NO: 170217 - DNA, 523 bp, Homo sapiens
tcactactgcaaccccagagcaggaagggcaccagtgtagtttgaaaagctccctgacccccataatgcgacacttctcttattcactcatagtgttgtgaaaatgctttgacctctctctctgaaatactggctctctatctgtgcacactctttgattaggtggagattctgaaggcaaagacagaatcttacaaatctctgtccacatagtctggtcccatgcacacaaggtatatttaataggtaattgctcatgggctgattgattaaaaaaagttcagactgactcccgtcacaggttcctaagaagaaatataccatgaaactgaaggctacagctggcttcctaattaatattagtcactttgcagttcttaattaagaactctaaaataaagacccacctttccaccatgccaagtgggtatcaccttcattagtatttaagtgatgtagccacaacttcatttttatgctcttttctctgccctgccagatgggaacattagctgcatagtat

SEQ ID NO: 170218 - DNA, 370 bp, Homo sapiens
tgacttcttaacgccaccatttgtgcttgtaaacttcatgcaggtaaaggccatgcctgttatatttaacatcatccacctatcaccttgcccagtgcctggcggatattaggttctcaacaaatattggctaaatacatgaaaaatttattgaaggctcagctcaaatgctactgctcctccaatctcttaggctttctacaggactctgtccccatcttggggcacattttcacaatgtgttcatgttatctgagtctttttttcctatccggccatgagcaacctcaaagtcttatttacctcgacattccccaccgcaccttgcataatgcctaacacataaagggttcttagcagtagatgaatc

SEQ ID NO: 170219 - DNA, 313 bp, Homo sapiens
tccacccaaaacaatggaatgtacattcttctcatctatctgtacatggtacttactctacaactgaccacacaatcagacataaagcaagcctcagcaaatagaaatcataccaaccacactctcagaccacagtgcaatgaaaataaaaattaatactaagaagattgctcaaaaccttacaattacatagaaattacacaacttgttcctgaataagttttggaaaaacaatgaaattaaggcagagataaagaaattctttgaaaataatgagagcaagatacaacatatcagaatttatgggactcag

SEQ ID NO: 170220 - DNA, 341 bp, Homo sapiens
gggaaagccagtaaaatgaaatgacagtgccatatgtgagtgcaatgtacagggtcctccaagagttcccaggaggatgggtatcaaggcagtcttcctggagcaagcagttctttgaatgatgagcaggatttcacccagcaaagaggaatggaaatgactttccaggcagaggagcatggcttttgggagaggtgggctgtagaacttgagaatagggaggaaaatgtattcagaaatgaagttggggccttgctaagcagtttggatttgatttgtagataatgggagccaactgaagaaatttaagaagagtaacagaagttggttctcagttaaga

SEQ ID NO: 170221 - DNA, 1025 bp, Homo sapiens
gaaaacttccttaagagctaggaaaataatgtactttttaaaagtgagaaagcttccggggcttcatatagcatcactccctaatattgtggctatacagttatttgcagtgtgtatcagttatattatgctgcataacaaaccaccccaaaatttactgccagcattttgagtcaaaatttactggctcaaaataacaatcctttatttatcttgccattctgtgggttggtgatttgggctaggctcagctacgtgatccttctcctttcacctgggactattcatgtatctacaggtagctgcagttccatgtcagctaggctttgtttctgggggtcactggctgtcaggtggagagataatgatgactaagccatgtatctcatcatcctgcaagttaccccaagtttgttcatatggtgattgggcagggttccaggagagagcagaagcatcttgacactgagactcagaattcacacaacattgtttccagtacattctgattgttaaagcaagctatatggttagcctggattcaagaaatatatgacagaggagctacagggtcccatttcaaggagcatggatacagggaggggaagaaatgtagccatttttggcaatctgctatagtgtttatggggcacatggaaacagctgtggtgaatgagaagagcatggagtgtgagaggacttagattcccatcttatagtcccattccttcaccccattctgactgccagcactgtcaaatcttagtcttacttctagccgtctggcatctcagtcagttcaacaagttcctaggcagtcttgcaaataccaggttttctaccctccagccctccctccattctacacagcaccactacactagtcattcttcagtttatctttcaggacgttactcctcaaaaaccacctccctccctacctgccatcccctacaccagcctaggctcttctctagcttctccactcattttctggccccattctctcttgttcaagtcctgct

SEQ ID NO: 170222 - DNA, 215 bp, Homo sapiens
ctaccaacaatttatactttatattcttgtacatatatctttgtgtactgatagcaactgtcatttttcatggctataaaatattctcttgctgggattacaggtgtgagccattgtgcctggcctgtactgtaatttatttaatctatctctatttttggatatttggattgtctccatttttctgttactgtattagtcagggttctctagag

SEQ ID NO: 170223 - DNA, 391 bp, Homo sapiens
cattgaaaagagaaaattgacaaggtaaacggtcgtttggaggggccacctggggacgcggcccgagccctggctctacctgaagaatatcttctatttgccacacttcctctccccgtttcctttcttcgcccctctcctctttccccttcccctcgaaggtaatgagaactactggaccgattacgctaacctcttggccctttgtcaaaaaatggagccaaaaaggttgatttagacagaccccctgctcagtgcagcacctgttattctctgtatttatattaccaagggccttcggtaaattatgaaaaataggatgccacctgggacaacactgcttagacagcactggaagacctttataaatatactaggttgcttttctcca

SEQ ID NO: 170224 - DNA, 341 bp, Homo sapiens
gggaaacagattcaataacatcacaggagaagcttggagaaagacaacaggggcatccaaatgctgcagctttaacctactttctgggactgtcatctcgctgactgcacgcctttagatgcttcttcctcagtctatggggagagggacctggggctagaaataggagagtttgtggggaggggcaggatgctgcagggagtgggtgtgggcagaggttgcaagactgccagggttctctgtgtgccggaagtgcaggtttggctgtgaggaatggaatgttctctcttgccctccaagagcacaaacagctgtggaagagcttgaaaagaagattacta

SEQ ID NO: 170225 - DNA, 322 bp, Homo sapiens
atggtgaaacctcatctctactaaaaatacaaaaaattagccaggtgtggtggtggacgcctgcaatcacagctactcaggaggctgaggcaggagaatcacttgaatccaggaggcagaggttgcagtgagccgagatcgtgccactgcactccagcctggacaataagagcgaaactctgtctcaaagaaagaaaaaaaaaaggaaaaaggaaatgtgcacagagcacgtatgaacagcttcatcacccagtgaagaaaaaggatattacttgtctcccagaagcccctactgaatccttctcattataacttttctatt

SEQ ID NO: 170226 - DNA, 397 bp, Homo sapiens
ctcccctcccctcccgagttttcccataccccaacttgaacgcctttaaaccagggcttcggctgcccacacaggatttctttcctctaggagtttttgttggttggttggtttgttgtttgttgacttatagtaagtcccttgggggtcttttgttttttgagacggagttttgctcttgatgcccaggctggagtgcaatggcacagtcttggctcactgcaacctctgcctcccaggtacaagcggttctcctgcctcagcctcccgagtagctgggattacagatgcctgccaccacgcccagcctatttattttttgtatttttagtagagacgggatttcaccatgttggccagactggtctcgaactcctgagctcaggtgatctgcctg

SEQ ID NO: 170227 - DNA, 322 bp, Homo sapiens
tctcctatgttctcgtggcatgattcttcgactataccttaaccactaccacttaacttccaaggacaaaagccaacctgaattttgggggagttaagaagcagtgagaagatgatctatctgagaaacactctggggcctagagtgagtgagcaagagggtaattttttttccactaccaagaatcaaataaggaatcacggcctcagtcttaatggttcttcttcaactgtaagtatatcacttgcaaaacctgtggtggtctgttgctctcctctaccactgcaacttcaagggagccagctaactaggagaaggaaaa

SEQ ID NO: 170228 - DNA, 452 bp, Homo sapiens
gggtgtcgtgatcttgataccaagtcatcctaccagagggctgcaaagtggaacaagagaatgcttccaaagaagttaatattttgaactgtgaaacatcaccagagcaactgaggaactatttgctttttctgggaaattactgcagtcaagagagcttatctgagaaagctgcatcaagggagtaaacgttaagtgagtcaaactttagttgggaagcaaagggaattccttgtattagaagagaacaatagctactttctacagctctgaacaacccaggaagactatttgagactatgcatctcagagatataaaaattggtaagatatagaagagatgacattgaactctgtaaggtctaattctggcttagttacatactaactgtgttactttggacaagccacttatctactattgggtcttgatattcccatctgtaaaatgg

SEQ ID NO: 170229 - DNA, 349 bp, Homo sapiens
gaagggcgagtttatatcttcacagacctagtcaggaggttcatctggggccagaatcaggtgctctggggtgagccgacctcaggcaaccggagttcccaggctagggagaagcatccagaatgtcagggcgggaaaggtccccgaaacccaactctagtgaataccatatttttccgatatggaatcaggcagcacaatctcacagaggacttgcctggttgcccaggacagtgggagaaagccaggtgggtctctagatccccaggcctgaacaacattcgagttttcccttgcttccttgattaaaggctgctagagccacatgtggaggtgaaatggggaagtg

SEQ ID NO: 170230 - DNA, 355 bp, Homo sapiens
ccccactgtgggagtaggaagcgcgtcacccgggccataaatttgcggtgatggcgcctccggccgcctccccagacggagggacagggccgactccggagcaggtggggccgccgagactcgacctccgcggtaggcgctgcgcggcttctcccgacgcgggtcccgggcgcgctcggccgcccctcccgccgcatccgcccgcgcccggccccgccgcgggatttccaaagggcttttgttccgggcttggatgtagaggctttgatttttttaccacccgcctcaggagactttttgcttggaaaagtcctgctattaaaacaaaaacaaaaaccaatcaattccggaggga

SEQ ID NO: 170231 - DNA, 158 bp, Homo sapiens
acacgcgagggtccatacacttcttaaagtcagatcgctgtgacgaagttgcacacgccgaaggaccatatgtttcactgtatgtaattatacctgattttttttgttgtttgttttttgtgatggaggttcactcttgttgcccaggctggagtgca

SEQ ID NO: 170232 - DNA, 510 bp, Homo sapiens
tttcccctctttaagactgaacagtactcctgtgtgtgtgtgtctgtgtttgtgtgtgtgtgtgtacgtattctttatctattcatctgtcaatggacactttgtaaacccacctagtcttgaaactctgctgcatgtgtgatttgtaccatgaagcctccctaacatccaaagctatgatgacctctctcttctgaatgcattattgcatttaacatcattggtattttactttagtttgaatttcattatcctttaaatattgcagtcattctgtcatgtcacccactgaggagactgcacacaaactgcttgaggacaggagctgtgttatgcacaccttttgtcactcatgacagcctgttaacacactgccagacacatagccagtgctcaattacacggctgagtaggacagaccacacagttattaccccctttgagcacaccatttgtaatccagtagcacaaaggctctcatcaacgtcaacatccccagaaagagatctt

SEQ ID NO: 170233 - DNA, 670 bp, Homo sapiens
acatggatccacaaaggaaagaatcagagtattttacctagaaaatactaagagttgggtaaatcctcaggatcccagactcttccatgacatgacgctttcgtgataaataaaatcttattagaaaatacctccaagcttagagtggtcatttgattgttgccctaaagctatattgcagggctaaactctcagttaagaaccaacatctgaagacaaagatgtgtctggaaatctctcaaaagaaggatatatgctttaggctaaccaaagaaacttccagaaaaaaatggtggctaattgtctcacactgctaacaaaggcttggctggggaaaaagaaagacaaaacatagacaaagaaaaaaagagtttggccacaccaaacccataaactgacaggacccttgaatcaaaagcaagacttaaaacttagaatcatgaagttcagagagaaaaattcaactgtgtcctgcccaggaacctagccagaacccttttaaactgctgaaggactactgaagcaagtcaagccatcaagacacaaactcaggttctaaaagcagaattaagcaaggcttgaggaggggatttaaagagatgtttctctcattttttgagggccaagaaaaagttctgctagttatgcctcgaagacaaatgagttatta

SEQ ID NO: 170234 - DNA, 624 bp, Homo sapiens
ggccaacgctataaagtggtactgtgtttcattttaaagagagagggatggccaggtgcggtagctcacgcctgtaatcccagtaatttgggaggccaagatttcattttaaatgcagttataaaaccaaatattatctatacagacattaaattggtcaactgaggcttcaggccctaggccaacagaatctatatacacttttgatgtgttctatttacttatacgatcacctcaactcaagctttcacccctaagaaaaaagaatatgcactttcaccaatatgtatcctctttatctactctgtttttattttgaagtaaaaaacttcattttttttttaaagaattctctatgaaaaaagtgaaaatagaacagagttggagagcaagtcagtgctattcaggggatggcagatcttccagtgagaagggctcttcaaacgatttcatgcagatgctatgaaactatacatctgtttatcgtgaaaaaaccgaaacccctttcttcataatctgaattaaaaatagaacatggtataattattctagggaatgagggctgtgggatcatatttaatttgaagcacccctgtttaactggtatgtaaccataaccaggtc

SEQ ID NO: 170235 - DNA, 619 bp, Homo sapiens
ccacacatggaatgtggcagagtgacactgtgtgacttcagacatgaggctgcaaagaacactgcagcctccgctgtgctctctgggatccctgcgtggaggaagaggccacccatgaggacactcagcgaagacgtgcagagatgaccacgtgccaagaatccaaggcctcccgccaaagggcagcatctgcctgccggcagcacagtgcaccatctaggagatgggtcctccagccctagccgagccttcggaccacttcaccccagacaacatctagcctcacgcagccggaaccacctgtggcgaaggctaaaatgactccatcttggatgctgacccgccatgtggacttccgatgaaccctagttctgggtccttaggtcaaaacaaccttaatgttattgtaaacacaaaatcctgcccttaagcgagttacaggctgcggtgcaggtggcattcttgccttctcctgagggtggaccagcaggcggcattcttgcttcttcctgaggggtaggccagttgtcttacacatccttctgaagctcccgctccctttccctctgctacctaagccctgggtccgcgggtagcaatgcatggatctcgcggccgc

SEQ ID NO: 170236 - DNA, 351 bp, Homo sapiens
tcatcttggagtacttgaaattcccctgctgtcttcacttactgctgctgtcatccagtttctatattctctttctggttagttcattttgacaattcattccgtagctgttcagccttctcttgtgtgctaagaacaaaggatacattaggcctgacattaatgcatgccttccaagagtttatatttctagttgagaatgtagaaaagtaaaacaaataacttcagttttgtgttatttatgagagaggcatagtgatacagagcagggactgactctacctttgtaaagaactggaaataaagatggtcagagagggcttcccagggcaggtgatgtggagctaatag

SEQ ID NO: 170237 - DNA, 691 bp, Homo sapiens
tgttttacttattttctttccccatcccctagctatataaaatttaagcaggcagcacatgaataggtctctatttgaatttagtatatcataatattatagtaaactgtatagtgttcttaatttttaacctgtttttactacaacaaatcaaaacgtgacttggggagattttcataaatatttttgaggagacttttagagaaaatttaaagctacttggtagatttttgagaaacagtttcaggaatacctcatattttgttgtctctttatttatagattttcctagagcagggtgtcagcattagatagcaaattattggaccaactgctctctgaatagaagatctttgctgttttgtcagaactcagtagcagaacttttctgatattgtttgacttagcctaaagaggtgcctggagtgtaaaatttaagaagacactcattctcaggtgcgaactctgtacctcacaagcctgagaacagagtgcctccttagttttgtgcctggagtgcctcacttgccttactcttgtcctggccttgttacacatactcatattaaaatcattttttgagctcttcattcttgttttagtgaagaactgaaaagcttgggcttaagaggtagccaacacacatagatacatacctactttttattttgaatttatacttttcatctca

SEQ ID NO: 170238 - DNA, 779 bp, Homo sapiens
atgctcttattgttgaaattctttgaatgttgtatattactccgattatgtagaatgaaagtatgaagggactagggccaggagagaaaatgtcagatactaagttagtggtccatgtggacttgcagtagagggtatgtgagaggaagaaggaggagatggacacatacatgcaaaataatgactttcagaattaatggcttttacccctgtcactaaaatcagacatcggaaaattgacttagacagccaaatggtattgtaagttctcattcactatttggaagtgttgaggcctgatcggtgtttcctctgaagacctctggttctataatggtaaacattttgctccgtagtggattgttggctttaacatttgatagcagtactttaattaactgttatataattttgtagataattaaatgacaatttatttctttcaagctccataggaaactcattgctaatttagcaaaacttggagcatctcattcaagatagaaaaatccatttgaaactgaaattgacttattgattaaaggaattttcattataaagcagattatggaaaatatgggaaatgcagtaaaataaagagaagtgaagatcacttagtgttttatttatagagtatatcttatggaattagaagtttattaaaaagataatcactcctgtaagtcttctttaagagttgatgcttactctaaggttatatgagcatctttatgtccataatatacatcattgatcatatagactggtttgattttatg

SEQ ID NO: 170239 - DNA, 320 bp, Homo sapiens
ggactttcgaggatcccgcggcagcgagcacagtgctcaagatagaaaaatccatttgaaactgaaattgacttattgattaaaggaattttcattataaagcagattatggaaaatatgggaaatgcagtaaaataaagagaagtgaagatcacttagtgttttatttatagagtatatcttatggaattagaagtttattaaaaagataatcactcctgtaagtcttctttaagagttgatgcttactctaaggttatatgagcatctttatgtccataatatacatcattgatcatatagactggtttgattttatg

SEQ ID NO: 170240 - DNA, 440 bp, Homo sapiens
  misc_feature (100)..(101): n is a, c, g, or t
  misc_feature (119)..(119): n is a, c, g, or t
gggagatctgcctgggcatcaagcagagaaggcctcaatccaccactatctctgcacaggaagggttaggaaactcaagctcctgccccgggcaggttgnngctccaaatgcatggagntctgcctggatgtggagtgaagaggcccccctgcatcaccatctctacacaggaaggatggcagtagctcaggctgctgaaccaggtgcctggataaacaagaaattctgaacactttgagtctggaaattttcagaacacctagacagcatcagtcataactccatacctgtgtgagactggaagactggatagggctgaagttggagaaatgccttttcccagggttgtcagactgtcatttgttctgatgaagaccccgcactccttgagtggtcagccagttttatcccagggcagccacacttcagaggcctctgc

SEQ ID NO: 170241 - DNA, 481 bp, Homo sapiens
tgtgcacaatgaaatgtgttccaaaatctaaaagcaaatcacaggatggagaaaacctttaatgaacacagctaataagagctcattaacattcatacatatatatgtacaaatatatcatagtaagtaccatttcttcttggatccttcctggcactgtgctaactgctttctacaaatttagcttacataaacccttgatacacccttgaggtgagtaggtattatctatagtttacataagatgaaatagagcctcccagcagttaagtaacttgtgtgaagatgggacccttgttcctgatggttctagaaccttcatccttaatgataatgctaaagtaagtacatgaattgcctgaagaagtggtcagagtttatcaatagaaaatttagatagtactcagcgtgtggaaaatgtacatttatggaaatgataatgttcactatctctgatattctatgatcttttacattagca

SEQ ID NO: 170242 - DNA, 186 bp, Homo sapiens
aaatgccagtgggacagcaatacagcaattaaaggataaggcaggtaaggaccagatcatgttggacctggtcagcttcccttttaaaaggtttctattttgatctcagaaccataagaagacatggaagtatttccaacaaaaggatggcatgacatttataggctgactgtatttgtgttgttt

SEQ ID NO: 170243 - DNA, 383 bp, Homo sapiens
aagtaaaagtttcatctctgatgggctctggccagcgctgccccccgggccttctgctctagaagcccatggtgatcctcatgtgccattcacctggctacttggccctaatttcacacagttcgaagcccagaaacctgctgtttgagcctaccttcccagagtccttccttctttcatgaattgaacaaacattcattgaacacctgctttttgccagagattatgtgaggcatgggatatggcagcaaataagtcaactttgctgtcaatatatgtcatagtagtcattgttgagttgaggcatttctatttggctattagtagcattggtttagaaagagcctcaaaaccctctctagtggacttcttgtgagaacact

SEQ ID NO: 170244 - DNA, 632 bp, Homo sapiens
tggtagacaggtccctgacgataaagtggatggtgggatccacctagaagagaaggcagcacgctgagccctgagtgttacttctggaaggaaaaacaaataggtcccctgttccccactgtcaggagtaaccccagaaagccagtgtggattaaaagacccgggatgttgctgcatgtggtggtgtgcacctgtagtcctagagctactcaagaggctgaggcaggaggatagcttgagcccaggagtttgaggctacagtgagctactgttgcaccactgcactccagcccaggcaacagagcaagatcctgtctcttaaagacccaagaagcggctggatacagagacttatgcctgtaatcctagcactttgggaggccaaggcaggcacatcacctgaggtcaggagtttgagaccaacccgggcaatatggcaaaaccccgtctctactaaaaatacaaaaattagtcagacgtggtggcacatccctgtaatcccagctacttgggatgctgaggcaggagaattccttgaacccaggaggcggaggttgcagtgaactgagatagcaccactgcactccagccttggcaacagagcaagactctgtctcaaaaaaaaaaaaaaa

SEQ ID NO: 170245 - DNA, 531 bp, Homo sapiens
gagtgctcaaaaactttataaactttgagttattcttacaatagaactttagcttaagtaagtagaaactcatataatgatttaagtattagaatttcctacaacaatatttagattaaaattgttaataaaatacatgtccagtaataatggattggctaagttaatactatctgtctgaatttatatttatatattcagtaaagatcagcttaagtaccatttccatttgagagtctcagctttaaatgtaaaagcttgacaaactcaaactaatgccccaactaaatgtgtcactccaaacctgataacaaagccccagccacattgacattgtttatgttctttgaacatgccaaacttattaatacctagagccttggcactccagtcactattatattttctatttccttatttttattaatgttatcactactttgaaatgattcatttgatttctttctcttaattatcatctccttctactgaaatataaactatgagcattagggtatggcttactttctt

SEQ ID NO: 170246 - DNA, 895 bp, Homo sapiens
cttctgggttctaaagccaagtggtatgatgtggacatgaaaatggggcactcattgcagagatacttttgactgggtttgaagtaacaggagaggtctaagagaaacacgaacaggaataggagagaggcaaaacagagggctgacatctagaaactctcctgagaaaaataacactgactgacgtgggtaaatctgagggattataaagcaggcagaaaaccccaccaaggaaatgacgagatatccttctttagatgcctccaaaacagaagatgtgctgtttggcataagtgccatccagggcactcagacctgacaggagagtctacagagaccccatagaaccaagcaactggtgttctaaagctcttcccctaatggcccagggctgaggaaaaagcaaagccataacatcctcagggtcacaatagtacactgcataaaagccgctctgtgctgggcactacggagagcagaggagatgagaaagcacttacacaagtggagatggcccccacacaaggggaagacagttgggagggcctcagtgctgaccacagtgtggccccaccacgactcagactccaaggcccagtttctattccccaaagttggtcaccttagcccaccatactcagcatatttctcagaactgggatttctcaaaactggtcagtaaaaacaatttaagcaaagaggaaagtgaggatatcttgggtggtagagggaaaatgggaccttttcccaaatagatagcgagcatcctactttcgtacatcttcccatggctcaggcacaagaaagagtacactttttggagaaacgaaagttctgaagtccacgttcacagacagccaagaacccagatccctgagctcctcgtctgaacgcc

SEQ ID NO: 170247 - DNA, 573 bp, Homo sapiens
ataacatgatagaatcgagctcggtacaagcaactggtgttctaaagctcttcccctaatggcccagggctgaggaaaaagcaaagccataacatcctcagggtcacaatagtacactgcataaaagccgctctgtgctgggcactacggagagcagaggagatgagaaagcacttacacaagtggagatggcccccacacaaggggaagacagttgggagggcctcagtgctgaccacagtgtggccccaccacgactcagactccaaggcccagtttctattccccaaagttggtcaccttagcccaccatactcagcatatttctcagaactgggatttctcaaaactggtcagtaaaaacaatttaagcaaagaggaaagtgaggatatcttgggtggtagagggaaaatgggaccttttcccaaatagatagcgagcatcctactttcgtacatcttcccatggctcaggcacaagaaagagtacactttttggagaaacgaaagttctgaagtccacgttcacagacagccaagaacccagatccctgagctcctcgtctgaacgcc

SEQ ID NO: 170248 - DNA, 262 bp, Homo sapiens
gaagatttaatgtaattttttatttggtaaatggaaaaataatgtttttccaaaaaacagattacagatcataaagttagacaaaatcttttctcctagagtgatatatctgcatttgtaagactaaagaaagctttaggtttatcaaaagagcacaaatggttttattaggttggtgcaaaagtaattgtgtttttttaccattaaaagtaatggcaaaaattgcagttacttttgcatcaacctaaataagagttggaca

SEQ ID NO: 170249 - DNA, 561 bp, Homo sapiens
agaagtctgcttgctttcattgttcacatttgccttttaccaccgcgttgaggtttcggcccccttgggcctgaccgcagggcagtgtgaaggggcgaggtttcacctttcccctgaggatattcaagcgaccccccgccctgcagtgctgcctccgtcctgagtccagaagggcaggcctcccggtctttctggggtgcgattccagtggtctgttgctcccatgggtgagacactgccgtctctgagaggcacgctccccatgggcagagcctgagctgacctgtggcctggcctcagggctggttctcctaactcctaggaacctgtcggagacccagccccaagctaatgggaataacaagactcccccttcttgatggggcctgaccccacctcttgtccctgcaatctcacaaggcttgcaaaagccctgctcggctaccagcttctcggccaccccttccagaatcggcagccacaggaaaaggcggtttccccattccccacggctgctttgcacgctctctgcaggccttcgagatgctcctggaggggaag

SEQ ID NO: 170250 - DNA, 795 bp, Homo sapiens
cctcagaggattccaggcaaagctctaccttccctttgaaacgaaggtagggttgtagagagatgcagctttttggggaagtctacccttgaggatcggtattccataggacgtcattccgggatgggcagaacctctcctcaaacccttcccattcccaaactgcaaagaatgtaatggatttagtttcgattaggcaagcattgtgtgaggatttagaatttatcttggaagggcagagatatttttctgagaaggccagttgcctctggttttggagatccccacaggatatgacaagacaggcatcaaatgtgattgaggtgagcttgatctagttacattaatgataaaatagctgacggtagagagaggaaagaagacaaggcagtataagagggttaaagttttcgtagctttaggttggtagaaattggccctggaacaatagcccatgactctgaagatggtgatgctgttttgactggggtatgatgggtccaccccttttcggctgttcgggctgctgtttcagttaggagtgctaggtatggtccttcccaagctggctccttccagcttttgataaggatgtgatctccaggctggtattgatgtaccaggaactgtaagggtggcatctgtgctaaaatacctttagttctgaggtaagagaaagtggaaagccaagtatataatttgatcctttgtttcaaaggtaggaatgtcagtagtaagagtgtaaataaggcagtccacataacagagagataggccagtatctttctgagaggc

SEQ ID NO: 170251 - DNA, 886 bp, Homo sapiens
ggtgactatagaccgaaatagagcacacattaggtatacagcttagacggtgatgacctcaacggactaacgtgacataagtatggtgacaatacttcttgcatgtatctgcaggtggaattgtaaacctggtggtccgagatggtctaattccatcttcctatgtatctccttatattagtagtggtaacatttgtggtggtgattcagcatttcaatgcctcttctcatggcaacaacaaacgttttccttctgaatcaacattaacctagatgttactgcggatcaaaattagactctacattttcaaccacagaaataccgggcagagatatttttctgagaaggccagttgcctctggttttggagatccccacaggatatgacaagacaggcatcaaatgtgattgaggtgagcttgatctagttacattaatgataaaatagctgacggtagagagaggaaagaagacaaggcagtataagagggttaaagttttcgtagctttaggttggtagaaattggccctggaacaatagcccatgactctgaagatggtgatgctgttttgactggggtatgatgggtccaccccttttcggctgttcgggctgctgtttcagttaggagtgctaggtatggtccttcccaagctggctccttccagcttttgataaggatgtgatctccaggctggtattgatgtaccaggaactgtaagggtggcatctgtgctaaaatacctttagttctgaggtaagagaaagtggaaagccaagtatataatttgatcctttgtttcaaaggtaggaatgtcagtagtaagagtgtaaataaggcagtccacataacagagagataggccagtatctttctgagaggc

SEQ ID NO: 170252 - DNA, 301 bp, Homo sapiens
tattggcaattagagggggccttccctttgaaacgaaggtagggttgtagagagatgcagctttttggggaagtctacccttgaggatcggtattccataggacgtcattccgggatgggcagaacctctcctcaaacccttcccattcccaaactgcaaagaatgtaatggatttagtttcgattaggcaagcattgtgtgaggatttagaatttatcttggaagggcagagatatttttctgagaaggccagttgcctctggttttggagatccccacaggatatgacaagacaggcat

SEQ ID NO: 170253 - DNA, 408 bp, Homo sapiens
acgaggtcaggagatcaaaaccatcgtggctaacacggtgaaaccccgtatctactaaaaataccaaaaattatctgggcgtggtggcgggtgcctgtagtcccagctacttgggaggctgacgcaggcgaattgcatgaactcaggaggcagaggttgcaatgagccaagatcgtgccactgcactccagcctgggcgactaagtgagattctgtcaaaaaaaatagaaaagaaaagaaaagcaaatagaagtaataagttcttatcaatcagtaattcctttaaatatatatttagttattcaataaaaacattgctatagtgtgagcatcccctccaaaattcacgttaaaatttaactaccattgtgagaaaattaagaaatgaggcccttaataagttattag

SEQ ID NO: 170254 - DNA, 668 bp, Homo sapiens
  misc_feature (545)..(545): n is a, c, g, or t
ccacttttccaagtgataaaatctagtataacgtgtgtccaatcattgatacactcaacaatcaatattcattgaccataaaaggctaataacagcctgaagttactgtgtgattaatttagtgtttcacactccaagttaaaatatttgactgtccagaagcctttagtgtgttttctttctttcttctaaagtctacaacatttcaatgaagcggaatttacttgatcataaatagatgacctgcaggccattatttttgtagtaaccagaaatagaacacagctctttgaaaatgattaactagaagaatacaatgtttttcgctagtgtgggaacataccgctttcctcaatggaatacatctgcaattctcttaaccagcgacaaaccgaaaaagcaagtcaggctcacaagaaggagtgatagccgatggctttatggctttagtggagcatattttccccttaatagattgattatttatttaaataaagctttggatttaatcttaattacattctcctctttagaccccgagctgnggaggaaaaggaagtgttgagatattccatgccacttttaggtcaaaagatagaaagctccaaagataggaactgagttcagagaacgcaataggaacaccgatttcaaaaaatatcagcaat

SEQ ID NO: 170255 - DNA, 385 bp, Homo sapiens
acccaatggaatcccaggagcagtcaagggcagtgtcccatgcaacacggtctcccattctgtgaggggaggaaggttggatggctggagtatggagactacggaatgttctgaaaaagtttcagcaagggtaatggagggtcctagacccaaagtgacctgttagagacacccaagaacagatcttaggatacctgctgtattcaaccattctctggaagcagccatgagcagtgtgtcctctgcatccacgtagtgatagatatcagaacttgccatctagaaccgtgttcaaccacactctctgcaagtagaaaacctaaaagattccttctcatggccaccacaaccagctatggttaacaaaaggattccataaaatggg

SEQ ID NO: 170256 - DNA, 219 bp, Homo sapiens
cccctgccagaatacaccctgtctaaatcaggggttgataaagacagcccatgtgccaaatctggtcgccgctggttctagtaaatagttttattataacacagccacgcctattcatttacatattgtctaaggctgttttcaagtttgagcagcaaagttgagaaatgtagttataacagagaccatatggcctgcaaggcctacagtattttcttt

SEQ ID NO: 170257 - DNA, 125 bp, Homo sapiens
gcaataacagacatccgttctctcttgtcgagttaaaggtccgtttcggtcagcaagtacttaggacttgcatggctgccagagccaggtgtgctattcatctgggcttctccaggccaaagtcg

SEQ ID NO: 170258 - DNA, 236 bp, Homo sapiens
cgccttggcctcccaaagtgctgggattgcaggtgtgagccaccatgtctggcctaggtttactttcaagtgccatcttttcttggttagtcatagttgcacagagcactaattactgattttgtgacctagtactacagtgattatatttgccatagacatgagaatgggaattatggtgggactgttcccagatagtatccatcctgctgtttctaggacatgtttatgcatat

SEQ ID NO: 170259 - DNA, 499 bp, Homo sapiens
acttgcctttagactgtgatgcaggtttgacccgtgacaaaggaaagtgggaagaaaggagaattggggaggaacagcctcacattgcagcatagctctgaaaaaaatcccagccagccaagtagggagctctggtgcaaagctcacccatgtgtaaagattgtcctgtgctggccataaatggtgagccattgtaccaccattatgttcagtcataggctgagaactacctgggaagcacatggccttgactctaaaactgaacagaccctaaagcaacctgcaacttgaggctgtcagataattgcaccccttgactagtttctctcttgaagggagatctgaatggtacaccttcatgtctgccatagtaggcatttttctttgatataatcacagaagactcgggacacttagaacagggcttgacaaattatgatctgtgagccaaatccagcctgctgcatgttttttgtaaataaagttttgtgggaacaca

SEQ ID NO: 170260 - DNA, 320 bp, Homo sapiens
ctggagggtatcctagacagatgcttagagaagatggagtgtgagcattacagaccgagaacggcttcagcaggcaggcgaggttgcaggggaaaaggcgcttctagcaaagggaaccacttgaggccagatccagaggcagaagctaccagatctgtgtgaggacagatgatcagtccagcgcacgtgatggggacatgggggaacaaggtaggagatgaatctgaaatgtacctggagaggaatggtggatgcctttcaatgccagctgcaacttcatgctggacacacttggtaactgaattttgccccagtgcaca

SEQ ID NO: 170261 - DNA, 886 bp, Homo sapiens
taaatattttgtgccgcttgatatttttctcattatggatcaaaatttggctttctggtgtagttcattctcttgtaaacccattattggctattgtgtaactgagatcaatagtagtagaagtggtggtaatggataacattgatccatccaacgaatattttattgaatgtttattttgtgccaggtattgccctgtgctctgggaattcaccatgaacaaaacaggcaaaagtttctacctttgaggagcgtatattctaatggggaagaccaacaataaatgaagaagcaaacaaaacatgtattttattagttggtaataaatgcaataaagaaaaagaaaatagagatggaagataggaaatggggataggatgagcactgagatttatatatgaatgaatatatatgtttatatatacatatacatgcatatgtagatatacacacacgtatgtatatgtatatacgtatgcaaatacctagagaaagtctcactgaaaagtgatatttgacctagaggaggtgagggatatctgcatgaagagtgtcccaggcaaagtcagaagcttggtgagttcaagaaacagcaggccgggcgtgatggctcatgcctgtaatcccagcactttgggaggctgaggcgggcagatcacttgaggtcaggagttcgagaccagcctggccaacatggtgaaaccctgtctctattaaaaatacaaaaattagctgggcatagtggcacgtgcctgtaatcccagctacttgggaggctgaggcaggagaatcacttgaatctgggagacggaggttgcagtgagtggagatcatgccgctgcattccagcctgggcaacagagggagactctgtctcaaaaagaaa

SEQ ID NO: 170262 - DNA, 334 bp, Homo sapiens
aatgaatgggcttagaaaactagaaagcactgtccaaaagaccagtgtagatattatttcctagagattgcctttaataaagaacaggaagtactagaaaatcacctaagatatgaacatgcagttgacagaaaatatacatggctcttaagcatatgacaagatgcttatccttactgctaataagagatacaaactagcctcaagacattggttttacctgttcaattagtgaagttgataatactgttactttctatggagaagactactgttgagggaatggctgaggtgagaagcagagcctcctcctgtcgctgatggcagtataagt

SEQ ID NO: 170263 - DNA, 194 bp, Homo sapiens
ggaaggccaagcacagtggctcacacctgtcatcccagcaccctgggaggccaaagtgagagaatcacttgaggccaggagtttgagtctggcctgggcagcatagtgagatgccacctctacaacaaattttaaaaattagccaggtatggccagacgcggtagctcactcctgtaatcccagcactttggga

SEQ ID NO: 170264 - DNA, 707 bp, Homo sapiens
tgacagggtcttacactctcatccaggctggagtgtgcagtcgtgatctcagcttattgcaacctctgcctcctgggctcaagcgatctttccacctcagtctcctgtgtagttggaaccacaagcgtgtgccaccacacccgactaatttttgtatatttagtagagacggggtttcaccatgttgttcaggctgatctcaaactcccagactcaagcgatccacccaccttggcctcccacagtgctgggattataggcatgagccaacacgcctggccaattccatttatttctgatataaaatacaaacatatccagttaaaatagaaaattctgtcaaacatgtcaatgtatccaaagtaatattttagaatttcaaaattaagtcttactcaacatttgaatttgttcaattcccctccctcccactgtttttacagggatgaatttcagtgcctttctgggtacaagcttgattttgtttttcttttttcaatagcagggtctcactatgttgcccaggctggactcctgggatcaagccatccttccacctgagccttccaagtagctggggctacaggaatgagcctgattttcaataattgcaatttgctaagcttttaaaagctccaggttttggtgaccaatttttgaaccttttcattaagatttccaacagattctgaacagaatgcaacaaa

SEQ ID NO: 170265 - DNA, 367 bp, Homo sapiens
agtcaggacctgctgcctccaagtccgtggtacatcatctacctgtggaaagttccctgacatcccctgccattgtcccttctccttcgttcaccttacggtatcgattgagagcccatggaatatccagcacttgattgatcaaaagcagacacggtcctgccctcatggagctcccaggcctgggaaaggcagatcctggagagagcagctgtatcccaccataccagggcccacccacactctgcacctaagaggctcacgggtgtttacaatagacagtgcttggtgcataaatcacctcgtttgaccctcagcagcctgggacattggcaaccaggtatgatcccattttacagatgcagag

SEQ ID NO: 170266 - DNA, 247 bp, Homo sapiens
tctacagatccctaccgtctttaaatatcaatcattttcatttggagagtatgctttggttttgtttttcattttcactatgctctttttaataatacagggaagtagctccattttagaaagatttccatcaaaacagataaaaatgaaaggttcagcccaggaaactcaagctcagctctcctgcaatattctacaaccaggcattactcaaactactagaatgtcagcatttctaaccctccag

SEQ ID NO: 170267 - DNA, 681 bp, Homo sapiens
tttgccccacccaggactggcaaattagctttactcaacatgccccgagtcggataactaaaatacctcttagtctaggtagacactttcactggataggtagaggcctttcctacagggtctgagaaggccaccacagtcatttctacccttctgtcagacataattcctcagtttagccttcccatctcaatacagtctgataacagaccagcctttattagtcaaatcagccagcagtttttcaggctcttagtattcagtgaaacctttatatccctcacggtcctgcgtcttcaagaaaagtagaatagactaaaggtcttttaaaaacacacctcaccaagctcagccaccaacttaaaaaggactggacaatacttttaccactttcccttctcagaattcaggcctgtcctcagaatgctacagggtacagcccatttaagctcctgtatagacgctcctttttattaggccccagtctcattccagacaccagaccgactttgactgtgccccaaaaaaaattgtcatccctactatcttctgtctagtcatactcctattcaccgttctcaactactcatacatgccttgctcttgtttacactgccggtttacactgtttctccaagccatcacagctgatatctcctcctgctatccccaaactgccac

SEQ ID NO: 170268 - DNA, 506 bp, Homo sapiens
cggcacgaggcgggacatcccagagctgccacacacggagctggaggcccttgctgttgaagaaacactttctcagctgtgctcagagctacagatgttgaacaatccagagaagatcgctgagcagataagcaaggatctggcctggctcacgtcccacatgatgactctgtggacccagttcctggacacagtcactctgcactcccaagtgaccacttatctcacccaggaacaccacaccctgagggtgagtggccaactgctgtgcattctctgatcacatgcatttgatttctttggaggaacctttatgagaattagatcaagcattaggattggcctctagatcttcgtgctttcgtgtctctaccatgaccgtgcagggtggcgttgtgaacttccttagcctctcaggcctttgctgtgtcattcatagaatacttgccttggcaatctcagaggatttcagagcctatcacaagaaatattaaaagtattttgga

SEQ ID NO: 170269 - DNA, 265 bp, Homo sapiens
ccagattattttgtcccacacggtgttcccgtgatgtggtactctcccccttttcctaagaggaagacctcctgagagtcagactatagtgattgctattacagccagaagttttgcttgacgccagaacacagttaacagcccagcccaactagagaacatgcaaggtctacctgtcaccacctactggcccaactagaatcctaggctatactaaatagtgaagatctgcacagccaaagaataccagcaaagactggaaagt

SEQ ID NO: 170270 - DNA, 342 bp, Homo sapiens
gaggtttttgccaaggactccaaggggagtgcacttgatgctggtcgggacccaaagcacccagccctccctgagacattgtgtgagtcgggctgggcctcaaacacggcccccactgccccaccccagccagggtggtgcttgtgtgggaaggactttaaatccagctgccagacccctggacgggagaaggagagacggctggccaccatgcacggctcctgcagtttcctgatgcttctgctgccgctactgctactgctggtggccaccacaggccccgttggagccctcacagatgaggagaaacgtttgatggtggagctgcacaacctctaccgg

SEQ ID NO: 170271 - DNA, 278 bp, Homo sapiens
ggaaataaaaatataaagcagaggctgagcatggtggctcacacccataatcccaatacttggggagtccgagacaggcagattgcagattgcttgagcccaggagttcaagaccaacctggccaacatagtgaaaccccatctcttaaaaaaaaaattagctgggggtggtggcacatgcctctagtcccagctacccaggaggctaagatgggaggatcacctgagcttgggaggtcaaggctgcagtgagctgtgattgcactactgcactccag

SEQ ID NO: 170272 - DNA, 319 bp, Homo sapiens
gaacttcctgagtagctgggactacaggcacgcgccaccacgcccggctaatttttgtatttttagtagagacgaggtttcaccatgttggccaggctggtcttgaactcctggcctcaagtgatccgtccacctcggcctcccaaagtgctgagattataggcatgatccattgcccccagcctgttgaggtttttttttaaatcaggtatataatcaggtatatgctttgcaaatattttctcccagcgtattacttgtctattttcttaacagtttctttcaaagaatagagttaaaaagattttttgtatctttt

SEQ ID NO: 170273 - DNA, 467 bp, Homo sapiens
atggtggaaggtagaagggcaagagagtgcatatgtgcgtgacagaaaaagagagagaagtgggggtggactcactttttaatcaggaacctactcctgcaataactaactcttgcaataatgacattaattcattcatgagggcagaactctcctgacccagtcacttcttaaaggttccattgctcaacattgttgcactggagattaagtttccaacacatgaactctgggggacacattcagaccacagtacctaccatatcaggcagtaactttaatttaagttctaggctgagcatgttcatttgcatacatcatctttttatccacacagtaatgctcttcctgcatctatattgctactttcctttcccacataaaatttgggaactatattttaaaaatcaccacagatgggaagattgtttcctgaaaacagtctttttttttcagataatatctcc

SEQ ID NO: 170274 - DNA, 820 bp, Homo sapiens
ttcatgatagctgaaaagcataaacagcccagctgttcatcagctgatgagttgataaacaaaatgtgatgtagccctacaatggaataccatgaaatgacaaaaaggaacaaactactgatacgtatatattacaataaatgaacctcaaaaacatactaagtgaaagaaggcagatacaagggaccttatattgtatgactccacttatgtgacttgtctagaaaaggcaagtctgtagaggtagagaatagattattggttctagggctggaaatggggagtgattgcgaatggacattgagggatcttattgaagcaacaaaaatgttctaaactggatgatggtggtggttgtgcaattcagtgaacttaataaaaattattgacttgttcacttcaaatgggtgaatcttatatgtaaattatacctcagttttaaaaataaaagggatcgttaaaattgaatataattttactttgaaaaattaaccaaaaaacaaaaaaatacaaaaaaattttaaagacaacccattgtgtagcaattagaagtgcaataactttgtccttccaatttgtattttttacactttcaatattatacagtttaagaaaattataaaaaatacagagaaaatcatttgcaatttctccatacaaatacatcagttctcttttttcttgttctttccattaattatctatgcatttactttacatattaacagtactataacaataatctagatacaaatttgcattctgatttttttaattttaatggtataaatatttttccttgtttcaacatagtcctcat

SEQ ID NO: 170275 - DNA, 484 bp, Homo sapiens
agtgtactttcatttcaataaatctgtgctttcactgcttaaaacaaaacaaaacaaaaaaaccttaaaactaatacttcatactgcattttgaagtcagtaaaagctccaggcatagagataaaatttagaaaaatggaatacagtccaatcaattccaagttctttaagggcttataaaagactctgcaggacgagcttacacctataatcctagcactgtgggagaccaaggcgggaggatcacttgagcccggagttcaagaccagcctgggcaacaatacgagacactgtctctataaaaaaatttaaaaattagccgggtgtggtgggcccgtggtcccagctacttgggaagttgaagtggaaagatcgcttgagcctgggagattgaggctgcagtgagccatgattgcaccactgcattccagtctaggcaacaagagcgaaactctgtcaaaaaagaagaagaccttgcatatg

SEQ ID NO: 170276 - DNA, 387 bp, Homo sapiens
tgaatgactaactgaatgtggaattgaatctcaggccaaccatttgtgtttttaattattttatttttattgttctttatttatttttgagacagggtgtcactctgtcctccaggctggagtgcactggtgcagtcgtggctcactgcagcctcaactttccaggctcaggtgatcctcccacctcagcctcctgagtagctgggactgactacaggcacgcgccaccacacctgggtaatttttttttttttttttagatacagggcctcactgtgttggccaggctggtcttggacccctgagctgaagtgatccgctcactttggcctcccaaagtgctgggtttacaggcgtgcaccatggcacccggtctgtttttctttc

SEQ ID NO: 170277 - DNA, 204 bp, Homo sapiens
ggtaattacttaactatgcctacatcttagcagaatttaggcccctctcattctcccaacctggtttcttttcattggttttacaaaggtggtttagtttttgaaagagctattatctcttaaactataaactaaatttcttccaaacttaacttggtccatgctcaggaacagctaagggtagtttgaaggttaaagaaaaga

SEQ ID NO: 170278 - DNA, 397 bp, Homo sapiens
ctctgaattaaccaggttagaattggcagtttcttcagggaggcattactaatcaaacaggctcagaatcagaggtccaaggaaagaatgtttattttggtcaaattccaagtttattgtgggagcctttgagaggagccgcagacagcctttcacttttgaccataaaatgttttactacaaggatcattattctttaatcttaagtaaactgatgaaaggtatactgactgcagtctctggattataagaaccaaccagatttgactgttgcctgccatgtttcaaccacatagatcgtcagtggtgtgtggacgggattccctctagctgtcttgctgggagtgaggctatgtagtccggcctgactgaagatgcccttgcgcaccaggctttt

SEQ ID NO: 170279 - DNA, 288 bp, Homo sapiens
cagggctggtagccggattttcagagtctggcacagcctccctgtgtccagcagagggcgccagggaccgggctgagtaagcatgccggccgtcttggaagagccggtggcaaccttattctgagacaagatatttgcccggtggccttcctggtcagttaacttccacttttgccctggccttttccagtgtgggaagccccatgctccccctcactgggaattatttctgggtggtgtgcatccaatcctgaaagtgttggggaggagggagggcaacagaaggga

SEQ ID NO: 170280 - DNA, 377 bp, Homo sapiens
tcccttttgcaatacacaaaacgctctgagaacatttcttctcactgtgaccaaggccaccaataaataaagaagagatcacaaacatcctttggcgtctctgtacaagtgacttcagtaaaaatgacaaaattcttcccaattaatcatgagacaatcaaatatacatattttttaaaatgaactgcatgttaaccaactgagagcctttagttccttaacatgtttttattttcacaaccctttacattgatgcttttcttcaagttccaacaaacaatctgctcacggtcactggtggccacagccgcgggccacactgggagttgaggttcacactgaacgtggttagctagatgtctaaaacaaagcaacga

SEQ ID NO: 170281 - DNA, 413 bp, Homo sapiens
gagtctacaactagtaggggagcaaagcatgaaaataatcagctagagagagaaggtgttggatattccagtaaaggtatttgcaagtgtgcaagataaaaggagcacagaggagggcagcatccaggcgacatgtctcaaaggtgaactcgagtttggtgacatatgaggaggagaaaggaaggcaagtcaatgagacatttactgtgtaaagacacagaaatttgagacactgtggcacttttgggaactacaaataattctttgtgatgatgggtggtacggctaaatggaaattaataccttggaatggagtgggagtcacaaaaggccttaactaccagggagaggagtttgaagtgcatcaggggttcctacactagagcctgtggccctggggctctggggctgtg

SEQ ID NO: 170282 - DNA, 153 bp, Homo sapiens
cacacttaattatgtgttccagagatgggagctagacacatgtaaactgacatgctaccagcaataacttcttctcctgtgagaaataatctatagtaagagaaaggcaataaataatgatacacactgaacagctatgttcagtccacaggc

SEQ ID NO: 170283 - DNA, 268 bp, Homo sapiens
tcaaaattgctctgatcgcttaagcccaggaggtcaaagctgcaatgggccatcatccccaaaaacaggctggccagctgggcgtggtggctcacgcctgtaatcccagcacttttgggaagccgaggcggatgggtcacctgaggtcaggagtttgagaccagcctggccaacatgaagaaaccctgtctctactaaaaatacaaaaattagctgggcgtggcggtgggcgcctgtaatcccagctactcgggatgctgaggcatga

SEQ ID NO: 170284 - DNA, 649 bp, Homo sapiens
caggacctgtgatgtatgcccaacacgctgagctattttttgtatttttaggagaggcgaggtttcactatgttggccaagatggtctcgaactcctgacctcaagcgatccacccaccttggctccgaaagtgctgggattacaggtatgagccactgcgccgggccatgcaccacatttttaatccattcatctgccaatggacactggttgattccacatcttggctgttgtgaacagtgctgcaatcaacatgggagtgcagatatctctttgatatgctgatttcctttcctttggttagacaacctgtgagaaaatgatctgctctaagagcatatacaatttggatatttgcagaggtctcagatgaaatcttcagtgatgaggccacatctatcccggctcgctcaaggattgttggttgcattgtttccattacaacccagctggatccttgctgggttcctgccagcagcttccacacacctggagtgggttggcttttcctgcaggtttgcttctatgccagctcctgggagcagttgtctaccaggacacacctggggagctgataaacacacaaaagaaacatgtctggctccccagccagatggcaaggcctgaaacccctgagcgttttggaca

SEQ ID NO: 170285 - DNA, 500 bp, Homo sapiens
aaataacactgattttcaaagtcgttttaaaaggcagcttttggcagctgctatcttttgcatattctctttccgagattaaagaaccttcaggtgacaacacctagggtaaaaggatgggacatcaggctgcagacgtgcgtatgcgtgtgtgcacacgcgtgcagtcttgactaggtgtggaaaaaaggtccgaagagattccaaaatcaaaaaaattcccttggcctactccggccccgaagaccaactcagaccccaccagacaaactggaaagtctccaagctctcagtcgccccagtcggcgggggagtgagtggggccgaccggccttgcggccctgccacctttcggggcgactcggtttctccactgacacccccgggcgcgaggtctggtccatcccggagtgggagctaggcagggacgccacctggcagcccactctgggcccctggcccgcgtttcccgcaggcgccggcggcgtcgggcgcggccg

SEQ ID NO: 170286 - DNA, 176 bp, Homo sapiens
attaatatggacaggtgatgtggtagaattgtatgcatttagatcttagtgtgaataagaggtgtcccaagctacccttatgttaatggtgatatgatattttttatatatttgttgtttttatttatcgatttattttgtttgtttgtttgtttttgagacaggatctcactctg

SEQ ID NO: 170287 - DNA, 531 bp, Homo sapiens
catgctttcagtattggtgtatttttcaggttttactgggaaccagcctccttttaaaaataaataattgaaaccaaaatgtactttatatatttatttttgccaactgagagattatgcaaggaggaactcattttactttactttttttgagacagggtcttgctctgttgcacaggctggaatgcagtggtgcagtcatggctcactgcaaccttgacctcccggaccctagggagcctcccacttcagccttctgagtagctaggactacaggcgcatgccaccacaccctgctaatattttattttttggagagacggggtttcgctatgttgcccaggctggtctcaaactcctgggcccaagttatccttctgcctctccctcccaaagtgaagtgctgggataacgggtgtgaggcgctgcgcccagcctcattttttttcttagtcctgggcctgcttattgtttcacactttattattcgtgagcagttgtatacatgtttgtgacatgcgtctattacca

SEQ ID NO: 170288 - DNA, 445 bp, Homo sapiens
ggggaaatgcctagagtgcaacatttaaggaacaaaggactcactctcagggttttaagtgcttcctttaatgttgcatcctaggcacctctatggggctcactgctcagtacacagacactcaaggtgttattgccagttaaacagaaaagaagtttactgttttcttctttgctcacttgtccctgtgtgctgtttagctggagacaggggcaggaaacaagtcccagaggtcactccactgggactttcttaggagccataaatgctctcaggctcatcgtgtctgcagcgcagtgggagtctcccatctgtggttgaaggaatggatggaagtgtgtgagctagattgcacagatagcaagcagaacatttctggtgaacttggacacacagacacgtggaagttactgtaaccacctggattgcaagaaacctttccttt

SEQ ID NO: 170289 - DNA, 173 bp, Homo sapiens
tcctatgctttccagtatatctagaggataaccaatatagattctgcctttgaattagatagctaatttttctgtggaacattatggattgatttggggcaagaatcttaataaaagttgaaaaagtgttgctacttgtgtgttagtgagattgggctaggcaagttcatagg

SEQ ID NO: 170290 - DNA, 689 bp, Homo sapiens
agtctctttctgttatttaaaatttcacatttccacatggttctctgaacctgacacctgtgtttacttgtgcgtttccccaacattctggctgattctctgagcctgggaactcccagggcaccaggattcttggctgtgccccatgaagaattggcatctgtgtgtgcatctctttgttactgaccaggtgagtccaggcaagaaggtagctcactgttgcctagaggccttcatccctggcttagagacatcagtctgtttgggactctgctgtccagagtagcctggctaggtattttcttttccctgcgatgtttactgttctttcgtgggatttcagatttccatgatggtggaaggcttgtaaaatgaaggggtggagaagggttaccgtggcaggagcctgggccaggccaggtcgagccagtagcacagacagcttttataatggtctgcagggctgggaggcttgtaaaggcgatgcaggcagatagggggataaatcatgcaagcagtgggcagggtggtgaagccgaggttaggaattaactttgtgttggatggagcccaggttgtgggatgggaagagaggcctctcctcttttcctctcctctcagctctgttctttgcctctcctttctgttggctctattcactgcaggctgtgacatgtttgccctagccc

SEQ ID NO: 170291 - DNA, 410 bp, Homo sapiens
gtggcagagttgtcagtggctgcagctgcaggcagttcttaggcttcagagagtgtgtgcttcagaccctggtggagctgtcaggaagctccctatgctagtctcagggccctcgtagggattcttctgtggttagggttgcaaatgttcataatgagaatgtggacctctgggaatcactcacttatccttttcccacagtgggcagcctctccaagattccagctgagctggcagcctgcttccctcgcctccttccctgcctcaggtgtttcctgttacttctttgttaaattctagtgttctgtcttagatgctatgtttgaaatgtgattatctgcttgctatttggtttttctaagtgcaggtgccaagtatcagatctgttttcactttcttaatagtgtctg

SEQ ID NO: 170292 - DNA, 171 bp, Homo sapiens
tggacttgatcctgcgagcattgcagagccatggagaggtgttaagtaacagggaaaaggatctcaaatttgtcaaggtaattccttatcctgagagacacatggagatttgaaccagggagactgctaggaagtcctctgcagtttttgtaggggattctcatggaactt

SEQ ID NO: 170293 - DNA, 558 bp, Homo sapiens
tgtgagccacaacacccggcctattccttggttttatattagcagttacagcagtaactgagctccgacagcttacataggcttattttaggctttgttggaaaattccagaggaggagacatggccctcagaagtttgtggtttaacaggagaggtaagaagacacattttcataaaaaaagtaatattggccaggcacggtggctcacgcctgtaatcccagcactttgggaggccgaggcgggtggatcacctgaggataggaggtcgagaccagcctgaccaacatggagaaactgcatctccactaaaaaaatacagaattagccaggcgtggtggcacatacctgtaatcccagctactcaggaggctgaggcaggagaatcgcttgaacccaggaggcggaggttgcagtgagccgagatcgcaccattgcactccagcctgggcaacaagagcgaaactcctctgtctcaaaaagaaagaaagaaaaaataataatattgagagaaatctgtctgggaacacatgaaaattatgagctcagtgctaaggt

SEQ ID NO: 170294 - DNA, 259 bp, Homo sapiens
ccgccccgcgtgcccggcccgagggcgggcaccggtaagggagggcccaggtcagggcttcccgccagcgttcgtcccggccccgcagcttcctgcgccggagcggcccagaggcagaggcctgagctggagcacacgccaggagggctaaggttcccgggagaggggtcgagaaggcagcagggtcctcccgccgctgaggtttggcctcgggagcagcagatggtcggcgggagctcaacccgaaacgcagaagggg

SEQ ID NO: 170295 - DNA, 676 bp, Homo sapiens
agcgatgcaagttgatttcattatggtcagatgccagcaaaataaatctagatcatcattatgtatttatacccataaagggaagaacttggcatggattacaaggtatttaattataatttagacatgttatggcactcagtgttttgttttattatacctttcatgtattgacaggccagtgtgaccacagaaaatttaaccttcctgccagtccttctccctgacctcctgtattgctaggaagaatgaaaattagctgtataggaaaaaaaaagattaactttcataagtagcccatatgtgccgttgtaaagattcactctcataagtagcccacaggtgatgtcgtaagcatagtgaatacagagggggagagccgagtctctaagcacacaagctttttgaagcatctctgcttggcaaaggctcttctctccacctccaagttattctttcagactcacctctctttgaaacctttcacctcagccaggcgcagtggctcatgcctgtaatcccagccctttgggagcccgaggtgggcggatcacgaggtcaggagatcaagaccatcatggccaacatggtgaaaccccatctctgctaaaatacaaaaaattagctgggcatggtggcgggcacctgtagtcccagctgcttcggaggctgaggc

SEQ ID NO: 170296 - DNA, 104 bp, Homo sapiens
tcatttcctgctccagccccgtcctcccataggcagcttgctgcaacctgctgtggctgatccactgggtgggcccgagcaatggctgcatttctagtaggggg

SEQ ID NO: 170297 - DNA, 779 bp, Homo sapiens
ggttctggcggctgagggccgggtggcgcaggcggcctccggctgtgcccatgggaactaaaaccttcggttctagaagagccgggggagaggctccgggaagaccgaattcttcagaaatcgcagagagaccttggaccggatccttccctgcagggctgcgtcggggaagcgccggcacaagtatattcagcgacttccttggaagcgcctacgttagaatactacaaacttacaagctagttgatcagtttacctcccactagaaaagacagtatgggaaggcagaggccgcgtggcctggacccccgtctttgctgtcaggcttccagagtgaaggtggggctcatattcagactagttcctggtccattcattctttcagtcagtcagtcagtcattcctacagggccagaaacttttttttttttgagacagagtttcgctcttgttgcccagactgctcaccgcaacctccgtctcctgggttcaagagattctcctgcctcagcctcccgagtagctgggattacaggcatgtgccagcacacctggctaatttttgtattcttagtagagacggagtttctccatgttggccaggctggtctcgaattcccgacctcaagtgatctgcccgcctcggcctcccgaagtgctgcaattacaggcgtgagccaccgcgcccggcccagaaacatgttttgaagggcaggcaccgcacagggtgctggagacagactgaaggaaactgcacctctcagtgactcaagagagat

SEQ ID NO: 170298 - DNA, 118 bp, Homo sapiens
attgagggatggctgcctgtttgattcgtagtgtgctgttagtaaatggggtcctttctttgaaaagtgtgatcacacttggtaaaattttctgactgtggcatctgtgtagcaactt

SEQ ID NO: 170299 - DNA, 894 bp, Homo sapiens
aacttttctattcctaaggattttaaggctatgctatatgtaatccatagacctgttacagggaggaataattttaactccagtgactgagaattgactgagagaaagcactaccctgaactaatgttaatcataattcactgagcatgattaactgtgagactggagaaattgtaataagtgtcagtgaaaagacaaagcacaaatcctttcttactcacattttactaaacatttccttagtagtgaagaagaaaggtttatgattttaaccaaaattcagtgtgggggataaaaaggcagagaaagaaagaacaactctggcatggccctgttttaagatttttttcccataacaacttgaagtagtagcatggtctctagaatatttccttccgcccctctccttcaatcccgaaaagactgttttgtctctaataaccctgttttatcccctccccatagtttccttgtgaagtatttgcttacttctgggtcctttacttctacctgagcgatggtatcccccattttaatatatccctggctttcttctggtgttacagaataggagcaatctcctggattctcttggctctggctgtacctgacctagacgtatgctgtcctctgtcacctgccaccatgtgattcctatgctgttaagagtggcagcagttacgttgaaacctcccaattttatttatttatttattcatttatttatttatttattttgaggcggggttttgttcttgttacccaggctggagtgcaatggcgcgatctcagctcactgcaacctccgcctcccgagttcaagcgattctcctgcctcatcctcccaagtagctgggattacaggtgcgcaccaccacacccggctaatttttg

SEQ ID NO: 170300 - DNA, 347 bp, Homo sapiens
gattacaggcgtgagccaccgcgcccggcctaatcttttaatttttttgtagagacagagtctcactatgttgcccaggctggtcttgaactcctggcctcaaacaattctcccacttcagcctcccaaagtgctggaattacaagtgtgagccaccgcgcccagccaagcccccattttctccaggaacctccagctgctggaccccctgcagctggccccctttttcccaaagatcccctcttgtgaggcctccaggagcccacactgccctggtctccgcccaccgcccgcagcccctccgtggtcctctctgctgcttctccccatctccctgccttgtccag

SEQ ID NO: 170301 - DNA, 217 bp, Homo sapiens
tcgtaccatatgtgcgaacttagtgcggacacccgatcggatagcgcactacagcccagaactcctggactcaagcgatctgccagcctcagcctcccgaggtgctaggattacaggagtgagccactgcctggccataaatttcccaatattgactgaagactatcttgaacttgagatggaactgagctcctggatgtggtttaactcaagcaca

SEQ ID NO: 170302 - DNA, 288 bp, Homo sapiens
gcagtaaggactggtgaatccagacggtgggtgcaaggcatggcaggctccctgagctcccagcattcacgggaggggtgtgtgtctgcaggatggtggggcacctggccgggcacaggccttgtcctcaggagcagacacccaggaccacagcagatgcggcggccggcctagccgcacatgggcccgacagggaggggactgaggagggcagggagaagaaacagacaaagaaccaaggaggctttcctgtcctgcctcggagagtggccttggagcgtggccatg

SEQ ID NO: 170303 - DNA, 446 bp, Homo sapiens
gtgatttgttaagatgaggtcatactagattaggttggctgctaaattcaatgatcagcatccttataagaagaggagaagacacacaggggtacacagagagatgccatgcgaagacagaggcagaaactggagtaatgcaaagatgactcaagggatgtcaagggttgctgggagtcaccagatgctgggggaagcaaggaaggatcctctcctggagccttcagagggagcacagaaatgccagcgccttgatcttggaattctagcctctagggctgtaagagaatacatttctgttgttttaaaccacacagtttgtggcaatttgttatggcagccacaggaaactaacacagtcccctaacctcaaccactgagcttcactgactagctgggaagtttctcccaggaggccatgttgtccctgaagccagtcccaatgg

SEQ ID NO: 170304 - DNA, 344 bp, Homo sapiens
agaaaaggcctgggatggattttgatcatgttacaaggcccacttgttgcatttaatttaaagcagttgtcccaatttcattaccacagagcatagcgttttcaaatttattctttaaaagacagagatagtggcacaaaatgtgctgtgggtttaagcaatatttgattgatcatgtgattctatcagtatcttttttttcttttattttgcctcagtatacacatttctgaatgaaaagatagacgatgtctttattttaaacaatctagtggtggttgaagaggccatctggaaaggtgatgtcaacggagggtagggtggttgctggtggaggggagtag

SEQ ID NO: 170305 - DNA, 543 bp, Homo sapiens
gcactagagttccaacttctgtacatcctaacaattgttatttttttatagtagccaacccagagggtgtggggttctcgtcgttagttctatcttgtcttccaaacttgtcatcactgaagcacctgaggactcagtctccctgtcttccctttcccatctatttctatccctttggtgatctcctccagccccctggctttaaataccatggacatactgatgtatattgctagcccctacctcctgccagactctaggcttctcactgctgttgcctggtgggcatttctacttggatgttcagtaggcacctcaaccttaaaatgtccaaaaccgaaggcagattccaagcccctcatcccttgcccaccatgaacctggttctcccacagactgcacttatctgtcaatggcatctccattctacctggttctcaggctccaaaccttggattcatcccttccttttctcttttcctttctttctacatacaccagcaaattaagttggttctacttgcaaaattaacacagagcttt

SEQ ID NO: 170306 - DNA, 557 bp, Homo sapiens
aagaagacatacaaatgactaacaggtatattaaaaaaaaaagtacagcatcactaatcatcaggaaaatacaaatcaaaaccataattagatatcatttcatacctggtaaaacagctattataaaaaagagaaaataacagatattggcaaaaatgctgagaaaggaaaatgcttgtacgctgttggtgggattgtaaattagtactgcacctatgaaaacaagtatggtatttctcaaaaaactaaaactaacattaccatatatatccaaaagaaaaaatcaatatactaaaatgtatctgtatttccctgtttatttcagcattatttataataccgaagataggaaataaacctaagcatctatcaaaggatgactggataaagtgtggtatttagacacactgcaatattatttagccataaaaataattaaatcctgtaatttacaacaatataggtagaactgcaggacatcatgttcagtgaaatatatcaggcacagaaagacaaatattgcatgttcttactcatatgtggcagttaagaaggtt

SEQ ID NO: 170307 - DNA, 134 bp, Homo sapiens
tatattgattcagtttcaattgttgcatggcctttcattcctgggataattcccacttggtagtattgtatcatcttgtttatttattaaaaaacagacttactgcaatataagttacataccatgaaactcat

SEQ ID NO: 170308 - DNA, 313 bp, Homo sapiens
ctttggggaaaaagttctgtattcacaagttgacaaacttaataaagataataatacagatttgaaaagcaaaaatgtagattttgaaaacatggagattgagttcataacgtaaaacacatatttgtaaagtgtttaaatataagggaaatcacagacaatatggcaatcatctgaaaggtaattcagatacagttgcaaaaaaaaagaaaaaataagttcttcagaagaacaaagggtaatatcgcagtcaaaaagtaatacattgaggaatttttctgctagctgaatgttgtatttttaaacctgtgtt

SEQ ID NO: 170309 - DNA, 450 bp, Homo sapiens
agttagacccctttccttatctccaggacagagggctttctgtatcctgaggttcttgctttggtatactggaagaatcagatcacacgtgggcttggagaatgagtgcaaggttttattgagtggaagtagctctcagcagatgggggaaccagaagagagatggtgtgggaaggtggttttcccctggagtcgggtctctcagtggctggagctctcctctctccgccccagccaaactcggcatagttccacccgtctgtggcctgccggtgtgctggtgcctgttggtatgctctcgacattctctcaatatccagctgctggtgtgttcctcttgatgttcagctgcttgtgtcttggggtttttataggcacagcatgggggtgtggtgggccagggtggtcttgggaaatgcagcatttgggcgtgaaggcaggagtgcctgt

SEQ ID NO: 170310 - DNA, 314 bp, Homo sapiens
ggagacctggtccaagaaacaagaggcctgggttgccgttctgccctaccaataacaggctaggaaaccatctctctttctttagccacatccttttccaaagaggaaaattcaggagattagcatctactccagctacttcacaagatgaaaaactcttttgaaaaagtaaaacatggccatgtgcagtggctcacgcctgtaatcctaacactttgggaggccaaggcaggcggatcacctgaggaattggagaccagcatgatcaatatggagaaaccccgtctctactaaaaacaaaaaaaaattagctg

SEQ ID NO: 170311 - DNA, 604 bp, Homo sapiens
aacattcaggtgatcgggagattgttaaatgtaagaattctctaaaatgatagtttgcagtgtcataccgtgggctagcatatagcatgtgaaaccattctacttgactttgaactttgagaagtacacttttgatgcttatagataacagatcccaataacaccagtgcagcctgtctagttgcaaatactaacagtagaatgtttcttgccttgtttggtagaccatccatttctttcccttacttgttttatgtatatcttaaaggttgcttttttggtttgttgatttgttttacaaatgcttattgagtgtttgctatgtagaaggcactgtttctagacatatgaggataacagtgattaacaaaacacaaaactcctgccttcctaagggatagaaatacacgataaacaagtaaacaaattaattataatttgatatggtaatgagtgcaaagaagacaaccaaatgcagtgatatgatagaatgaagaattaaaaagctgctttgggtcggattgtgatgcttgcgtggagcttggagaagcagcagccaactgagggaagagtctctagccagtcacctgatgtcacgtacctc

SEQ ID NO: 170312 - DNA, 418 bp, Homo sapiens
caggaagctgtttttcccatgctgagtagtctcatggcactgtgtgccaccacagtgctgcccagccctgccaccctggactgaccgatagaggggagaccacagcgtcagctgctaacatggaaggacttgattgtgcaagagctgggtttcctgggaagtcaggcaccctgctccttcacctccccataacagctgtccccatggcagtctcatgacaataacaagccagccttgctattttggaaagcagtgagggacgtggagatccccattttgacagtattcatctcctgtgtgacctgggtgagttgcccaccctcacagagtcttttcaccgagttcacatgggactcaaatgggatgccatggttttaacccctggcgtgcgttagaatcacctagaggaattgaaaca

SEQ ID NO: 170313 - DNA, 285 bp, Homo sapiens
gccaagagtttgagaccaacctgggcaacacagtgagaccctgtctttacaaaaaatttaataattaccctagtgtggtggcacacacctgtagtcctagctactcaggagtctgaggtaggaggaccacttgagcccaggagtctgaagctgtagtgtgctatgatcacaccactgcactccagcctgagtgacagacaggttgtctcaaaaatctaggaaaaattttttttaaatttgttaaaaaggtagcactacctcaactagtttctggaacatgtttca

SEQ ID NO: 170314 - DNA, 244 bp, Homo sapiens
gaatagtcaatatagagtaagatttgaagaaacaatcttgtgcagatataatttttagtttttagttatctgtaaatgttggcaagcattccttctgtgaaccctggcattcctctcaggcttcattagaacacatctctcccactctgatctcttcttcatgcttggggctatgagcctctgggcatacctctgtcacaggtctctcaatgatctattatctaacatgtgactaaattgttct

SEQ ID NO: 170315 - DNA, 463 bp, Homo sapiens
tcatccaatgtgggggttttgaggaattcttcagataccctctctgctcctctcctccctcctgggctcccacagatctgttggggtccccgaggccgctcagcactgctcccttttcttcagtctcttctgctttcttttcctcagacgatgtgattttattgtcttcaggctcaccgattatttcttctgcctgctcacatctgcctgtgagtttctgttgtgaatatttactttttagtgtctattgtgagcatgtacttattagctctggaatttctctctggtttcttgttggatcttctgtctctgttgatatttccgtcgtgttcacgcgtcattttcttgactttctccacatcttcctttcgttctctgaggaactgaaggtttaagacagttccctaaaatctttgtctgggacatctaccgtcaggtgattttcaggaaccgtgtctgttgg

SEQ ID NO: 170316 - DNA, 208 bp, Homo sapiens
gtccctgtcatccagactggagtgcagtggtacaatcccggctcactgcaacctccacctcctgggttcaagcgattctcctgtctcagcctctcaagtacctggaattacaggcatgtgccaccgcaccccatgtaatgtcccgatcttgatggatgcactctggttatagaaatgtcctcattttaaggaaatacatgccaaagta

SEQ ID NO: 170317 - DNA, 409 bp, Homo sapiens
tttcacatccatcttttcatttgaaccttatcgtaagactgtgaggtagggattatgatgctcccactgccccttttttacagatagggagtgaagctcagacttggtcaagattgcagatcaggtaaatggcaaatccaggactctaacactggtctgtctgttataagatcctgtgccttaccctatactacaaagcatgtggaaaagtgaggcaaaggagagttgaacttgggggccttcttggtgacttcccactccaaggctatcttttcctttagtgctaaaaacagattccatttttaaaaagagagcctcaaggcaaatgttagtctctgttgagctatggcctggaaagtagcctttaggttgggtggtcttacggtttcaagtggtcgggtaccgagct

SEQ ID NO: 170318 - DNA, 396 bp, Homo sapiens
ccagcctgtatttagagcacatttctaaatgttttctgctttaatatgtgaatcacttgatatataaaaaggaaattaggccaggtgcaatggctcatgcctataattccaggactttgggaggccgaggtgggtggatcatttgaggccatgagttcgagaccaacctgcccaacatggtgaaacgccacctctacaaaaaatacaaaaattagctgggcatggtggcacgcacctgtagtcccagctattcaggaggctgaggcagagaattgctggaacctgggaggcgaaggtcgaagcaagccagggtcaaagcgagccagggtcgaagcaagccgagatagcaccactgcacttcagtctgggcaacatggcaagtctctgtcccctcac

SEQ ID NO: 170319 - DNA, 474 bp, Homo sapiens
gttttaggcatcattgattgacctgctgcaatgaaagttggttagctctgctatttttcattcccccatcttccagttttgttgcttgcattattttttcatcttcagggtttaaaatatttacgttatattctgcaaccagtatccacactgttttaccttacttctgcatttaaattgattcaaactcactatgaatctcttcatcagggtttctccattcctggattactcatttaaattaattttttttgttgttggcaggcttctaccagtaagtttctcaagaaaaatcctgagttcatgtttgagaatgtctgcttattgttttttgcttgagtaatataatacttttgaatcatacattctttcttccagctccactgtctcctgtagtggaatgtttttgtaaagctggttggattctctcctcccctgagaccaccatctttttggtgacttcttttcctgctt

SEQ ID NO: 170320 - DNA, 392 bp, Homo sapiens
cctgctgccatccatgtaagacatggcttggtcttccctatctcccaccatgattgtgaggcctcccaagccatgtggaactgtaagtccattaaacctcttccttttataaattgtccattctcaagtatgtctttatcagcagcatgagaacagccccccttctttttctctaccctctatcccttgacaacatgatataaaatcttgacttttgctactacatggatgggcctgaaggacactgtgctaaatgaaataagccagacagaaaaaaagatactgcataatttcacatatatgtggagtctaaaaaaacaaatttacatatataaagagcaaaactggttatagggggatagggagaactggggaatgtaggtcaaaggatt

SEQ ID NO: 170321 - DNA, 370 bp, Homo sapiens
aaccagctgtcgaactcttgcccaccccggtgaagccagcttctggacttgtggagataccgacagcacgaagcggctacactgccgcagagccaccctgtgccacctcgtcccccctcctctgcagcccagcagagctgacgggggcgggggcgtgcgcggtgggggctgacatcttataatacggatatacatattgtcacgctgcagaatcctccgcggcttctcgtcagcaagtggtagtcaccacactcctcctacagaattaaggaagtcttccaaaaattctgctgttggaactaaacagactgccttgcagctttcatgacagcacttggattccaagaagcagactgaagaatgtgggaga

SEQ ID NO: 170322 - DNA, 556 bp, Homo sapiens
agggtaacagggaaggtgtctctgagatgatgctgggcaggagccgagggggttgtggtgccagagctgctgatagctgtgttcttatgacctgcatcctgatggcttctgagccctggttcctctgaggcctctgcagcctgcttccgggcagggggccacacctgtgctcacctgtcctggtttgcctccagcactgtgtcctgggctgccctcgtggggcagggctctaacaagggggagaaggccctgaggaggtgcgggtgaggccaggtgagaggcacagaggatgtcctggcgcctcctgctcccctctccccacctgtgacctcacctcactcttctgcgtcctggcccagagcactgggacctcatcccagtatcaatcaggatgcctccctgatgtccctgggcacctctcactcaccttgtcccaaactgaccttggcatcttcccccagaagtgtatcttcccctggtgcccttatcagggaaggcgccactacccacctcatcgctgggaaaagagacctggggcctcatccctgatgcctcc

SEQ ID NO: 170323 - DNA, 137 bp, Homo sapiens
taacgacttggttgaatgcagaacgtcctagagtgaaagggagggaactaaccaatagtacaatgctgacagggtgatgaggaagtgttctggcaaacacttactataacagacagacaccgtagtacagtgtgaca

SEQ ID NO: 170324 - DNA, 627 bp, Homo sapiens
tttgaggcagcatggtacagaccatttaaagtcaagagatctgtgttcaagccccactcacctttatcaccagctttgtaggtttgggcaagtcagctatttagtgttagcttcctcacatgtaaaaatggaacctaaaaatagtgtctgatttagtggcgagtcttgaatgagatcatgtgtgtcaaagtactttgcaaattgtgaagagctacataatattagttgttactaatccagactatttgggggatgaaacgtttatgaagataggtgtggcatcaaagaaaaaaatgccagtattttaatatttgtaaaaaggagttagtttaaacctgacacatttctttttaaactgccttcacctgcatattcctatttatgctgacatgaccctatttatttaatgcatatgttgagaccaccagtcctttactcatcaagatccttgtgaaagaattttaacccctttgtcaaaatttaaggacctctcagaataggatgaaatgggtatgctgatttttaaaaaactcttgttagatttaggaacctctcagaataaaatctggaagcctgttccatttgcattatgagatttgcattacaatgcaggtaagttgtaatggt

SEQ ID NO: 170325 - DNA, 677 bp, Homo sapiens
acaaaccaaaacaaataaaataaaagcattaaaataaaagaccctgccactcaatctttgtatattggccgggtgtagttactcatgcctgtaatcccagcactttgggaggccaaggcaggaggatcccttgagcccaggagttggagaccagcctgggcaacatagcgagaccccatctctacaaaacataaaaattcaatatccggcaaagctatgctttgaaaatggagagatttccacttctggaacagcaatgtgaggaacttcatggaagtacttcctgtgaaacaagcaaagcttaaaccacttaaagtctcaaaactgtcctaaacgcatataacagatgaacacttacggagtaaaatctactgacacctggtacgaacattaagcctggtggcatctgagcctcagcctcctctttccctctcaccccagctcaccatgatgggtactacactcagggagaggggagcaggaagatggggacccttctcaattcccaaataaggtttcctggatctcatgggctgggcagaccaccagagtttcacatcctcaccgactccaagttgaagagactaagatcctggtgcacgtggccaagaagccaggggctcccttcctccaccttgcccaagcctcagagaggagactacccccgccacagcagg

SEQ ID NO: 170326 - DNA, 638 bp, Homo sapiens
cccaacacactggatcacttaggtagaagagacaaattcctggaaatacacaacttaacaataattgaattacaaagaaacagaaaatcggaatagacctatacctaggaaggagactgaatcagtaactgagaacctctatcaaagaaaagcgctgaaccagatagctttgctgctgaattcaagcaaatatttaaagaattagaaccaagtctcctcaaactactacaaaaaaattgaagaagaaatacttcccaactcattccattaaggtcagcatcactttgatacaaaagcctgacaaagacctcatgaggaaagaaaattacagatcaatatcccctacaattatcatgttgcaataatccttgacaaaatataagcaaatttaaatcagcagcatattaaaacaattatgtgccatgaccaagtaggattttatcctgaaatgcaaggatggctcaacatttaaaaaataatgttaacacaagcattaacagaaggaaggagtgcagtaattgaaagagagtggtattagtatagacatacaaactaataaaaccgaagagagtctagaaataaactttcacaaatacattgaatcaatggggaaaaaacaacagccttttcaacaaacg

SEQ ID NO: 170327 - DNA, 393 bp, Homo sapiens
tccgcccgcctcagcctcctaaagtgctgggattacaggcatgagccactaggcctggcccatactttcgatttgctttctttccatcccatttcagtcttcacattgttgactttgaatggcctttctatgaattttttcctattcacttctaaatccctattttaaggatcacctcatatctggattattgacatagcattctgactggttctaccctgctctattttctcttcccccaaaatacacacacatgcatatacacacagaccacacccacacagaccacacctacacaccatcctgcataccctttcttctcccaacataaacacacacaaacaccaacatccccccatattcttcctccatataatacacacatgcacatac

SEQ ID NO: 170328 - DNA, 357 bp, Homo sapiens
tgggcttgacaattataactctaggatgttgcatataccatacttggctacatctgttgtggaaatagagggatgatatcatttttttcacctctttctgtaaatagaatttatgtagcacatgtgggcttcctcaagagaaatttaaaaccccaaattgatgggatggtgagacctaccacctctctcaagcatgtgtctctccaagtgacacacataagacactatttaaagcatgtactttggatgtgtgagccactgctcctggccttgcagtttttatagtataagttgtctcagtccgttttgtattgctgtaaagcaggggtccccaacccctgggcctattaggaatgg

SEQ ID NO: 170329 - DNA, 365 bp, Homo sapiens
ctactccttaatggattccattagacagctatctagccaaccacccggaacaacactggtgaatcatatgccaacctttgtccctcctagaagttgtatgtctatatctggccgggtgcggtggctcacacctataatcccagcattttgggaggctgaggcaggagaatcgcttcagcccaggagacggaggtcgcagtgagctgagacgttgtgacagcactccagcctgagcgacaaagtgaaattctgtctcaaaaaaaaaaaggtacagggccatgtagcatgtgctgatgtagatgctgcagcaaataatccagatttagctaacattatggatggtgaccacaccatttagatggaac

SEQ ID NO: 170330 - DNA, 345 bp, Homo sapiens
ttaattaattcaaagacttacctgagattctgtttgtgcaataaaaattaaaaagattactcagtaatacattgggagaggtgtaactggggcattaaaatacgaatgtgtgtctaattttcaaacatcataagtattttgaaagcacttatacataatcaattaatatatgttgttaaataaattcatatgaataatatgtgatataaattagtgttttgtattaatttcaagacaattataaagagaatgtcaccatcactcttttgattcaatcaacagtccttagactggttccttgtaatgaatttaatgggttaataaaagctgtgttatttgaaatta

SEQ ID NO: 170331 - DNA, 176 bp, Homo sapiens
ttttaaaaagcagaaaagtagcagacacaatgacatcacaggcagcaaatacctggcactccagaaccactcgccttcctgcatacaaggcagacatgggtcacttagccagccctctttccctgagtgtgaacccagcttcagaatccagttctatgcagcaccctgggcaactg

SEQ ID NO: 170332 - DNA, 501 bp, Homo sapiens
ttatcttctagaaattcggtctcaactgtacactggacaatgagtccctctctgtcacttgctaccaaaaccatggaaattaaaaatctttaaaagtccaatgtacttaaagttttcatttctccactatttgatcaaggccaaactagatatgggtactctgggttgtgaagccatatgtgatctctgccttgacactctagtcctggttggtggccctcactctcagcacaggagtgcccggatgcacatcttcctgaaggccgacgctgtacacatcctagatgaacacagggttgtcattggcttcaaccaataggatcaggagttgagtgatgctgctttgttggggggccgtctaaggctgctagcactaagggatgggagctctgcttttcctagtcaagcagcttctctaacacaggatcaacatatgtctttccactgttggtcacttttacttcaaagagaaatatagagttgctgctaaggtgataattt

SEQ ID NO: 170333 - DNA, 612 bp, Homo sapiens
tccttctctgcccaccttgagttccgcaggctcagtggtctcttgagggtctttagatgaccaagccctcagtgtagccaagtgtgcctttccctctgaaatgctcacaccctcaggctcaatgatactttcattcttagggtatcccaccacggcatgcgattgcaccactgccctccatcctggatgacacagcaagaccctctctcaaagaagagaaagaaagaaaaagaaattctatgtaaggaaggaggaggggattgctattgaacagggtaatcagggaaggcctcactgagaaggtggccttggcatcagatgagaggcaagagcaagccacttgaacctggagaaatagccttctaggcagaggcagcagtaggtacaagggtcgggtgtgtttgaggaaaggcaaggaggtgagaaggtgcagcagtgagggggagatgtagcttagctcatgcaggaacttttaggctgtttgatgactttggcttgttcttcaagtgacatgggaagtcattgcagggttctaagcagagggaaatgtcttggttttcatcataaccttttgtctctgactaatgtgttgaaaatagactgtaggagttg

SEQ ID NO: 170334 - DNA, 124 bp, Homo sapiens
tccgtgtcctagtaggtatcacatcctccacctgtggtataaacctgagagccattcatacgctctctctctatctctctctctccacctccccattcaatcagtcaccaaatcttgtctattt

SEQ ID NO: 170335 - DNA, 262 bp, Homo sapiens
ttcctacaacagtcagcattcatagttcaaaaaagttagtattgcaaaaggagagtaattaagaattctttcttaataaatgttattgcaagtcattagagtttcatgaaagcagagacatatggaaaaatctccccagagcaataacaaacatttcatatagacagtatgccattcaggtgttcagcatggaagacatcagaaatattaatagtccaagcaccctaaagtgacttcagactaaagtaaatgaatgcgtccg

SEQ ID NO: 170336 - DNA, 695 bp, Homo sapiens
agattcatttttgtttcatatgcactttatacacatcacctgaaggtaattttatacaatatttcataataattttgtacatgaaacaaagttttgacttcattttgactgccacctgtcacatgaggtcaggtgtggaattttctacttgtggcatcatgtcaatactcaaaaaatttgggactttgcagcatttcagattttagattttggggttgaggaatgctcaacctgtattgttgccaccaacaaaactggcatcatctacagacaataaacctttaaaaatgcttcgcagaaacacaaagtgttttcctcaacatcttccttgatttttgtagttgaaacaagctcctatcatgtgccatgtgaagtagtgtttctgccctcgagaagtttggtaagagaaatgaggcagtacacaaatgactagatatgacgaagatgagttaaatgcctccgaatattttgtttgctcactagaaattcaagagaagagaacgctcagctagagtgaaccaggagactgcaacaatcttgttcatttggttattcacttatttaatgtctgtattttgtagatctagattaatgtgaatttccttagaacttacatcttggttggtttactcagtgctatatccccaatgtctgacatagtacctggttctcaataaatactttgaaacaattga

SEQ ID NO: 170337 - DNA, 672 bp, Homo sapiens
attgggaggggtaggtgagggtcgcgaggctgcgtgagcttctgagtgaacgcggtgcttttgggaacgcgggacgggcgacctgtggcgccaggagcgggccgaggcgcggcggcgccgctgccgtctggatgggaagttaccgtttacagcgaagtccacccaacgtttccgaagtgaaaggcgccgcgcccagccgggccggccggcggtttctccaggctggtgatgggcaagccgggtgtaccaagtccatgatgcacatgaggagcatttgtagccagtcactgaatcacctcatgactagcgggacaagcctcaaattcaccgcaggatttccgatctcactctgttgcccaggctggagtgcagtggcacaatcacagctgaccgcaaccttgacctcccaaggctcaggtgatcctcctgcctcagcccccaggtagctgggacctacagacagggcctcactctattgcccaggctagagtgccgtggcaggatctcagctcactgcaacctccacctcctggctcaagcgatcctcccacctcagcctcctgagtagctgcgactataggagtgtgccaccatgcctggcttaattttcatattttttgtagagatgggattcaacatgtttcccaggttggtctcaaactcttgggctca

SEQ ID NO: 170338 - DNA, 834 bp, Homo sapiens
gccccgccggggcttaagttccatgcgttggattcctcgcttgccgctgccgcccgcagccctccttgggcgctggggaagaaactcgctggcgggtgttctgtggcatctcagggggtggagggacgagcagcttcgggggcacgtcctcgtgtatcctgtggaggaccctgaccccgcaccccaccctcgaggccagaaatcggttgcctctggggacctgagaagcgagaccactcgcgcccctgacttgcaaagttggggtctttattggcctccgggattctgctcctggcggtttctccaggctggtgatgggcaagccgggtgtaccaagtccatgatgcacatgaggagcatttgtagccagtcactgaatcacctcatgactagcgggacaagcctcaaattcaccgcaggatttccggtaggttggattgtggggttggtgtttgcactccaaagagttgctgtgatttccctgtatctgtctttctggcttgttagatcttctcatttggcgtcctttctccgaagagttaaccaagacgtttggcatggtttccttgctttcctcctatcttttgctgctagagctgctttcgaaaagaagtcttttcttgcagtggtatcttttctttgggttacagtgttgttcatcctttctttgccgaaagaatgaatcccagtgcttcacaaggttacaaggaaaagatctgctggtagtgtttagtttttgttctgagctgatatgtgttagtagctttttgtttttaaattttattagtaaaatttcaccagtgaaccagaagctctttttttctattgtgaaat

SEQ ID NO: 170339 - DNA, 148 bp, Homo sapiens
ctttcagttttaaatgaagccacaagttccctgtataacatttgggagatagaggggagctctctagcctaggggttgaggtctgtgaccaaacgcctataaagttgtctttgtttggactcccccagaagcagagcctgagacaagg

SEQ ID NO: 170340 - DNA, 223 bp, Homo sapiens
cgttcattactatgatcgtattattgaccggaccaacacaacactgtacattgtaatggaatattgtgaagaaggagacctggctagtgtaattacaaagggaaccaaggaaaggcaatacttagatgaagagtttgttcttcgagtgacgactcagttgactctggccctgaagtaatgccacagacgaagtggtggtgatcatactgtagtgcgtcggggt

SEQ ID NO: 170341 - DNA, 487 bp, Homo sapiens
agaaatcgtagaaaagtggaagtaggacagttcctttaactgataaagggtaatcataaatgtgtatttaatggtaaaatgttgaaatcctttcttctgggattgggaggaagacggatgccactcttggcactggtgatcagcactgtgcagaagcccatagccagagaatggcaagaaaaggaataaagggtgcaaggattggaaaagaagaaatgaaacaatcagtaacgtgagtagtacgattgcctaggatgaaaatccaagagggtcgatgggaaaattgttagaatttgaaagtacgtgtagcaagtttcccagataaacatcaaaattcagaaatcagttatacatcttcatactagcaacaaagagagaattattttaaaatatatcatttatgattataccaaaaatatcaaatgcttgggaataaacttgatgaaagatgtgcaagagtctatacagcaaaacataaaacaacatt

SEQ ID NO: 170342 - DNA, 386 bp, Homo sapiens
gcatacagaggagagaacagactaaaacatccctaagagttcacattcgcaggatgtggtgactggtggaaaagggccaaagtgagggaagagtcatgataattcccaggtgtgaagcttgtttgggggaccgggtggaggcagtatcataaagaggagacagaatgtgaacacagaggagggacgatgattagtttggttttcaatatgctgattttggctgggcgcggtggctcacgcctgtaatcctagcactttgggattgcaagcgtcagcatagagccaccgcctggtttgaattctaatttggaaaacaatctgtaattaaaccttttgagttcccatttctaccttaaactttcttagttacatataaccatctagta

SEQ ID NO: 170343 - DNA, 749 bp, Homo sapiens
ctaagggctgcatctcaggctgaccacagggcaggtgccaagttaagtgttttcatgcactccctctctcaccacctgggaggcaggtatgattaaccccctgcagaaaaactcacagtggggaagcggtgccggaacccaaagtccaggctccaactccctggacgtgacatgctcgccagccggggtacaccctgcacaatgctgggagcatctccttgatgcctccaccatcaccgcctggagcgctgatccactcagcacattctggctaagcatctgctgtgtgccaggccccgtgctgggcagtgatgggaatgaaagatgagttagatctcatctctgcccccggggagcctcccatctggtgggagacacagacacgtggatctttgctggaaagggtaacaaggccatggaaacccaggcaggagcgttctagaaatccatccactttcaagtaggacttccatgcccgtaacatccacccaccgagctaatcacccccactcctgccccgctgccctgggacacctatgagatggcatcacctaaatcatcacaaacatctccaaaggccatgctgccagtgtagacacactcattccatgggtgttagtgataccaaatctcccccagctcttagactcgggaggcctgcttgatcaatgtgtgtgtcctctgacgcagtttcctcatttcatcagacctagtgttctcacactgaccacccatccattcaccagaca

SEQ ID NO: 170344 - DNA, 483 bp, Homo sapiens
acacactttttgtaatttctaatcatttgtcttatatattcattaatttgagcagtatttaatttgaaattttctaaccttagacttgaaagtttcatctggccagatacatctatcatattagagatgcaaatgataacacttaaattaaaatagaattttgtttttaaaaaaatttttaaataattcataaatcatatttttgttgaaagtttaaatcttagtgtggaaatcttataatcttataaagtgaattatatgttgtaggcaattaactctgctaaccatagcttagttttttcaagctgtaggggcctttgtgtgacattcactgtttgatgagattaacatataatctggccagacggggcctattctcatattcctatagtttattttagtttcataaatatatatgtatggaataaaactgataacattcctgaaaattaatgattctgttgtttattagggataagtgaa

SEQ ID NO: 170345 - DNA, 384 bp, Homo sapiens
gtgctgtgggctttctgtgtatctccagtgattctcacaatgcttcgattgtgagtttttttaattgtggtaagataaacattagatttaccattttaacaatttttaagtgcacagttcggtggcaataagtacattgcaattgttatgcagccatcaccaccgtccatctccagagcttttccatcatcccaaacagagctctggcaccattaaacactaacttcccatttcccctctccccagccccccattctccgttctgtctctctgaatgtgactactctaggttccttaggtaagtggaatcatacagtgcttgtccttttgtacctagctcatttcacttagtatagtgtcttcgaggtccatccatgttgtagc

SEQ ID NO: 170346 - DNA, 331 bp, Homo sapiens
gaaaagatggtaggatcagtggattatggaactttaaaaattatggactttaaaaatgttggagtgatgatatttgaggaggggaattgaaaagataagggatggcaggagagtgggatgctagaaattgagattgtggagggtgtcagctattggtaatgacaagttctggggtatgattgtgggaatgaaccgccgaggtcaagtggagtactggattatgggaggagaggatgaggtcaaggatgatctctacagatattaaaatcagtatgcatttgacaagaacaatgttggagagagtgtcatagccaggagctaaaatctttaa

SEQ ID NO: 170347 - DNA, 258 bp, Homo sapiens
  misc_feature (1)..(1): n is a, c, g, or t
  misc_feature (11)..(11): n is a, c, g, or t
nggtcggtacntactctcgggcctggggccatagtgaaacctgagtggtatttagtgcaggcagggtggcaggcaggctgggggcctctcagaagcgtggagctggcagagagagacctgcccggggcatcggaggaaagggcgactgtgcaggaacagagtagacgaggtgggggaacctttgggtaagaagagctgagtcaggagcattgaggcagcggttttcaaacctcagaagcaacagcagggcccgagagt

SEQ ID NO: 170348 - DNA, 426 bp, Homo sapiens
tagtaatctgatttgtagaaattaggtggtttcacaaggtggtagagtacatgacttttattttgccgttatctgtttaatatattagataacaattagaacagaagatgtatgccatttacctggttaactttgcattttttctcctgtattgatccgtttatagctgactttgaatatatgttctgtttttttagaatttagaattgtaagactctataatactgggtatgccattttaaaatttcctgtgtgttttaattttatgtagggacttacatctgtgttaggaacctaagtttttttgtttgtttgtttgtttgtttgttttgagacggagtctcattctgtcgcccaggctggagtgcagtggcgcgatctcggctcactgcaacctccacctcccaggttgaagcgattctcctg

SEQ ID NO: 170349 - DNA, 417 bp, Homo sapiens
aaaaatatcttaatattggacacagtagaacaatgctgatgagaaaaaatgaacactcagtgcaggcaggggttggtgtggtggatgtggatgtttgaaactgaaattgggcaatatctctgacccttttctcaggcaacagtacccatacctactatggtactccattggcttaattcaaatgacttctagctccagaggtagcatagaaactgtagttggttaataataagaacagtgaacacctattgagtttgtaaaatgttccaggctgtattttgagcattacagaatcagaatacccagcatcaggttcctctagccactactgactgaacatgagctgtcccaaatcaatcttaccagaacaatctcaaaagagatgttttctcttctgatatacatgaacatggccca

SEQ ID NO: 170350 - DNA, 258 bp, Homo sapiens
cccaactctggctatgggcctttccccccagtagcactggacaggttccacaggttccagctggacctgcccccaagcacaggtcctggccatggggaggatgatacgggggaagggtaaagtggacaaagaactgggcagggggaagaatatcgggacactggtcttctgtctgccacggacactctaggtgactgagggtaagtcatgtctcctctatcagcctcagtttccccttatgtaaaaagagagcattga

SEQ ID NO: 170351 - DNA, 290 bp, Homo sapiens
taactgagtcacgtcgaccctcagatgacatcaatcttcactcctcttctatccaactaccgactagacacacgtacacatgcgtatgcaccccacagatcaaacttatttcattttctctacctgttggtcacggccttttcttcttatagcttactttattcccattattagacctgtttccatgttactgaaccttttccatcaaacctcaagtcctttatcttgtcaacaactccgtgaagcttttatcaatctgcctgtcagtaatctctctcttatctgaactc

SEQ ID NO: 170352 - DNA, 270 bp, Homo sapiens
agcctgcccattcctcaagcaaactgttacaaaggaaagaaacctcatccaaacctcttctctcatattttcatctagctatacagttaaaacaacaggtctcagcacacatcctgaataaattactttagaataaggaataaaatgttagtaacaataatgattctaaattatgatacttcgttattgattaattttctctatgatgcaaaggcttttaaatattagtacaaactgaatgcttacttttaactggaagcacccccccac

SEQ ID NO: 170353 - DNA, 450 bp, Homo sapiens
ctttctgctcccaccattcaccttcacatcaccggcgctgcttgccatgacacggtgtctagttatgtgacagcgtacaactgaagatgagatttgggtggggacacagccaaaccttattacctatcatgaaagtgaaggagagagcaagaagtggaggtgggtagtagtaatagaggttgatataatttctcaggaccccacttgcctctcagtacctctcttcattccctttaagggtgtttgttataagcatgggacttaaagaatgaagatggctctgaaagacaaaagttgattttcagtgaccgttgatattgaggattttacagtgaacaggacaggcacggcccctggcctgctggagcccgcggtccatgggggaaacagacaatcataaatcaaaagtaaaccataaagatcgtttcagatgagtgcttggaaggaaat

SEQ ID NO: 170354 - DNA, 345 bp, Homo sapiens
tggtcagggtcccagccaacaactattccacagaactctgaggacacttctggatccatgattgcatttctggatgcttggaaattcgatttgactactatttccactaccagagtagcatctctgaaatcctaatacttttgtgttcctagctccctgttcaaagtctagttttaggcaagatcagatgcccacatcttatgtctgagaggtttggaaataattatttggtgtttggtgctcctaaaacagaaggctggttctaccaccaacaaaacttgtaaagagtatcttccctcttgttgtcccatcaggaagagggtttagattctaggcagaccaaaa

SEQ ID NO: 170355 - DNA, 188 bp, Homo sapiens
aagatttaaagttatttctgcttagcaagcatgaaatataaagcatcctgtgtacgaagatgcagtacctacaattaagcaagtactcttttgaaaaactaagcacacaggcccatatgcatggtggaagtcgttgggctcagtattatttggagctggtgcatatatttatcacactttaataacaa

SEQ ID NO: 170356 - DNA, 143 bp, Homo sapiens
gggcattactgaatgcagatggctttcacactctagtacagttgacccgttgtgagtcaggccattgtgagtcgggcctgtgtgctgtgctgtgtcctcagttctgggtccactctgctgtgtgtgattccagagtcccagag

SEQ ID NO: 170357 - DNA, 411 bp, Homo sapiens
cggcacgagggaagacaggaaaggaacagccaaggaagtttgtagaaaagtaagagaatgtaaaatgtggtagaaataccatgaatgtgttctaggtaagatggtctgtatccatcttgactgaccaagtaaataagacccaataattgaccactagatttggccacgtggaggttactggtaattttgtttgtttgtttttgtagagacagggtctcactatgttttccaggctggtcttgaactcctaggctcaagagatccacctgcctttagaaaattaagtactggctgggtgtggtggctcgtgcctgtgatcccagcactttgggaggatgaggcaggtggatcacttgaggtcgggagtttgaggccagcctggctaatatggtgaaaccccgactctagtta

SEQ ID NO: 170358 - DNA, 268 bp, Homo sapiens
caacttgccgttccgagagccacactatgttctcctgcctccgttatcttcatcatcctgtttcctctatgtgggaatcctccggacccccaggcctggcacacgtttgaggaaagaaataaatgatacaggaagattgccaggtggcatcatagggacaaggactgcttcatctgtggggtaccactgctggggagagccagagctgagaccctggatggagcagggtaccaggggttcccacgaggccatgcagcctgagatcagg

SEQ ID NO: 170359 - DNA, 555 bp, Homo sapiens
ggacacccagagacttgccgcgtggtgtagcctttactcctagagtctgctggggccaagcgtatgattcatgtgagcaagagagtgaacagaccttaggagagaagttaacagttgccacaggatccctagggagtgaggaaggcttagggaggaggtgaaggaaccatctccgtccacagaacagcaagtcagaggtccccagggatgagaagaatccagcaaatggtctagcccgccaacagacaggcaaagccctgcaactctgaaataagaactgggctgtgacactgcttcctctctctccctacactccaaacccaggaggactatctgagaagaaaaaggagaaattctgctctgggtaaggaaggagagaagttttctctattccctcctctgagcactggtctcacatcttcaggaagcccaacaggttagaagggtatgtgtgtgtgatctctgaggcttcaagattaacccaagttcaaagttttgctaatcacaaggcactggacattttgattgccgactaaagaatcttgatttttttta

SEQ ID NO: 170360 - DNA, 312 bp, Homo sapiens
atctcggctcactgtaacctctacctcctgggttcaagcgattctcctgcctcagcctccctagtagctgggattataggcacacaccactacaccgggctaatttttgtatttttactagagacagggtttcaccatgttggccagcctggtctcgaactcctgaccttaagtgatccagccgcctcagcctcccagagtgctgggattacaggcatgagccaccacgcctatccaggattggtgttcttataaaggaggttggagggagcttgtttgcctctcccaccatgtgaggatacagcaataggg

SEQ ID NO: 170361 - DNA, 497 bp, Homo sapiens
ctcgatctctcgacctggtgatccacccgcctgggcctcccaaagtgctgggattacaggcatgagccaccgtgcctggcccctcctgtgttctttaacacctcccaagcccaaaccctgttactggcagcaaatccgtgtgggtctgcagcaacctcaattcttgtctcctaagaagaaagaattcgactgaggggaataggcagaaggaaagaccaaggcagcctgggcaataggctctcatttagagcaggagagaaagtttattgaaaagctttagagcagggacaaaaggaatgaaagtacacttggaagagggctaagcgggcgacatgaaagacaagtgtgcagtttgaccttttgagttggggttttatatgttggcacacttctggggtcttgcgtcccttctccccagttcctcccttggggtgggctgttcacttaggcggtggcctaccagcgcctgggtggggagcatgcgcagtgtgtttact

SEQ ID NO: 170362 - DNA, 334 bp, Homo sapiens
tactgcctgttttacagaaatgactcacccatgagaaaaggcaaagaacagtagaaaacctgaatggtttattatagtgttatgtctgcaatttatggtcagagtcagtttgactctggtcttcacagagaaaataatacctgataagtctggatccagactgaaggaggaaatgtagtaagtagcagggaaatagtggtggggcacaggaaaattgtaagtgagcttctaaacataatggtgctccaaacagtcaaacatcataactcgtgtattttttatccgaagtgcttgaagctgtttcataaattccctagcacctcattatttgggt

SEQ ID NO: 170363 - DNA, 458 bp, Homo sapiens
cacgtcccatctgtgtaggaccccactgaaaatcggactgttcaactcacctggcagccactcccagagcccctggaactctggcccaaggctctctgactgactccttcccagatcttctcggcttagcggctgaagactgatactgcccgatcgcctcagaagccccctagaccatcacggatgccgagcttcaggtaactctcacaatggaaggcaggaacgtcaggcctctgagcccaagccaagccatcgcatcccctgtgacttgcacatatacacccagatggcctgaagtaactgaagaatcacaaaagaagtgaaaaggccctgccccgccttaactgatgacattccaccattgtgatttgttcctgccccaccttaactgagtgattaaccctgtgaatttccttctcctggctcagaagctcccccactgcaccttgtgacccccg

SEQ ID NO: 170364 - DNA, 165 bp, Homo sapiens
tagagcttaagtttaagtagagacaggcaataaacacaatacctaagtaaaaatccatagtactgtatattagaagataactaatgtggaaaaaataggacaaggtcaggaagatcagtagtgctggaagagtgcagtgttaaatagggtagtaagggtagattt

SEQ ID NO: 170365 - DNA, 302 bp, Homo sapiens
gaaataaatacttttcaacatacattgtcattatggttatatgttaataattctttggcttagactcgtagaagtagagttgttgaagcaaaggacttatacattttaataacctgtcaaattcttcaaaaagctattttaatttataatccctataatcactatcagtgttatgaaaaagcctatgttttgacaactcagaatttatacttttatttgcttatctaaggtatacaattttaatttaactttaaatttccctatttcattttagtttctctgattactaaggatatgaataa

SEQ ID NO: 170366 - DNA, 755 bp, Homo sapiens
tgagttatgggtcttcacgcagccagcatgctgtgttttgggctctgcctcttgtaatttttagaaattaattagtttattctttatttatatttatttatttatttattttcagatgggatcttactctgttgcccaggctggagtgcagtggtgcgatctcggctctctgcaacctccgcctcccaggttcaagtgattctcctgcctcggcctcctgagtagctgggatttcagaattccaggccatgaaagatcactgttttagtctgcgtggtgcagtggaacagatagacctcggtttgaatctcagctctactgtttactagacatgaaatggggaaatctaaaatgagatgccagaagcctcaaaaatggaaaaccccctgtgcttcacatctgaaaatctctgctgggggcagcaactttgagcctgtggggaaggaactgtccacgtggagtggtctggtgaatgcttaaggagctgcagaagggaaggtagtgaggagacagttaaatattgagcacgttttggtgcctagcattgtactggcctttcacatgctatgtttaatcacgcaggattgtatggaatgggattgtacagaatgaggcctgggtttgctaaatcctgggggagattgtctaagctgtcacttgaagggaaaactgtagcatgtgggacttaaaaacagcttgggatggagtttgaggtagggcgagagggaaaaagatcttggcagatacattctgaa

SEQ ID NO: 170367 - DNA, 105 bp, Homo sapiens
ggatggagacctccttctgcatatcccatcagtacccccaactctacaagccctacactgaatgtgtgatctccccgcaagtccatcattcctcctctaatggtc

SEQ ID NO: 170368 - DNA, 482 bp, Homo sapiens
tacagcaaggctatcccattcactagaagcttcagaaggtttaaatatacaaagcaattgaaaaacaagcagtgataatcagctaattaacatatcaaagaacagtaataacaaaactgtaactgcaatgaataatctaggtttgacaataattgacctgatagtttagtctcttccctcacctccacccaccattgtctactgtgcaaaggtgggatattaagtacctaatatgtgccagacactgaatctgtagacttgttctcatgggttcaaaaacttttttcaggctgagcacggtggctcacacctgtaatcccagcactttggaaggccaaggcgggcggatcacaaggtcaggagttcaagaccagcctggccaacatggtgaaaccccgtctctacaaaaaatacaaaaattagctgggtgtggtggcgtgagtctgtaatcccaagctactcgggaagctgaggcaggagaa

SEQ ID NO: 170369 - DNA, 311 bp, Homo sapiens
ggcagaggggaaccttccaccccagaggaaggaatttgagtcctaataccactggctgactaaagtgtcctggggctctaaataagtttgagtgtcagtcaggctacagagaatgttgtccttggaaaagccctggtacggcattggtctctgaggcagtgggcttgagatacaacccagtgcaacacctgctgcagtaatcacaggagtgttcacttcactctttccccaccaccaggcagtgcagtgcagggagagactccttcagcctgaggaaaggagaaggaagagatcagaagacttttttctta

SEQ ID NO: 170370 - DNA, 677 bp, Homo sapiens
gccactgcattccagcctgggaatagagcaagaacccatctcaaaaaaataaaaaatgaaatgtatcttgtggcaggtactttgagattatgtacatttcctgtttctcatactttcacaaactagtgttagcatccatcgatgattcctgtctgaaacggcttactgtggtggttgccgaatggtgatgtttgaaagctgtcgtcatcctctacacgttagagaactcttgtattttagagctttttctgctccccatctattcatttatgtatttatatttttaaagaaaaacttattctgacccttattaaagttagcaaggcacttagtgctttgggaggcaaggcaggacgatagcttgaggccaggagcttgagaccagcctgggcaacaaagtgaaacctcatgtctacagaaatttttaaaaattagccaagtgtggtggtgtgagcctgtagtcctagctccgtgggaggctgaggcaggaggatcacttgagtccaggggttcgaggctgcatgattgcaccactgtactccagcctaggtgacagagcaagaccttgtctcagaaaagcaagacaaagggcaggctgttcaggatgatcatgataggtatagggactgctgcaatgggattgtgtagtgggggagacctaggagcaggagtggggg

SEQ ID NO: 170371 - DNA, 368 bp, Homo sapiens
atgcctggcaccccatagagataagttgcagggactgccgtgaagggcatgaagggtggcccactttagtcatgcatttattcaatcacccaacaggcacagagcaggagcttcccatgttaggaattccagatgcaaaattatcagactcaatatggtgaagacatttttaggccactgatttctgtgtaatttgtgtccaatatttcaaagccatttaaaaaaggattttgactgcatgcctagtagctgtttcagatcattttttaagtacagaatggataattagtcttcagtgatttgcctcttaaatgtggccatttagtttgaactcctttttagttattttaaacagtatatgcttaaac

SEQ ID NO: 170372 - DNA, 290 bp, Homo sapiens
ccctgggtagatactccccttgcaacacagaggaagcttcatacccttggcagccagggaaggtgctctgctccaaactgcccaaggctgatcttgcatttgaatgatctaatgaggaagcagaaggcttaggtgcctctcccccagccaccattccctttaggaaatgtagtctcatggttctgatgggaaaatcatgaaattaaatattgatataatgaattccattgcaggaagtagtaattttaccagtagaaactgtcatttaattatatatgcatacatgcaaa

SEQ ID NO: 170373 - DNA, 471 bp, Homo sapiens
tggagtgaactttcactcactctcacctttgtaggtttctcaaaaacatatgaatttagaagcaagatacttggctttttcacatgactcaaaagaggtgtagaggaagagaagctccatcatcccacagatcttccagggtaacctggacacatccctaaatctccagctcctgggtctttgaaagcctgtttagggaaagaatttgtgattgtctcaaggttgagaggaaagagtttgggaaacaccaaggcatgggttggcaaaaagattacatcatcagtgaggaaatgaaatttccagaggtttttgccagatctgggaccagagacaaaggcctggatgaatttcctgtgtatttccatagaggtctgttatctagttgtatagagcctgtttcacaattaggctctttcaaatctggtatgttgatttaaatgccattataaataacttgataatgttgcctga

SEQ ID NO: 170374 - DNA, 419 bp, Homo sapiens
cagcacccactgcaattgtagatgataaaaatgaggcattcatcaagctaaccctttcgcctctagaatttcatgtgcactgagagaaaagtccattgatctacattcagctcttaaaaactgcacttgcttgttagaagacagaacatacactcaggaaaaacttcaggctgatactgctaagattttaacacatttataaaacttcccatcaatacctaatttattgagagtttttagcatgaagtgttgttgaattttgtcaaaggccttttctgcatctattgagataatcatgtggtttttgtctttggctctgtttatatgctggattacatttattgatttgcgtatattgacccaggcttgcatcccagggatgaagcccacttgatcatggtggataagctttttgatgt

SEQ ID NO: 170375 - DNA, 397 bp, Homo sapiens
cttgaagatgagcagcctgtggaaaatgatataatacatctatgcctacaatagagctccgcacagagaaagtgttcaataaacatttgctcaacaaagtaccaaaataatccccgactaggattctaagaacaaggaattggatctgttatatttgtattcctagcacctacacagtgcttagaacaatatgcactaaatatttatcttttaattggcatgcaatgacgacagtggaaaaaatggtggggctacaaataacatttcaaagacagaagcagaactcactgaccagaatggggaattgaaagaactctagtactatgcacagaaaaaggcaagtctagaagaggagttgagtttgaggaaagaagctaaatgtaagagaatagtatgt

SEQ ID NO: 170376 - DNA, 849 bp, Homo sapiens
tccccccacccaccaccccccaacacttagtcttctgaaaggtttgccaattttgattacctattcaaaaaaacattttcatttcattgatctttgtattcttttagtcttggtttcatttacttctgctcttttattatttctttctattaacattggtttgttttttagatgccttttttcacggagaaaaaaagaacaaaaaattgggggtttgtttggttttgcttttctagttccttgaggtgtatcgttaggttatttgaagtctttttacttttttgatatagacgtttattgctatacacttccctcttagaaccgcttttgctgtatcccataggttttggtattttgtttccattttcatttgtctcaagaaattttaaaatttactttaaaatttcttcattggtccatttgttgtttaatttccattaatttgtactgtttccaatgttcctctgattatagatttctagttttattccactgtgacaagataaatataatttcaattttaaaaatttgttaaaacttgttttgtgacctaatgtatgatcaatcctggagaatattccatgtgctgttgagaaaaatgtgtattctgcaactgttggatggaatgttctgtaaatatctgttaggtccatttggtccagagtacagtttaatgtctacgtttctttgtttcttttctgtctggatgatctgttcacattgaaagtgtggatgttccctagtattactgtattgcagtctatctctctctttaggtctattaatatttgctttatatatttgggtgctctggtgttgggtgtatatatatttaccattgttatatcc

SEQ ID NO: 170377 - DNA, 433 bp, Homo sapiens
ggtgcagggaaagaagtcgtaagagggaagttacacacatagttaaaaaaaaaagatctcaaatctacgctatacctcaaagaactagaaaaaaaaagttacacccaaagctagaagaaaggaaattctaaaaagatgacagcaaacataagtgaaagagagaatacaaaaacaatacgaaaaagctcaataaaagtaggagttgggccatatgggtttctcctgccccagcctcccgagtagctgggattacaggcgctcgctaccatgcccagctaatttttgtatttttagtagagatggggtttcactatgttggccaggctggtctcaaactcctgacctcaggtgatccactgctctcggcgtcccaaagttttgggattacaggcgtgagccatggcgcctggctgctaacattgttgttagttct

SEQ ID NO: 170378 - DNA, 570 bp, Homo sapiens
ctaaaggtaaaatgtgaatcctgaattagccgcaattaaatttttgacatctatgtgaatgggaacctaaaatatcaattattataacagaccaatggaacagagtagagaacccagagaaaccagatgccaagaacttacactggggaaaggacagtctcttaataaatggcgctgagaaactggatatccatatacggaagaataaaaatagatctctgtctttcatcatatacaaaaatcaacccaaaatggattaaagatttaaatgtggctgggcacggtggctcacacctggaatcccagcactttgggaggccgaggcaagcggatcacaaggtcaggagttcgcaaccagcctggccaacatggtgaaaccctgtctgtactacaaatacaaaaataaaaaaaaaaaaaaaaacccaacaaagaaacaaacaaacaaaaaaagatttaaatgtaagacctgaaactataaaactactcaaggaaaacatggtagaaatgctctaggatattggtctgggcaaaagattttggggggtaagacctcaaagatacaagcaacca

SEQ ID NO: 170379 - DNA, 239 bp, Homo sapiens
gttcttccacccaacgctcaagatttgcttcttcaagacaactctctgatcagctgagacccatagacacccagcttctaccacacatatgatggcattatcctagggcatggcagagcaacgcaagggaaaactctgggcccccaagtgatgtcatggaggagaactctcaacccagaactactacgtgagaaacaacgctctctcttctttaagccataggtgtgttgggaatcttt

SEQ ID NO: 170380 - DNA, 277 bp, Homo sapiens
atgaaggtgtggccgctggaagctgtcacttcaccactcctcttctgaagaaagagctgagccctgcacatgggagcattggtgaaaagggtggtagacgtttatcagtaaccttactggttttgtgctccatcctccatctcccaaagtccccctgaccttgccttcagctccaggaatggccacatgactcagacaaagccaaccagccatcccatttcagtggccagtgatgaatgattcagtgtttacccaaacgcatccaatcagggtgaat

SEQ ID NO: 170381 - DNA, 788 bp, Homo sapiens
ggaactgtcaggttcaatgaacaaagcgtggttgtgaatggaatgtcatggcctaagacaatgttagcaaggtgggtaagggtgcaggtcttgtgagtctgttaaagaaatatggtctactgcatgtgtgatgggaggcctttaagtggttttaagcagggaggtgacatttgctatccatttgttaaagatcactctgggctgctctgtgactactggatcataaaaagtaagagagggagatgcagggaaattgttgtggagattactgcagtagcataggctagagatgctggtggcttgaattggaggatggcagagagatagaaggagttagctggattagcaggtattttggaggtagagttgacagttcacagttcttgctgatagattggatgttgggatgaagtaaataaaggaaggtgtccggaatcatgccattattccagtttgaataatgaagtagatggtaagcaccttttagtgagatagggaaaactggggaaggaattgtttaagagggaagatttggagttgactctggacatacagagtttgaagagcttgtggcatccagatgaattggatgggctctaaagtcttttcgtctcctaatagaagaatgaagtctttccttttctgttaatgagttgctctttatttcctgcagacattctgatgtcaaaagcacatttagtttgttttactattgttgtgtatctgcaactcttctgcttgttgagtacaacaatgagttgctatgagaacacatggcaattcttgtg

SEQ ID NO: 170382 - DNA, 315 bp, Homo sapiens
caggggccagaaagctggtgacaccccttcagagccccgtctcctctggagccctcaggtttgatttgtcgctgctggagcatgagctccgagggtggcagttgcccccatccccacagtggccctctcactgggcccacctcagactgtcacaggctgggctccgggatccccagaagcccccgttgcagtctgggagcctcgtgcgtcggcagtgggtgagttatgatgtgagaaaatgtggggtgcagggaattggggtttccttttgagctcctgccccatctcgggcaccatcctcaccttagaaccgtg

SEQ ID NO: 170383 - DNA, 542 bp, Homo sapiens
ccaggttcttgctatcttgttgctccactgtgctcaccctgtggttgagtctgctgctccagtgcccacactcatgtccacacaccagccagtgagagaagggaaaggaccaaggggaagacacaccccctcctttagaggcatgatctaaaagtgacacgtggccttcactcatacccctttgaccagaatgtagtcacatggtcacacctcactgggagagaggtgagaaatggctgtcacgtcatgtccagtagttgtcatgtacaactgcgatgtgtgtgttagggaggggtagatatccgaggacaactagtaggtgcctgccatagcatgtgaggtccttttcagttttaaaaataaataatgtgtgcaagttccatgtctaattgcctattaacctatgaaaaaaattcagacactatccctcttgtgcagatgcctgtgtttgaaggtggcagaggaggtagatggaagaaagcccagcaggggtgaccttgtaaatttcgacagcatagtctgatggagtgtattcttttgtg

SEQ ID NO: 170384 - DNA, 201 bp, Homo sapiens
gtggttttggtgaaagcaaagggaaaagaagtaggagactatggatgctagagaaagtaatggaaaggaaacagtgacctccagaaactagagagatagaaacaagggcacttacaaaggggttggttttgtctccactgacaccaccatcttgtctcctcctctggcaccatggtggcctcctatctaatctagtcatat

SEQ ID NO: 170385 - DNA, 367 bp, Homo sapiens
cgcccggctaattttgtgtatttttagtagaggcggggtttcactgtgttagccaggatggtctcgatctcctgacctcatgatccgcccgcctctgcctcccaaagtgtggggaatacaggtgtgagccaccacgcccggccggtaacagtaaattttaattgtatttttaccacaataaaaaaaaatcctgatagacagatctagaacaaccatctcattttttactaacaaggaaactgaggtcagacagcagaaatgatggctgtgtgtggtggctcatgcctgtaatctcaacactttaagaggcctagttgggtggattgcttgagtctgggagtttgagagcagccaaggcaacatggta

SEQ ID NO: 170386 - DNA, 667 bp, Homo sapiens
tccattccagtgtcaatcaagttataaaaaaaatacgaaacacttactatatgctctgtcatgtactaagtgttttgagagccattagtttatttaagtaccaaaatgaacctatgaataattctgcctctgaaggaagagtttctagtttcaaatgctggctccatcattggcatataacctgactttatcacgcttcaattttctcatctagaaagcgggcataataaggattgttgtatttagtgagctaatataaaaatatgtgtatgttaaaaacacataataaatctaacaagcacaccacaaaacgaatagtaaatatatttggtactgcaagttggattttcaattataatgaaataactgactaacaaatctgtccgttctccaaaaacaagtagaaactgcatgaaatatttgaaacaatgatttttgaatcatgagtcacaggaaaacatataacaatggccaatgagagaaggaaaattagcactgtgggtgacacagccaacccaaactctgtctggcggcagtttcctgatcttagtgcagacaagggaactgaaacacaacaaagaacttactgaaatgtagagataattgaatttgggtaggataagaagtctgaaatttgtaaagcagaatttgtaaagagaagcagatc

SEQ ID NO: 170387 - DNA, 120 bp, Homo sapiens
ggtccccaagtgtccttcgtggagttcttattccgtgtgagcgaatcgtgcgtcggtgtttacttagctgtatggccccagcctgttaactgtgatctgttctacttctggagatttcta

SEQ ID NO: 170388 - DNA, 699 bp, Homo sapiens
cagcgtggggtcgcccggcagctcctccccacagagggtgagccaccagtgcagaggccactccacgaagaggcagcactgatgagaccggagcgcggctctgttccccccgtgcgtcctcccttgtttaactccagcagttgattttttttggaagccacagcgccccgtcatttctggttttaatcagcgcaggagctcagccgctggaccacacgttgtctgtgagccaggcagggtgcggactggagctgcagagttaacaaggttcctccagatgccagcgggggaggcctggggcggccagtggagaggagtgatcgttaataaggaacgtctggtcaaccccaagcccctcccagcggaggaactgagcaagccaggagccctccctcaactgggcagcacagggggattctgtaagcagagctgccctggcggagctgctcgggaggggtggggccaaagaaggggccggatggacgttgctggggtccctggagggagctggggggtcagaggtgcaggcagacagggaagacaaaggagggaaggaggagtggccgctgtggagctgctgtcctgcctggggaggccatgctgtcttttgcaagaattaaacgacttcctaagagagcgacggggagagccagactgcaggagggagggagaggcagagactgagaagccacagccctc

SEQ ID NO: 170389 - DNA, 348 bp, Homo sapiens
aatttatttcctgttctttctctttttagctcccaggattgctagagctccttgtagaatatttccgacgatgcctgattgagatctttggcattttaacaggagtatgaggtggggaagaagaagaaagaacaggaaataaattaagggagaaaagtggcctaagaacagaattattgacttgagagacctccccaagtcttctgtatcagttgggagaggcagagttgctcctttcccaaaggttctccacagagcaaattgttcatcttaatctcttctatgcccaacacaaagttctttcttctgcccaacctaccttcacgtaagcctatctccaggaacact

SEQ ID NO: 170390 - DNA, 650 bp, Homo sapiens
aaacttcgaggatccccgacgagttgtccgagttaaaagaactcctcagtaaaagaaagagggagagagagaaaaaaaggaaaagaagagaagagaaaagaaaagaaaaaagaaaaggaggaagggaggaaattgtgtcctatttatctttgtctttccagcaccaacccagtgctggccctcaataagtgcttggggaatgaaagatcactcgatcacttggccagtaaagcatcagaaccatggtttgatgccagaccctcctatgccaaatcccaagtccaggccattccctactcttctgcaaacagggggtgactggagaggggtagcaatagtagagaccccaacctgactcagcactatctgtatctgaactgaattacagaattactgaattacagggcacagtgaaagaacaaaacttcattaatcagaactctgcaaattcagggccgggcgcagtggctcatgcctgtaattccagcactctgggaggctgaggcgggtggatcacttgagatcaggagttcgagatcagcctggccaacatggcgaaaccccgtctctactaaaaatacaaaaattagccaggcatggtgatgggtatctgtaatcccagctactcaggagaatcacttgcacccaag

SEQ ID NO: 170391 - DNA, 208 bp, Homo sapiens
ctcaagattttaccatccttctacattctgcaaaagggattcattaaaagtttttaatcctttcaaaaaataggtactataccattgaaaaaaatccagactctcaaaataaatcctgaatggtttcttaatgttatcatactccattaaaaacagaaaagaaattcaaatgtgctaataaatgtactacatataccggaaaaagaat

SEQ ID NO: 170392 - DNA, 525 bp, Homo sapiens
ttgctttgtgatattttggggatgggactagcaaatagtggttttccccaatatcctgcctttagcagaactagatttaaaccattccaggcaaatgagaatctttaaaaaaaaataacttttttattttgaaataatgagactcatagctgcaaaacagtacgtagtacaaagagacccacgtacccttcacccagcatctcctaatgacattttatttcactgtagttcagtatcaaaaccagaaagttaacatcggcacattaccgttaactactggactagagaactcattcagttttcaccaacttttagcttgtattcatgtgtatctgtgtgtagtacgtatgtgtctgtccgtgtggttctatgcaattttaccgcacgttcagatctgtaaccagcaccacaatcaacatacaaaactattccatcaccacaagagaaatccattatgccaccactttgtattcacccccgttctacctgcctcaccccagtccctttaccctggcaactactaat

SEQ ID NO: 170393 - DNA, 109 bp, Homo sapiens
ctataatggccaaaaccaattttcagattgagaagaaaacataaactttcatgtaaaagattgcacaaacaacctgatatgtaaatctagctccactctactcttgcct

SEQ ID NO: 170394 - DNA, 452 bp, Homo sapiens
ggtgcaaatatgcacacacacaaaggttcttgcccggaggtgtgccatgaggaacgtggtgctgtcggcggatcagcacaagtaaacaaagaaggccaggcatgaggtcctgtctccagccaggtggaccagagtgggaacagagggagcagagagggaagagtgagcaggagaggctgtgatgaacttgtccctgaccagcgaagctatctgtcctgcggctggcagggactgtctcctgggcaccttggtaaaagactggtgattagttagttacaagctaagcagggctgagagtggatgtaaaggcgccaaattagctcttaccatctctgggaactagtacaaagtgagcttttcatctgctgaaatgctgtttatgaggcagtaaaatccagagccaagaggcatgaatgtatcctggttagggtaatactctcctgggcaagcag

SEQ ID NO: 170395 - DNA, 210 bp, Homo sapiens
tagacagggacttactctgtcaaataggctagggtgtagtggtgcgatcgtacctcactacagcctcaaactcccaggctcaagggatccgactgcccctccctcccaagtagaaggatcactggagcctgggaagtcgaggttgcattgagctatgatcacgctcctcttctgcagtctttggtgacagttgaagacgcttgtgttgac

SEQ ID NO: 170396 - DNA, 610 bp, Homo sapiens
agagagtggcataatataattgaaatgccggaggaaaacaaacacaaaaactaccaatcaagaatacttaacccagcaaagctatctttcataattgagaaggaaataatactttctccctcagtttcatgaaacatatgaattgcaaaactcaatggtatatgtaaaatagtgccatattcagaaaactgtaggactgtaataatggtgcataaggcaatttcatccctagtacatgagtcaaaaaacaaaaatattaatagcagctatagctaaaataaattatcaaggtatacacattaaaaatgatgtaaattctgccattaaaaacataatgttgagggggtatgaaaaagtatagaattgttgtatgcaaagttaattgttgtatgcaaagttaagttgttatcagcttatacttgattgtttataagctgttatcagtttatacttgattgtttataagatgttctgtgtaaacctcatggtaatcacaaagcaaaaatctttagtggaaatataaagcaaaaatagaaaggattcaaagcataccactatagaaaaccatcaaatcacaaaggaagacagcaagggaggaagacaaaaaaaa

SEQ ID NO: 170397 - DNA, 368 bp, Homo sapiens
ttagggcagatagaaacggcaaaatcattgtcttctgatcaccacccctactaattattgcagtgaagcctccttgcccatgtagaggtggctgggacagggcagaagaaggtggctgggcaggttggctcagagccccctgagatgggggatgaaggaggttaatttggcacatcgaaccccctcttctcataggagctttgaggtccttctcttgaatccagttggtaccgccccttgggctagcagaggaggagttgagcttgtctcctcctccccagtttccatagatttgccaggaagttggcaagtgggattctccttggctggtggaatttggggggacccaaaaggataggggtaagttg

SEQ ID NO: 170398 - DNA, 679 bp, Homo sapiens
gggaaggatgtactcgttatgaagcacatctccgctgtagctgacagtgctacatggaaccaagaaagtaacatgccccttgggtcctgtgtccagcatctcacagccaattgccactattcttccttggcaacttctgggatgctccaaagcatttattctgagtgagcttgggtagagttctgtggggcgctgagctgagaggatttgttctggaggcctttcttctgggagtgggtcgggtggctgttaatctttagaagggcacctccagcaaatctacttagctgcaacagaatcagcattctttgaaggggcaggggacagccatgacaccgcagctttcctgtccaggactcttctgacacactgctggaggcagctgccttcttttctgggaagggaggggtcttccaagtgccatgcaccctaggagtttcctctttctttggaggttctgagtgcaacttgggtgtcttgctagggggctggttctttttattcagaaagcctctctgttccaaaagttgccatttcttaacaaaattttgtgcttggcagttctttctaatgcctttttgggaggaggttccaccaaatcccgattgaggagtcaggtagacatggggacagtgggtggtggagggtgtgagggtggggtgggggagtgggggaatac

SEQ ID NO: 170399 - DNA, 192 bp, Homo sapiens
gctgctccctccttcctcgactggtccccgccacgccctccttccctgactggtcctcgccacgccctcctccctggtgctgacagctctgtcggcatgtgactgtgcctgtgagggttgcattggtttatagtttacacataaggaggctgcttttctaaaggaaatacaagttttagttgaacttgtgga

SEQ ID NO: 170400 - DNA, 579 bp, Homo sapiens
tttaaactcaaggagattaaggtaggcaataatattgcaattaagatgctaccattcaataaaagcttctactctgtatttttttcaaaacacatgacaaaaaaattaagcaaaagatagatttctttaaatccaacatgtacaataaatatactattctctatactttttcactccatgagacgcattcaactaaaaataacatttaacggtcattattctaattgtctttatcttcattcttagcaattatcaatgtcatagaataacaaacccatgatgacactgatgaaaagtatggagcaagctgtggaaccacagcttactggttgggaataactgattgatctagtccaactcgtttctctaaagaagcagcatcttagggcagtaagggtaaaaatcttgaccaagattcactctactcataggaggtagccctagaaatacaataaagcttttcatcaattacccccaactttgtggaagttaaataagccttctctgtgaaatctttgaaattagacatatcttcatttttgagatatatcaattaggaagagagccagttacctacaa

SEQ ID NO: 170401 - DNA, 128 bp, Homo sapiens
acaaagtttaaaggcagtaaatgaaatgaggtaaaatggagcactggtgttatgtgccttttcatatgagcctttacatataattatttgatccttttgttattgtttgggttagtgttttaagccct

SEQ ID NO: 170402 - DNA, 627 bp, Homo sapiens
ataagtaaacacttaaactacgtgaatggtttaatattgattaaacaatgatctccaagactaaactctaagcatggtaggtagaaggctctggaaggagaaaaaacaaagagtgggcttaatggtgtgcattgatttacagagaagtgtggactttgacctgccagatcaaaatcaggatttgcaatgattacccaaaatacagtcctagggtcccacccctgcaagctgatggtgaggctgggggctgaatggtcagggtcaaggatcaagttcttccctcagaaaggccagcttctcatccacacccacttccagaaatggaaactcaggcaaagtgtgggctcaaattgcatttcatttattgtttctaactacgggccacagacttcaacttgattagaaaattgtgctgacgcttcctgtgaagcatatcctgagacttccagaggaacttcagaagggaattttttgcacgtacccacttcttccaaatggcattccccctgcttggcagagcctgtggccacacatctgcccagacgcctgggcaggagactctgccaaggaagcactgttgaccagcttcttgggctcctgttgggagagggaaggtaggttccctct

SEQ ID NO: 170403 - DNA, 609 bp, Homo sapiens
ggagagcctctcctctggggtggctttcggacaaggctctgcttccccactggcccagcgtctctggctctcccgctgtgcggtctccagggctctgggtgctgcctggcgctggtgcaggcgtggcgcggctcgcaacgctccctgcagctgccatcgccccacaggctttcatacctggtttgggtggttcatttaatgaggacagtgggttctcgcgaacatcatggctggtgatttcctcggcagccttcaggggctgagaagactctattagcagcggccttctgcattcctccagcgcaccgggcactgtcatgcccatcggggtgacaccctcaggccccgtacgccccttggatgatgccgccagtgacgtgggggctcctgttgggtttctcccagtcggggacggcacttgctggctgctggaggcatggctggtgtttcccctcagaaggttttgtgaggctgcaggatcatttgttgcggagcccttcttctgcattgatatttcattagattccggcaacggatgcttcacatctctgagctcagaggtcctctctcctgaaatatcgtcaggattcctgggaccgtgtgaattct

SEQ ID NO: 170404 - DNA, 160 bp, Homo sapiens
tctggattcatctcttgattatctcccaccttcgatgcaggagcctgccacacctacccactggaactcaggaggagggcgggaaggaaggcctgagtcagggtttttaggaggagcagtaattcaaacatttcaggatatgccgcctggaggttctttg

SEQ ID NO: 170405 - DNA, 177 bp, Homo sapiens
tgaggaaggcgcttctcccgggctgctggcactgacgattgtttgctgagatcagaagtgaagacaagctctgctgccaggcgctcgccttgtgccaggctaatgcctgaagcacatctttccctcagtcctcacaacaacctgggaagtgactgcgtctttccccatttgacagag

SEQ ID NO: 170406 - DNA, 402 bp, Homo sapiens
aatttttttttttcaatggagtgggggcaaataaaagtaaagtgactttccacgcatagcagatccaatatgctcaaatgtcacccaaaggagtagagttaaagccatggctggaagttcatgagcatcaatcctgactcagtatattgaagagtattttagaagtaaaagctgtaccaaacatgggattagtcttcttgtcattcattcataaactttttatttctttagagatgaggtcttgctatgttgcccagggtggactcaaattcctgggctcaactgatcctctctcctcaacctccagagtagctaggactacaggcatgggtcactgtgccctgccgagaattcacaaacatttcttgagtgaagactctttgttatgcatggtgctagatt

SEQ ID NO: 170407 - DNA, 227 bp, Homo sapiens
ccaagctggacttgaagtcccggcttctagtgatccacctgcctcagcctcccaaagtgttgggaatataggcgtgagccactgcgcccagtttaatctgtcttttgttcaagggtctgttggatacagtgagttctagatttctcttagaggactcagcatgtatgttcagttctttgttctccatttaactcgtgcatagtttcagtaaacaaccttttccacca

SEQ ID NO: 170408 - DNA, 291 bp, Homo sapiens
ctcagtcactggggtcacaagagtaggcagctaaatgtggcctggccagagacagcactcattcctgcttcccacctgtgagacaaggtgtatgtggccaaggagaggccttccatgagactcagaaggtgaggagaggcagagaaatggcttctctcacctgtcaatcccgactgataagggcactgactgtggctgctgcagccatctttcccaacacagaacaagggcctaggaaggaagccagcactcccaggaaagccagtgtggagagagacagtgtggagagag

SEQ ID NO: 170409 - DNA, 432 bp, Homo sapiens
ctcatggcttggtgctgtcctcttgatagtgaattctcacaagatctgattgtttaaaagtgtgtgccacctcctccctctcttggtcttgctcctgctcttgccatgtaacacacctgcttcctctttgccttccactataaggtttctgaggccctcacgagaaaccaagcagatgttggtgccatgcttgtatagcctgcagaaccgtaaaccagttaaatcgcttttctttataaattcacagtctcaagcattcctttacaacaatgcaagaatggcctaactctgcggtcatttctccagtccctgaatgtatgaatggaatagatacactgggtatttggcccaaattctcatagtgggttctttacttatgagacaagagccatcgaagtagcgaaggtagaagcctctgaaaccgccctcctg

SEQ ID NO: 170410 - DNA, 628 bp, Homo sapiens
cgtggctaattcatactcatcctttaacactaggcctacaattgggcatgattttgtagatgatggaaacattctaaatttggattatggtgatggttgcagaaacccataaactggctaaaaatcattaaattatacacttcgagtgagtggatcttatatgagttctacctcaataaagctgtttaaaaaaatcaagcactagcaacacttctccaagaatcctccctggtgacccaccccatccagtataagccacaaatactccttttctgtgtcctagaacatcctgaacatacctcttcacagcacttaccatactgtatttcaattacatatgcatgtgttcaccttgctaatggtgagctccaaaatttaacactacctatggcacacagtaagtagtcaaatgtttatttaataaactaattggtatcttttctgttctcaacatatttactgctgatgagacaaatattagaagaaatgaatcttgccctaagccttaagttctaattcaggaaataaagggaatcaacaatttatttgagttcctgtggcttctggaacgttcacatacattaatttagctaaccctgtgagaaaagcagtatttttccatgtttat

SEQ ID NO: 170411 - DNA, 510 bp, Homo sapiens
ggccctgtccctacttccatctccaccttgtcctactctggttaaatagggagtacattgttttgccatatttctgttttatacatttctaggactgaacattttacagcaaacttgtattgcctttgtatgttcaagaaaaattatttttagaaatttaagcctgggcaacatagtgagacccagtctgtacaaaatatgaattaaaaaaaacttaaaaaatcagcaggcatgatggcgcacgcctgtagtcccagccacttggcaggctgaagtgggagggttgctcgagcccaggaggtcgaggcaggagtgagctatgacggtaccactgcaatccagcctgggcagcagagcaaggccctgtctcaaaaaataataataaaaataggccaggcacggtggctcatgcctgtaatcctagcactttgggaggcagaggcaggcagatcacctgaggtcaggggttcgagacctgcctggccaacatggtgaaatgccatctctact

SEQ ID NO: 170412 - DNA, 274 bp, Homo sapiens
attgattatagtccagaaaattgagcttaagagggggttaagtaaattagaataataaacttaatacgttctactagttctatgatatgtcaattgtactgtaagaaaactgttctgtagtcaggaaaatttacatttcactaagttaagtaaaattaattattaccattaactataaggacaaatttaaatttcaggactgaaggattcactccttatagttaagtaaaattattactattaagtaaataactattgctacttacatagtact

SEQ ID NO: 170413 - DNA, 380 bp, Homo sapiens
caagtattctaatgttggactttccaataacaaatataagtaatgagtagaaaagaggacctcaaaattacaggcgtctttgagcaaactcaaaaccttgcacatgtagaagtctggacctgagcggtaacaagtagttctgggagccccagggcaaaggaatgagggtgcatgccatgcggacactctcccagcctcacctcagttaaaacggagatgagaatctctgttctaccaacctcatgggattgtctggaggatgaaataagagaatatatacatgaaagagccttgaaaagtgtaatacaaagcatgatacaaaacaaaagggagtcctgactggagcgaggagaaaagcggccagtggaggggagcggccg

SEQ ID NO: 170414 - DNA, 168 bp, Homo sapiens
catgtcttccttaattccttatatgattttcccctttctgcaactatatttgcctgtgagaatatttctctgttttcactgagtttaaaagacttttctgagtcacttcatatgaacaccatcaggcatctttttctagaaaacttctgcactatcttaattttctct

SEQ ID NO: 170415 - DNA, 243 bp, Homo sapiens
gacaggtgaaaatcacagagtggcatgaaaatttccaagaatgtctaggtaggaaattccaggtaggtgccagtgcttagctttgtttcagggagcctccagcttaaaaatgcctgctgacatctgttgcctgtcccctgtatttctggctagggcaactgtccttaaataatacttgagccattgggggattttgaagaatttgggtaaagaaacgaagagagaaaagtttctctggaaagg

SEQ ID NO: 170416 - DNA, 303 bp, Homo sapiens
catgtgttggaaacttcattccccatccagcagtgttgagggggcggatttttaagaggggatgggtcacggggccctgccctcatgaaagcgttagttatcgcaggaggggttcctgataaaagaataagtacaggccccttcccctctcttcctctcctgcaggcaagcatgccctcttgcccgtccaccttccaccatgggatgatgcagcaagaaggccctcaccagatgtgggccccttgaccttggacttcccagcgttgagaactgtaagaataaatctttgttctttagaaatta

SEQ ID NO: 170417 - DNA, 386 bp, Homo sapiens
aactgtcaaaactcaacaacaaaaaaagtgaacaacccagatagaacatgagcaaaagacatgaagcgacatttcaccaaagaagataaacacatggcaagtaggcccatagaaagatgtacaacattattggtcattagggaaatgcaaattaatattccaataagacaccaccacacacctatgagaatagctaaaatcacaaaatgacggcaacgtcagatcctggcgaggatgcagagaaacgatcactcacacattactggtgggaatgtaaagtgacacagctacacggtgccaaacagtttctttacaaatggaacatgcaaccaccatgcaacctagcaattgaactcctggcatttatcccagagaaataaaaagtt

SEQ ID NO: 170418 - DNA, 307 bp, Homo sapiens
tggtattcccgccccctcccccctccgccacatttaggtctttaatctaccagtttttaaaaatatggtgtgagaagggtatataattttttcacatacagacatgcaattgtcctagtgccatttattgaaaagttactaatttctccactgtgtcacgtatcaagttctcatgtatctgtttctgtaccatagatttacatgtctatcctggcatcacaagggctgtgttatcactatagttttataagccctactgtcttttatgataggtactcccctatttttcctgtttaaaaaaaaaaaa

SEQ ID NO: 170419 - DNA, 342 bp, Homo sapiens
aagacacatagcggggcttcttgaagtgaataaagacaaggatttgtcctggggcatttgtggaaaacgtagaggtcctaaaatatttcattgcagaagacccatttggcagggggtaccaattttcaggactgtcctttacactggggacttcagagcaagaatgtattgcatactgtgtaataacccaatggaatccctgattacctatgagtaacaactatggtaataagtactatttatcagagagtaatgtagactctagagacgtgggacatcaggcaagttgtttaaaccctctttgtctcaatttcttgacctacaaattggggtaataacagt

SEQ ID NO: 170420 - DNA, 795 bp, Homo sapiens
cctggcattttcaccaccccgtaacactgccaaattactagtttactaagttccaaaaggttgaccaccattcatccatcctgttttataattgggcttctgggaccaagtgggtaccttctattaccccacagctatacccttgtgcttttcccatcatctttcctcctcaaacaggccccagatgctaaggaatggcagcatagtgacggaatttatcctcgtgggctttcagcagagctccacttccacacgagcattgctctttgccctcttcttggccctctacagcctcaccatggccatgaatggcctcatcatctttatcacctcctggacagaccccaagctcaacagccccatgtacttcttcctcggccatctgtctctcctggatgtctgcttcatcaccactaccatcccacagatgttgatccacctcgtggtcagggaccacattgtctcctttgtatgttgcatgacccagatgtactttgtcttctgtgttggtgtggccgagtgcatcctcttggctttcatggcctatgaccgttatgttgctatctgctacccacttaactatgtcccgatcataagccagaaggtctgtgtcaggcttgtgggaactgcctggttctttgggctgatcaatggcatctttctcgagtatatttcattccgagagcccttccgcagagacaaccacatagaaagcttcttctgtgaggcccccatagtgattggcctctcttgtggggaccctcagtttagtctgtgggcaatctttgccgatgc

SEQ ID NO: 170421 - DNA, 354 bp, Homo sapiens
ggggagttggggtgaagggtcccttcagatccaccacctgctacctcaggagggagccccactgtgttttgagtcggagtgggcagggggaaatccagtatcttgctgtacctatctacactaaggcatgaagtaacgtctagaaaaacagttctcggctggttgtggtggctcacacctataatcccagcactttgggagactgaggctggatgatcgcttcagtccaggggttggagcctgggcaacagagtgagacctcatctctattttatgaaaaaagttcaaaccacctgtgtggggaagaccaggtctctccacattctagctagcttcccgcctctggcggctttt

SEQ ID NO: 170422 - DNA, 453 bp, Homo sapiens
tcttcccctagtttaggtcacagcagttgagtcagggtatcatgctatcgcagggcacaaatttctatcatcatccatagatcactggattagttgaaaaagtcactcaaatgctgaccaggagcacatgaacttctgtttatttcggactttctgataaatggtggccaggtacacaaggttgaatctgttaaaattcactctaaaacacaatttgtcaaaaggaattaaaaatagcagaaaaaaagtccatttaaaccacacacccaaatcgactgttagtgtggactctcagttctaaatagtaaagaaaaaataactgccattcccacaggtttctgtgttcccatctttcctaatgacctttcctatgacatccttcatgcaataaatacagctcaacctttcagccaaaaccctgtagttctaggctctttcatgataatgatgaag

SEQ ID NO: 170423 - DNA, 368 bp, Homo sapiens
tttttgcatttttgaagagatagtttgccatattgcccaggctggtctcaaactcctgggctcaagctctctgcctgccccagcctcccaagtagctgggatcacagactcatgccaccatgcccggccaaattttgtattttcagtagagatgggatttcaccacgttagccaggctggtcttgaactcctgatctcaggtgatctacctgccacggccttccagagtgctgggattacagacatgagccactgcacccggccgaacttttatcttgaagtagatagtgtcaacaaatacaaaaataaaaataatgtctttaaatgaggtgatgtttagagctatatccatgaaaaatatgggatag

SEQ ID NO: 170424 - DNA, 388 bp, Homo sapiens
acaaccaactagatttaattgacattattggaaactctatacgacagggaatgtacattctttccaagtgcacatgaatgttcatgtggatcatatttggggacataaaaatctgaaaatatttacaaatgtggaaaatataaatatcatacaaaatgtatatctcaaatcataataaaattaaactagaaattaataaaagaaagatacttggaaaatgcctaaatatttagaagttaaacaacagacttttaaataatgtataggccaaagaggaagaatcaggggaaatttttaaaacgtattctgagttgaataaaaataacaatataaagcatcaaaactaatggattttagcttaagcagagtttagagggaaatgtataat

SEQ ID NO: 170425 - DNA, 734 bp, Homo sapiens
gggaagccttctgggagatgaggacacctaaggctgggtagagtttttccagctgaaggacattgaggtacatcctagtttctatcatcaggtagttcgttaggctatttcatatattcatgcccaaattagtggtttgggctgtgcactttctgaggatggagacaattcaaatgtctaccattgtcaggaaggtaacacaagtgagtgagacaggaaagatgtgagggacgtacactatagactgaagactgctcctctctaaaggggcagggctcctctgttgcagcctagcatttctgggcaagaatgcatgccctgtgtgatcaggttgtccaattttgtaagaggagccagaacttctgatttttaggtaaatatctactgatttttaaatgctgatcccttattcatctttttaaataatccagatcccaaatatgggctccgttgatgagctgtctcttaacttcccattggtcttttcaggccagtgcttaatgggatccttcactaccagcactcaggctcccattgctccagcacccactccactgaggctctttctaggaattgatgtggttatttactgagcctcgagagggcttactctgataccacaaggatttgggaaagtacaacagattttagagccaagagactatgagtggtctaattctccttaccactgatgataatgatatatttttttcttgattgtgactaattatatg

SEQ ID NO: 170426 - DNA, 889 bp, Homo sapiens
attcccatagatgagtggacggcagagatcactgtgtattccccacaacagatcatcaaagtgtatgttggaagccactggtacgcaaccaccctgcagacactgctgaagtatccagaactgctgtccaaccctcagagagtgtactggatcacatatggacaaaccctgctcatccacggggatggccagatgttccgacacattctcaacttcctgagacttggcaaactgtttttaccatctgaatttaaggaatggcccctcttctgccaggaggtggaggaataccacattccatccctctcagaagcccttgcacaatgtgaagcatacaagtcatggactcaggagaaagaatctgaaaatgaagaagctttttccatcaggaggctgcatgtggtgacagaagggccagggtcactggtggagttcagtagagacactaaagaaaccacagcctacatgcctgtggacttcgaagactgcagtgacaggactccatggaacaaggctaagggaaacctggtcaggtccaaccagatggatgaggctgagcagtacactcggcccatccaggtgtccctatgccgaaatgccaagagggctggcaaccctagcacatactcacactgccgtggcttgtgtaccaatcctggacactgggggagccaccctgagagccccccaaagaagaaatgcaccacaatcaacctcacacagaaatctgaaaccaaagaccctcccgccactcccatgcaaaaactcatctccctggtgagagaatgggacatggtcaattgcaaacagtgggaattccagccactgacagccacacggagcagccccttggaggaggccaccctgcagctccccttgggaagcgagg

SEQ ID NO: 170427 - DNA, 706 bp, Homo sapiens
ctaattacattattccttcttgtactacattgccacttctttggggtttgggaggaaaatgaattttcagtctatcaacggggaagcagaagattttactcatctcatcactatttttaacaacagtgcagtggttatcttcatgtgtaagtcagtctacatctctagatattttctcatggtggttttctagaaatagataaactgttcagattatgaatttcttgactcttgatatagatattgacaagttgattcctcaaaaaagtaactaatttatattcttagtgggttattcaataaaaggtgggagcagttactcaagggtacctacattcacatctgaaccccttatgtgggtcttgtatctcagcttctgtggaaaatttggcctcttttctgaatcactaaacttttctgggcctcttttatttgtaaaactgggataatcataccctgaagtaatgtatggaaaagctcattgaaagtagtattttattatttcagcaagtgcttaagagcctcctacttgtactaaatacatgttctgtactaggaactatggaggatgtctaaatgatgtgaacctgggcctcaaaaccaatttacagcgcggtggttcacacctgtaatcccagcactttgggaggccgaggccggcggatcacgaggtcaggagatggagaccatcctggctaacatggtg

SEQ ID NO: 170428 - DNA, 848 bp, Homo sapiens
taatttacggggtcacaattaaacccataatacatatatatctcgatcttgcaacatatattatctcgatctttgcaacatccattttctccatgttatagatgaggaaattggcttagcatggttaagaaactagcccaatatctcacagctagtaggaggtagcactggaatttgaaccaaaattttattggctctgaagtctgtgtccctaagccttaattatgatatgaaactttttttcctgtaaggtaacaacaaaacaagaagaaaagagaatgcctggtttatttatagggctaatttaaatgtgttagaaatgtaccttgattattttcgtgcttgggaatggtaaaataatctcattttgcattgtgctaaataatgaatttttttgctttggtggttgtcttaaatgtgaccacatgaaaaccttgcacaggcagtcatctcagttatacatatagtctttgttctaagttgaaataatagcaatgttgactgttaaactgtttttaaaaataaaatatatgattttacctagattaaaaaaaaaaaaaaaaaaaaaaaaaccttttgggcgcgtgcggccccagaaaggttcaaaccccttctgtggcgcgggccaataggaatggaacctggccaacgtggaccaaagagctggcagcaggcgggtctcccccaaaaaaacgccgggaccgccttcgccatcaaggggtcgcgctcacgctcaacaggtcacacagtacccctctcgtgggacagaagcaggaaacagccgcagacaagcaccggcagagagcagcccacacaccagcacacagacgaacaccacacagaccacg

SEQ ID NO: 170429 - DNA, 824 bp, Homo sapiens
agagaaggaatctttatctgtttctcctttcccaagggcaatgccattatttctgtctctcatacagactggctgtgagagctgcataaagggccatgtgttgctggagggaagaaagaaatgcaaaagagacttcttagttgttgtggtccagcatgaatagcgcatggaatcatgggcatgaagtgggaagatagctggaaggtggatggtacaactgatggggtaaaaagtagtcaagagatcaaatgcatttcaccggacttcttaggctatgagggaccaagaagtcattcagaaggtgtggtgccctccgcacaggaagcagacactcggccaccttctccctgacccactgcgatggctaatttcattaaccaatgtcaacttgccaggattaagggattcccagatagctggtaaagcattattttgggtgtgtctatgaggatgtttccagaagagactggcattagaatcactttaaggtcctggatagaataaaaaggcagaggaaaggtgaatttgccctctccttcccattctcctggagctagggtacccttcttctcttgctcttggacatcagaactccaggctctctggcttttggactctgagacttgcaccagtggcaccccaggttcttaggactttggccttggactgaaagttacaccttcaggttccctggttctgaggcttccagagttgaactgagccacactgccagcttcccccattctatagcttgcagatggcctgcatgcgactcagcctccataagcgtatgagacaactcctctgataaatcccctcttata

SEQ ID NO: 170430 - DNA, 341 bp, Homo sapiens
cgagtaattaaatgtccgaggtcacctctgactccaacaccaacaaaagccctcaaaatagctactgtctcctgcctccaataagaaactgaaccaaaaataataaggcaaagaaggaagaggcagaaaaaatccaccagccaaggccagaggtggagatgataggttgcatgctgcatcctgcattcctcacagcgtagcaacagcagctggagaacaaggacccacaggaagagatggggtcagagggcccggattacaaaggtgatatgcagccttttctattatcctgaggcttatgaggagctatttgagggttccaaaacctgtaagaaggtctc

SEQ ID NO: 170431 - DNA, 644 bp, Homo sapiens
cgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactgtgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagca

SEQ ID NO: 170432 - DNA, 592 bp, Homo sapiens
cactctacccccgccccgccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170433 - DNA, 1666 bp, Homo sapiens
cgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactgtgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagtgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcattggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170434 - DNA, 1662 bp, Homo sapiens
cgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactgtgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagtgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgacctgcccggcccgttccaacttgcgcattggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170435 - DNA, 2519 bp, Homo sapiens
gaggactgagcagctggaggtgattttgcttttgcgtttcccgacgttgcacatctcaggtgaataagttctatgaagcgctcacactagtacgtggcccctcggtggtttgtcctcgaggtcgaaggtccagatgtccaggggctgccctggactccagagtggtgcggctgagcaggctgtggtcttgggtgcttgggcacctcccgtctctccctgctcagagttcttctctcctgggcagccagaaaggatcagaaccggtcacatgcagagcggcctcccgtatcccacagcagctccgttctctaatctgggtcttcagatgcggctgtgtctcccgggcaccttgcttggaatgtgttgcatccctcggagtccagcagcccttaggcagagctgggtgccgagcttgagtccaggagggcctcagacacctgcgatcttgcagcctgttgccctggacagtgggtgtgctgtgggtggaggatggcgccctgcctccacggaagcatccccagcttgcccctcagtcacacgaagcgtctgtccccagcctggggcatttctgagtggcctccacttggcctcttcctttttctggagcaagtatttgaactcctgcaggcgccagagatctccttacctgtttcccgctacccttctccagccaggtttctgccctcggccagattgtcctgcagtgacttgcttttggccatggagtagtggctgctcagtgcctgagattgttttagcagcagaagggaccgggtccccctgctgctggcaacacagacgcttgcttacagttctctggtcctggacacctgaggtctcggcctccccaggacggcccttccagattctcaggaccgccttgccctccctgccctgtctcctaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagtgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170436 - DNA, 1850 bp, Homo sapiens
cgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagtgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170437 - DNA, 1764 bp, Homo sapiens
cgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagtgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170438 - DNA, 789 bp, Homo sapiens
cgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactgtgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170439 - DNA, 1353 bp, Homo sapiens
gaggactgagcagctggaggtgattttgcttttgcgtttcccgacgttgcacatctcaggtgaataagttctatgaagcgctcacactagtacgtggcccctcggtggtttgtcctcgaggtcgaaggtccagatgtccaggggctgccctggactccagagtggtgcggctgagcaggctgtggtcttgggtgcttgggcacctcccgtctctccctgctcagagttcttctctcctgggcagccagaaaggatcagaaccggtcacatgcagagcggcctcccgtatcccacagcagctccgttctctaatctgggtcttcagatgcggctgtgtctcccgggcaccttgcttggaatgtgttgcatccctcggagtccagcagcccttaggcagagctgggtgccgagcttgagtccaggagggcctcagacacctgcgatcttgcagcctgttgccctggacagtgggtgtgctgtgggtggaggatggcgccctgcctccacggaagcatccccagcttgcccctcagtcacacgaagcgtctgtccccagcctggggcatttctgagtggcctccacttggcctcttcctttttctggagcaagtatttgaactcctgcaggcgccagagatctccttacctgtttcccgctacccttctccagccaggtttctgccctcggccagattgtcctgcagtgacttgcttttggccatggagtagtggctgctcagtgcctgagattgttttagcagcagaagggaccgggtccccctgctgctggcaacacagacgcttgcttacagttctctggtcctggacacctgaggtctcggcctccccaggacggcccttccagattctcaggaccgccttgccctccctgccctgtctcctaggtgaccctggcaaagatgagagtgcacatttcgtcctgcctgaaggtccaggagcagatggccaactgccccaagttcgtccccgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagca

SEQ ID NO: 170440 - DNA, 2007 bp, Homo sapiens
cgcggcgcagtagcggctgtgactagcgggccggcccgggccaggacagcgggcggcgggcggcgcgggcctggccccgggatggctatgttccgcagcctggtggcctcggctcagcagcggcagccgccggccgggccggcgggcggcgacagcggcctggaggcgcagtacacctgccccatctgcctggaggtctatcaccggcccgtggccatcggcagctgcggccacacgttctgcggggagtgtctccagccctgcctgcaggtgccatccccgctgtgcccactgtgccgcctgcccttcgaccccaagaaggtggacaaggccacccacgtggagaagcagctctcatcctacaaagcgccctgtcgaggctgcaacaaaaaggtgaccctggcaaagatgagagtgcacatttcgtcctgcctgaaggtccaggagcagatggccaactgccccaagttcgtccccgtggtgcccacatcacagcctatccccagcaacatccccaacaggtccaccttcgcctgcccgtactgtggtgcccgcaacctggaccagcaggagctggtgaagcactgtgtggaaagccaccgcagcgaccccaaccgcgtggtgtgccccatctgctcggcaatgccctggggggaccccagctacaagagcgccaacttcctgcagcacctgcttcaccgacacaagttctcctacgacacctttgtggactacagtattgacgaggaggccgccttccaggctgctctggccctgtctctctctgagaactgaagggaagcgcagccacccgcctgcgtctggggtcagggatgtccccgctcctgtgtcgcacctggcacctgctcgggagtgcacctcaccggactgagctcacaggaggagcctgcacccgcgcagaaggggagccggggccgagcctccgggcctgaatacgggccagccgccgaggccgccagagcagggccgcctggtcccaccggcgtcgctgggttcttcggtgcttctggccgagcaggcggcctacttgggcagggctggacgctgggacctggagctgccgccgtctcttcaaagccatgataccccctcgtgggaagaagggaccgacgcgcgagtcgcgctccgcagtcgagccgggaggaacccaggctgctgccctgcccagcccgaccctgccccggccccgcttccaccttgcgcatttggtactggcttttgtgatacttaggaaccctggcatcttttctatattatccagtgtgataatcttttcacgttttatagagcaaagacagagcagttactcttcatattgcaatatctgtgtttgactaggaataatagtatttttatggaacatttacaaaattatattttttaagaaaacaatcaaaacaagcattgggggattggggcaaggatggaaggagcagtggggcagctgccagagctcaggcgagccatggggtctgctgtggggtctgccctggccacccactgtgtgtctgggtccttgaggtttgtacgtttctctttgatgaccaggaagaaatcccagcaccccagccacaggctgtggctgctcccagcagaggcggggccggcagagaaggggcctcctccacccagagtcctggccttggcccgctgtcaccttcaaagctgactgtgccccgctgcgggaggggacggcaccccagtggtggcaaagcttgggggcctgggcaggggcccgcttggcgggccgggcaacacgtcaacattcttttctgttcttggcattaattattgctgtctttttttaaaaaaaaaaagtttaaataaaatgtctcagagcaaaaaaaagcgggcgtcaaaatacctgagggccatttacggcaccgtttgcacaggccctatggaagaaaacagagagccttaaaccgaaaaactccgatcgcagacacttgcaacgccccaatccagaaaatatgctcgacaata

SEQ ID NO: 170441 - DNA, 511 bp, Homo sapiens
ctggcctttgttgttttttttttttatttaagctcacaggctgtacgggcataggcagtgtgtgccatagtttgccatccccttcccagcgtcggggaagaggcgggtaagttctagacatctcaaaggagaaagaaaaatattgtctgagcaatggatgattgtcttgaaagcttccagataattaggctaagacaagttgtttcatttatctgttcccctgcttagcttggtcggaatctagtggtgtgtctgctgctaacatttatgatgattcacttcagactcaaggagggctgttggcttatctgcactggctgtcttggaggctgatttgagaggttttgtttggagctatggaattcagtcatgcttcatcatgcctctggtttatttaaaaacaaacaaaaatactgttttcgccatggctgtggtcctacccacaacctgctcccagcatttgagtgctgtgtgggctgggtcattcctgcttccccaggtcacgctaacc

SEQ ID NO: 170442 - DNA, 536 bp, Homo sapiens
aacctcccctagcgggctcaagtgatcttcctgccctggcctcccaaagtgctgagattacaggtgccggccaccaggcccggctaatttttttgtattttttgtagagacgagttttcactacattggccaggctggtctcaaactcctgacctcatgaaccacccaccttggcctcccaaagtgctgggatttcaggcatgagccactgcgcctggctggattgcattacttttagcacttctgtcgcttaaaagtgtatcccggcccctctggaaaggcccgatttccttcactgaaaatcacctcaccttagctcacgtcaatgcctccacaccatgtctcttggggcatctctgtcgacttactcacccactgctccccgcctttccagcttctgttttttttttttatcttctgctgattctcctggtagaagtttaattcactctcagggcctgagctctctggcccctgctggagactcgcaaagtaacatgtctgctactaacgtctcatctgcactctaacccgct

SEQ ID NO: 170443 - DNA, 349 bp, Homo sapiens
ttgatgctccgggcagttcttgcggaagttgatatgcagaaccatggagccgcagcttcggggtcaggctcatacccagcagccctgcttccttgtttaattacctgaagagcaaaacagtcaggctgggagtgtgtgaaaacccagtatctctcacagccgcctggcgctctgacatcctgcaaggccagccctgtctgtccgccagcgtcaggctggctcaaaccctgggttcctttctttcgggaggcattgtgtggaagagggtttggtcaggaatttgaggttcctgccaatgctgtgtcccctgctctccccttgtggaccacactgacagacatgcttgatt

SEQ ID NO: 170444 - DNA, 455 bp, Homo sapiens
caatctgtcatctaacaattgagctctttgtgattgttgaaaagcatatattaaatttctccagaaaaaagaatctattaaaaatcatgtaggaaggtgaaagactattttatatagcattataatgagcccaaattggctttttaagtcttgaagtccctgaaatgcacagagaacactatggaaaaatgcacacacacctttcgaacctgattttaacacaaaccttcatccttttatcttaatatgatgccaataaaaccatacccagctacatttcatctagtgttattggaggaaatatgtatcatattaacagaggcaaattctttcagtattgtacatgttgggtacaatatacactacttgggtgacaggtgcactaaagtcacagacttcaccactatacaattcatccatgtagccaaaaaccacttgtacctcaaaacctattg

SEQ ID NO: 170445 - DNA, 887 bp, Homo sapiens
catagtgcgcactaccccttcctgtggatgacggacactcctcacagccagcagctgggcgtttgcttagtttcccagatttttattttaccaacagtgctgcctgtgtgcacagcccggctgctggcgcacgctgtctgtggatggaggtatcaacttgacagtgctgactagatggctttacttccatcagcactttgtgtaaacgtgcaggaatttttacaaggtcaaagacagactacacagtaaattttggcaagggtgcagagatgtgtgctgaagaggagcttctccaggctccttttctctccccggagtagtcatttctctcatcggagttggctggaaccaaagctcagtgctttgtctgatttggcaccaccctgggggcatttggcagtgtctggagacacttggttgtcaggatgcgggacagtggaggccgggatgctgcctgacatcctgtgacatgcagcacggtgcccacctgtaccaccccacaaagaatcccccggccccgtggtcagcagcaccacgattgtgagatcctagtcgcagggcatcttgaacagcatctccttttgacggcctgtctcccggcgcagcgacgttcttcttggcgcttggattacaagtgcttctgcattcccacaacgtttccttacatctgaggctgaaacctgagctgacacgtgtgtgtcaagcgattcgtggagcacctgcgcacagagtgggccagtggtgaggggtggggactcttttctccgtggtggagtagcaggctctctgcctcaaccagtggtgccgagagtaaagtcatgacctgtgccaatctccctctttcccccacctctccagctcgatacacagctcctccgtgtacccag

SEQ ID NO: 170446 - DNA, 423 bp, Homo sapiens
agcctatagagcacattgaggtcttttggttcgccctcagtgaactttatcacatcaagcaggagatgtcggtgagcctcgctgccctgctgtgctccacccattggccccccttgcagcagcattcaggagaagacagaggcagcgtcttctgccagcctcctcggactggaaggagtaacaaggctttgaaggcatgcaggaataacacccacacagagccccaggggacatggatcgaggtctgaaaagcatttcttcccaccctctgctgagtcacctggactgccagaggtagagctggcatagggagtttgccagaagacatcaggaagaaacctctattttctctacaaacatcctttgagaacatttcaaacctgcattgacgttgatacgatgatcagaaaacgctcatacaca

SEQ ID NO: 170447 - DNA, 317 bp, Homo sapiens
atttttactagtctaggcatggagttgggggctattagcagtaagaaggcctcatggataagtgatttttgaggtgaatgtattgtgctgtggtcctaaactgctgtgaggtgaacaacgtaggcagtgtgacatcagtggaccaggtagccaagactgctgctaagtgactataagattggtagcatatagagcatggataccccagacaaaggaatgattcatgtccagggcaggatggagtgggacagcctgagatttcatcatgctactcaacacagtgcagtttaaaacttaagaattctttatttctggaa

SEQ ID NO: 170448 - DNA, 260 bp, Homo sapiens
aaacacaacagaatttataagggttaggaggtgaaattaaggaaattttcaagaaagtgtagtaaaaagagaaagaatagaaaataacgtagaaaaaataagaagcttagaggattggttcttacatccaaaaatagtacaccagattcagagaacataaaaaatggaggacagaaaaccatcaaaggaataattcaccaaaatttctcaaaaacagaagtttcctgattaaaagggaataacaacagatgatcatgaaa

SEQ ID NO: 170449 - DNA, 394 bp, Homo sapiens
ctcttggtgaggaacactagaactgattcctcctctgtagctgtaattttggaggggactcaatgaatacttctccgtgcatctgaactaaggctgacaccaggtatgagctccatgagtgggagaggcctccacactgcaggtggaagacaggccagtatccgcagactgtgttcttgcagctgatgctcagcagctcaccagagcccgagtccccattgacatccctcatcctagtttttcttctttatctgacctgaaatacctctcctgtctggctcctctctatttctgggtaccccttcaacttaattcaggccttggtcatcttttccttcctctctgctctctctggctctgaataaagacaagagagaaacaaccccattttatg

SEQ ID NO: 170450 - DNA, 497 bp, Homo sapiens
ttcaaagtctgccattcctgaatgctggaagaactgccaattagcaaatacctggaacatttctgtaactttatttttgtaaacaatgttgtaaattcaggaagaatatggcaggtctagaataagacttgaagatgtctatttttgcaaagtgattcttgtgttcaggcagcatacctaggagtgtcctcagcttttcagcccgtcctgcctcagtgcagggccatgttgagaacaatctggggatgtttcctactttggctgccactagaatcacgaggggagctttaaaaatatgaatacctaaatcccaccctcagagattccagtgcaatacgtctgggacactgcttgggtatcaggattttaaaataattcctaggtgattctaatctgtagctaaatctgaggaccaatgggatagttgttcttttttttttttttttgtggcagggtctcaatctgtcatccaggctcactgcagtggctcactgcag

SEQ ID NO: 170451 - DNA, 324 bp, Homo sapiens
ctgacttcagcctcctcatctgtaaacagaggccactggtgtctgctttccaagatccctcacacagctctggaattctagagtatgtgtgcagcaagggtcagaaggagaaactacacagccaccagaagcaactttcttaactttctgcttcaaggttgaaagagaagacaagggctgggtgcggtagctcacgcctgtaatcccagctatttgggaggctgaggcaggcggatcacctgaggttaggagttcacgaccagcctggccaacaccatgaaaccccgtctctactaaaaaatgcaaaaatcaggccaggcacgg

SEQ ID NO: 170452 - DNA, 146 bp, Homo sapiens
tttctggtagagtcatggcatgatttgactttactgaaacccatctggttgttctggtaagaataggtggcaagtgtggagcagggccaaacaggaaaaccagtcaggaggcaactgcaatactctaagataaagactagtggttt

SEQ ID NO: 170453 - DNA, 108 bp, Homo sapiens
gagtgatggatggaatgcctgtacttggaatatttttaaattaatctattttcattacattgaaagtatgacacacagagaacactaaaattggatgaggcactacct

SEQ ID NO: 170454 - DNA, 167 bp, Homo sapiens
agaaattatgctgggttcattggatatatctatgggaaaaaaatgaatcttgacctctacctcacaccacatacaaaaattaattttacatgggttacagatcaaaatatgaaggaacaaatgataaagattttgaggaaaacctaagaaaatacctttttcacttg

SEQ ID NO: 170455 - DNA, 418 bp, Homo sapiens
gacaaacaatattcaggacagcctcatgaccttaggcttgaaatctagaatatttgggcatggatggtcctctgagatcacttagtcttgatagatttaaactactaatttcaatatttgtgaatttgcattatttgcgacaacagacattgtttagaaacccgaggaaagttatctgctgcagtctatcatgaggacggtgggctatcacaatcacaggtattttttttggggggggggatgagaaagggcctctgaggataagcctcaccccatcctttcctcgggagaggagtgaaatgtctccagaagcaactgcaccactgcaaatacttcaccctccaagtatcacaggggaagccattccggcttctctatttgaaaacagttaccatattccccctcagtttgcctctta

SEQ ID NO: 170456 - DNA, 540 bp, Homo sapiens
atgtgaagtactggctcccccttcgtcttccaccatgattgtaagttctccgaggcctccccagaaactgagcagatactgccatgcttcctgtacagcctgtgggaccatgagccagttaagcctcttttcttttaaattacccagactcaggtatttttttatagcagtgttagagctgactaatacagactctaattggcaatgtatgacaaaatgcaaaaataaattttttcaaaagtatatgaggtagtgattcattacctgggatcattaaactttgaggtatctctccaggggtccttaagattttttattggcttttaagtaaacattttatttaagtataacatatttagaaaagtgcagtaggaggtagtgtacagcttaataaattttttacaggctgaacacacttggggaactagagaccaagtctgaaatcagaacatgacgagttctccacaagttcccttataccttcctctagtaagtactccacctaatcatcattctggcttctaacacaatagattaatt

SEQ ID NO: 170457 - DNA, 1110 bp, Homo sapiens
gaggactggagagacatggcagatgctacctgcacacttttggtaatattctgtgtgatgggatatgaaatggtccatagaaaaaaaccggaaaaatacgccaaggttaggttcattctaagagtctaaaaatttcaaaaaccaaaacaacattataaatggtgtttctcaaggacctttcactacctttttagattgtgcttgtgattttcaggcaagctaaatgtctgatgaagactgctcttcttttgttctgtgtctgacctactaattcctgcccatgcttcaaactcagttcagaaatcactgaaggaaccatccactgccggcctgcctgcaaccacagctgacagctgagttagttaggttttcctgtccctattatttaccagtttgtactgaaatgctttcatgggctgtgcttccagattatgagttctgtggaatcaggaagtatgtctctgtattcttgtattctttggcttttttgtgtagtaaagggactcaagtaatgtttgacagtgaaggatacaacttcattccttgcctgctttgataaattttagtaataaattcccaaaactatcatgttgattaaaaataaaaagtaaccgtaacctcacacattaactttattcaaacaaacagcacttacaggaaatgtaaagtagaaaaagatttctgcccactttacctacggagacatgataaacacgcaaaaaaaacctagaaattaagcaaaaaatagcacaataatttaactgaaagcaacaagggcaaaactgtctccttttgtagtttgtggtaccttatagtagtgctcattcagtttcgtttgcttgataaatctgaggactatgagatatcagagttactagtagggtaggagtgctgtaagggtactgggagaagtaggattagttaggggcagatcttgaattctggccaagaaactgatatttaacccataaagagatagtcactatatgttatcaaataggagaataacacaaatgagaaatgactgttaattcctgatgcataataacagttgtgagctttagtttaatgtaatatttgtaataaaaacgtttggccaggcaccatggc

SEQ ID NO: 170458 - DNA, 426 bp, Homo sapiens
gaaaaacccatctgtgtaccaggggtagtatatggcctactttgaaaagctcacatattaaaagtattaataatccttggctctatagcctggatctggctggtagtttagcaggttattagctgagtaacctttgtcaagttacttaatctctgtttcttcatttgttaaacgggcataagaatcactactttgtagggttgttgtaagaatgaaagatgatcatttaaatggccaagtgtaaaagtggcacctagtagacaatgaatggttgttattcaagacacagttcttccaaagaactatccctgtttcagccaaagcctactgtctgcagttgtagctagtttatcgcaaagcaaatgtctttgaatgctttaaaccttggatttgttatataaggttgagcatgtttgtgtcatttgt

SEQ ID NO: 170459 - DNA, 255 bp, Homo sapiens
acagccactgctgtgtttggggtgctgcagagcataatcataaatgtgggagtccagatacaggtcagctgttagggctccaggagtgtgcggacccctgccctcacctctttgtgtcaccggagctccggattaagggctttctgacaactcctgaccacactcctcatcttctttccctccctttgctgatgaagcaactgtcttcatttagctgcctgatggagaacatctgcctccaggcaccacagaaat

SEQ ID NO: 170460 - DNA, 238 bp, Homo sapiens
gatgtttgttgcaaaaaggttagtgggagcgtgtggatgacttgccccaaacccatccccactactggagaaacacctctacatggcctgaagcatctctgttctgaggacagccctttacattaacaattgtttaccaggtgccgaatgcttatcatctgagagagcagaactcacaggtgtgcaggctaggtaacaggaatatatgcttgaaagcagtgctttatccactatctgg

SEQ ID NO: 170461 - DNA, 251 bp, Homo sapiens
tgatttattagtacttacgaatgctctggggtgctttcctttattcattcagtcaacaagtacttatgaaacactcatttcagtgccaggtactgaggtagtcactagggatacagtggtgaacaaaagacaaagacatcctaatgggaaaatgagtaaacaaagaaatggtctgctattttgtagtaatttatattatgaagaagaaaaataaagcaggataagggtgagagagtgttggggataacatc

SEQ ID NO: 170462 - DNA, 515 bp, Homo sapiens
gaggcccccttctccatgggtggcaaatcctcacctatcgagtgagccatcatgccctggaagtccagcatccagtggttccaatctctctgccataactactgccaaaactaaaaaactactatgttttttagttgctaccacttcaaaagagtgaagagtcatttcaactctttaattctcccataaattaaagataatgaccatagtgtgcttggaaaactatgtttaggccgggtgcagtggctcacgtctgtagtcccagcactttgggaggctgaagtgggaggatcgcttgagcccaggagttcaagaccagcctggtcaacatagcaagacccttcatctacaaaaaaataaaaaaattagccaggcttggtggcatgtgcctgtggtcccagctactcagaaggctaaggtgggaagattgcttgagcccaggaggtcaaggctgccgtgagctgtgatcatgccactgcgctccagcctgggaaacagagcgagactctgtctct

SEQ ID NO: 170463 - DNA, 468 bp, Homo sapiens
gagctgaggggtagagctggggacaggcagaaatggctgcctctgggggtcccgtcctggtgggctcaggcgtctccttggcagagtgcttggagcgcagatgtgcagcagttggtcagtttcaggggatttcccacctttctaaggcttttcagcctgcttaaggaagaaagcggatgggtgatctgatggctccgcacacacggggtgtggcgggagagaggagggcttccctcccttgcgctgccttgggccagctcgccctcagggtgaggcctggccctcctggctctgtgcagcctcccagaaccacgtgctctttggtgacacagtcgccacctcgtgcagcctacccccggggccttcctgtgcccctgtcccctggactccggttgtctgtatctgggtgttaccatgccccttagtcctgcccaggcacagtctgcactctctcctgagcacccgtgc

SEQ ID NO: 170464 - DNA, 278 bp, Homo sapiens
tctttagttacctttgtgtccccagagcctagcaaacagtgagggcttattttatttttaattatctgggtgtggtagcgtgtgcccatagttccagctgctcaggaggctaaggtcagaggatcccttgagcctgggagttcagggctgcagtgagctctggtcacaccactgcactccagcctgggcgacagagtgagaccctgtttcagaagaaaacaaaaagttcttttttttccttttcctttttttttttttgagatggagtctcactctgt

SEQ ID NO: 170465 - DNA, 456 bp, Homo sapiens
ccactcagcacagaccttgacagataggtttttgttttttgcttttttgaagtacatgatatagacaggaacacagatttttaaatggtagctgttactaagtgtgggagagagctttgactctggcagtttgggatggcctttcaaaattgacaagtgtggttgtaagggttagagagtaagttggtgatgaatgatacactactctttggagaataaagagccaggtgtgagggtagagtgttctaggattaggagacttggatgtgtttgaaacctgaggagtaagaaattggtggagagaagggactctgagaggatgccagcagtattggctacagctttttcatcttccccaattatccagtaaaagcagagctccctttaatattgggagcaatattaatatgtttactcttatcacttgtatttatcattgtattagaggtcctaaca

SEQ ID NO: 170466 - DNA, 284 bp, Homo sapiens
ttcaagtctttggtggcatctctttcaagtttcccagtgcacctgactcagaagatagaatcagtctgttagctgaggtctctctgtgctggagaagcatgaaaagggccccaccagcatagactcagttctctttgaagtttaagatccatctacaaatggccatgttctttccttagcagaaggtattggggtttctacatacatgctactcactgctcacgtgtaagtaaggtaaaatttgagcaagtggaaaatgaccctgctgtaatccagatcataat

SEQ ID NO: 170467 - DNA, 198 bp, Homo sapiens
ccatgaaccctccaggtacacacttgaggttttaatattcctctagttgatatccagacctgtgaaatttttttttctgacgttatattcggaaacccaaatgactattcttattcatctttcccagtttttccccactctgtgtgcctaattttgccatttctcaccaattgtgaccttaaaaaattaaattcagta

SEQ ID NO: 170468 - DNA, 335 bp, Homo sapiens
ggagcacatctgacccgtatcattctggctgctgtgtagggaacagactcaggggcaggcttggggattgcagcaggcaggagttggtggtggctcaggacagggtggtgacagtggcacggcgtgaggggatctgatgtgtttggaagggagggccttgatggattgggtgtgaaagagaggaagccagagttttggcctgagcgactggcacactagagatgctgttcaccaacatggggaagccgtggtggttgagcaaggagattaagcatgagatacctgtcaagacacccaatgaggggtcaggaaggtggcagagacaggaatctgga

SEQ ID NO: 170469 - DNA, 207 bp, Homo sapiens
tagcttagtctttccatcatagaatcccctggcctctgcttagcgtctttatccctctcattcacataatggctgcttttcaaggctaagtccagtttcaaagagagcaatgctagcactctgctattctttctttctttgtacatgcctttagacattttaaactaagccttctgtcaaggctgaatatatgtgggatctgaaatg

SEQ ID NO: 170470 - DNA, 366 bp, Homo sapiens
tctttttcattgttatgtttccagtgtttagtagagctcttggtgtttaataattgtttactgaatgaaagaatgaaaatcaactttaccatgaacattagtcacagttcctcctatctctttattccctttcgtatctgttatgttggcctctgtttttctcacatttatttatttttattattattattatttttgctgttgttagtaagaaacctcaccaggaatttctcacatgtctttattttgtgcatctatttctacaaattgaccgtccatatagtgcttattttaatggctctgtaatctgtattcccattatagtttacttagcttttctccaggtgttaggcactctagcattca

SEQ ID NO: 170471 - DNA, 107 bp, Homo sapiens
aacataatttcaataggcactgattttgtcatttaatgctgagaagaggcaaaaaccctatatggattcttagaaataggactatgttggaatggaagagatggcag

SEQ ID NO: 170472 - DNA, 957 bp, Homo sapiens
gcagtccaacctgggcaaaatagtgagagaccctgtatctgaaagtaataataaaaataaaaaatataaatgaggtctcgttgatgttggacaattcaagaattcagacttgaaccttaaacctaggaaaagttactttgtatcaggattctaacaattatgcttcatatttgtgaagtcctttaaaacataattttctcaagttctttctttgagatctcaatctgtcttagcattttgtaactaataactgaaattttattcaaaggaattgtaaaccttaaaccaccaatttatttccatgtgaaaaagtgttacatatgacaagtgttttttgactgtaattgcgttaaatcttttgagaatgtaaatgccgggctaggcaattgcagttaatacatacagaggttagtgaagggcttattaagttgtaggggaagcaagctgggaagaatcagatcagatattttcctgacaaaaaaaaatgaccctacagagagcatcaaaatgtggtgttcttgttaagtaattgatcgtggtcttcgctttaatcttagttccgccaggcacggtggctcacacctgtaatcccagcactttgggaggccaaggcgggcggatcagctgaggtcaggagttggagaccagcggtggcaacctggtgacccccgtctctactaaagataagaaaatcaggctgagtgtgtcgggggtgcctgtggatccaggtacttgggagactgagcggagatggcttgaacccaggaggccacgttgcgtgactcgagatgggccaatgggcccgctgggacacaacaatttgctcaccattgaatcagacctctccccgggagtaaatggcccctaacgggtaagtaacaatgggcgggggggcaccgatccactggggggcgggccacacggaaatccccggcagtgtaacaaagcgacagcgga

SEQ ID NO: 170473 - DNA, 369 bp, Homo sapiens
ctagaggaacaccagacccacatgagacctctatcagcagaactgctggtgaaaatgtgaggaatgtctctgtccttccctgactcatcagacctcaggatgaccttccttcctgacacagccctcctgcgcaagtaactcaccatcttcctgtgcccagctaccaccagacacctgcaggtgagctcactgcaagcttggcgtcgtggtgctgcgcacagccctcttcagcacacagtgtcagcaccgtcctataaaatctccagccagcctttgtttctttgcagtcggcatctctcatgcaggctgccctgtctccttgcaacctatttttctactttctccaataaatcagcctttttctgccta

SEQ ID NO: 170474 - DNA, 109 bp, Homo sapiens
ccctcaccaagagcctgctcagcactctccaatttgatggacaccaaaatccttgccttggtccccttggtcctgcgtgccctcctctctggcctcatctcaagccagc

SEQ ID NO: 170475 - DNA, 261 bp, Homo sapiens
cgacagtccctcgtgttctggagaaaccagcctcccgctgcagtgaggtctcccatggtgacgggccatctcctggcctggctgggtgaccgcaagtggctatcctcagtcttgacggggtgtgtgtgtcacagtccaccgtgtggccacatggagctcaccattgagagggaaactcggcagcgcggtggggtcctccggacagaggctcagaaggcgagagaccaggggctcggtgcatcctgtgtcagcgtccactgt

SEQ ID NO: 170476 - DNA, 168 bp, Homo sapiens
ttgtgtagcctctgctgggaattcaagacatgagatagaagaaaacattaaccctaactctccaattatataggaaataatggataattcaaataacaggactccaaaatgctcagtacaaatgtgcaactgattttaacctcgtccaaataaagacgaatgaaacaa

SEQ ID NO: 170477 - DNA, 368 bp, Homo sapiens
  misc_feature (338)..(338): n is a, c, g, or t
actactactactaaattcgcggccgcgtcgacgtcctggtggcttgcttggatgctggtattgagagtggtgggctgggtacgttctcaggcccctggccagcaggtgtggtgtgggtgatggcagtagcagtggtaggataaccctctgggtcttgagcagtgcactctggtgctgacagtagatacaatgtgctgagtgggccagtcttcaggcccgcaggtagcatgtgcagtaggtgccagctgtggtggtagcagcagggtgtgtgggcctaatctcaggcccctagaagaggtgctcaggtgctgatggtggtagactaggctaggtcgacncggccgcgaatttagtagtagtagtcgacc

SEQ ID NO: 170478 - DNA, 184 bp, Homo sapiens
cattaagagcaaagtagtaaagtgaaaaaatatataaaggcctggactaagaccagagcagtggggctagaaagggtgaattcaaacgacctttcagaggctgaattgacagaatcaagccaccgacttcagcatcagatagaatccaggctgggtgcagtggctcacacctctaatcccagca

SEQ ID NO: 170479 - DNA, 346 bp, Homo sapiens
tccaggatgggttaaacgttacctctatctccaccccgcatcttctaaagcatctgataagcgctagagaaaacatcctgtgtgcagaggtttagatgctgacacagggtgggggagcaccaacgacccaggggccacgaggagttaatcccccgagagataggggcctactctttggaaagttcagagaaagcaaagagaaaaaagattccaccggctgttacatgtggttaccaaaacacaaaacacaaatgtaggtagagactctgtagcccaaaattaagaaaacaacgaccaaaacttctttagtccaagcggacggtactcacaaaaaaaggaaaagaaa

SEQ ID NO: 170480 - DNA, 581 bp, Homo sapiens
acgcattcatcaaaaccaaagggactccactgaaatggatacatcagaaacatctgaaacttatttcccagcaccctttgtcaaagtgaagtgggaggaccacctgcattagaagcgcctggagagcttgagattgcacgtcttgtactaaaggttccacctagaggcaaaacctggggctttaatgaggtctgacttcatgtctaatccatattacaaaatgtgtctcaagatcctctttctaccatgccttcaggtagaaagggaaaaaacacttaggtatcatttcataagccccagaatgcctaagattacaaagactgagaacaccaaatactggcagggatgtagagtacctcacatactctacatgtggtaggtgtataaactggtacaaccgttttggaaaactgtttgacattctctcatacagttaaacatatacccaacaatcccactcatcagtattgaccccccaaataaaaatatatgttcaactgtagatttatgcatgaatgttcatggcaggtttgcttctcagtaaccccaagctggaaataaatcaaacgtctatccacatg

SEQ ID NO: 170481 - DNA, 397 bp, Homo sapiens
gttagctgggcgtggtgttgtgcgcctgtaatcccagctacttgggaggttgaggcaggagaattgcttgaacccgggaagtggaggttgcagtgagccgaaatcgtgccattgcactctggctccgggcaacagagcaagacagctctgtgcagagaacagactcctgcggtggaaatgctggctgcctttgaggctgggttctgtgaccttgggtttcccagcctgagcttccagtttcatttataaaaggggtgacgtggccgccttcctgcaggcgctctgaaggtggcagattacacagaggtggtacgactcatacaggtttctgcaaacgggggccccatcaacagtcacctttccttagcacagcgccttcctcctggggtgacctcgc

SEQ ID NO: 170482 - DNA, 211 bp, Homo sapiens
tgagccctccctggcccattccatgatgggcatacacactgcacatgtatactcatgcacacatacatacacacatgcatacacaccaatacacatatatgcacacatgtgcacccatatacatacatacaacaggcccctgtgaattctcagcagggcatccatgggcctgggccatgccctccatgccctctatgccctccatgcccat

SEQ ID NO: 170483 - DNA, 507 bp, Homo sapiens
gagagaactggctccttctagacaggggaatatcgtggttagggttctggagtcagattcaatctgggctctgtcacctactagctggggaacaaataattgcgccttggatcatcacctataaaactaataatagctactaatcagattgatgtaagtgccaggattaaatgagagagtctacaagctataaaaagtgctatgtggcagctgcctttaaacattcctaacattggctttgttattattgttgctgcatttccaggtaacgcagaagggcttctctcttccctagcccatccctctgcctcatttctctcacattcctgcttctcctctttctcttccttttcaaccctgcaaaagccttggcttcgggagcagtggcaggagggagggaagaggaggctgcagccgctacagcctcatgccacatgggggcagcaaggccctctgaaatgtgggcctgcctctcccaccgcaccttctggcgggtgcaatggccca

SEQ ID NO: 170484 - DNA, 330 bp, Homo sapiens
cttcggctcggtacccactttccgagtagagctgagggaaatgttactgtaagagtttatcaagaaatagtgctatatgagtgttggagagtatcaaaatatgattttagtgaaacacatttgtgctttccttcctatgttatgatatttaagatgatagtcaagtttattgtcctgacttcaaagaaatcttaatccttcactggaagttaagtttgaaaaagtccaatttgtatgtgagtcattgttgtgatatcatttagcatttgatggctcattgcactcagactaagtgttagttgttactaattttatttactctaacagtat

SEQ ID NO: 170485 - DNA, 256 bp, Homo sapiens
ccagctgtcaggggaaaatttgtcatatttgaaccgacttcttctgtgccaagaacaaggtcagaaataaaggaaaggaataccctgtcacttattggatttgacagtaaattactctttgatgaacagatggactacaagagatttaaattcataatcagagtgtaatcatgaggaacagtgatttgaaatcttctgtcaacccatcagtgaaggacatctcacgagccctagtcacagaatcctgttttggtct

SEQ ID NO: 170486 - DNA, 469 bp, Homo sapiens
tcgatcgagctcggacccagttctgcttcttgaaacagttcctgcttcttgccagtcctcggggtctactccaggggtacaaggtgagagtggctctccagagtgcatttgccttttggtgccgcactgcatcctcactttgaccctgagcgctgcagtaagccctgcagggtgctccaccttgaagcacgggaagatctgatgctggccgccttcttccttcggttgcctgaaagggcccgtgtttatccttcgcttcacagagaacgcaacacacaacattaaacacacatagagagtgaaagagaacaaggcatcttcatcaaggagggcgcaccatttaaccacccgcgaccttgcagtgcgcctctgcaaagtggggactccgctctgtagcaggagatgggggtgttgacgattttgaaagtagttctcagttttccgaggcaaaggtgtctggggctgacga

SEQ ID NO: 170487 - DNA, 5191 bp, Homo sapiens
  misc_feature (447)..(447): n is a, c, g, or t
  misc_feature (3107)..(3107): n is a, c, g, or t
cctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacantattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggagaaattttacaattccatgtgataagaactttccctggtcgaggaaatgttactgttaactggaaaattattgggcaaaatctagaactcaattttgctaactttagcggacaacttttctttcctgaggggtcgttgaatacaacattgtttgtgcatttgttggatgacaacattcctgaggagaaagaagtataccaagtcattctgtatgatgtcaggacacaaggagttccaccagccggaatcgccctgcttgatgctcaaggatatgcagctgtcctcacagtagaagccagtgatgaaccacatggagttttaaattttgctctttcatcaagatttgtgttactacaagaggctaacataacaattcagcttttcatcaacagagaatttggatctctaggagctatcaatgtcacatataccacggttcctggaatgctgagtctgaagaaccaaacagtaggaaacctagcagagccagaagttgattttgtccctatcattggctttctgattttagaagaaggggaaacagcagcagccatcaacattaccattcttgaggatgatgtaccagagctagaagaatatttcctggtgaatttaacttacgttggacttaccatggctgcttcaacttcatttcctcccagactagattcagaaggtttgactgcacaagttattattgatgccaatgatggggcccgaggtgtaattgaatggcaacaaagcaggtttgaagtaaatgaaacccatggaagtttaacattggtagcccagaggagcagagaacctcttggccatgtttccttatttgtgtatgctcagaatttggaagcacaagtggggctggattatatcttcaccccaatgattcttcattttgctgatggagaaaggtataaaaatgtcaatatcatgattcttgatgatgacattccagaaggagatgaaaaatttcagctgattttaacaaatccttctcctggactagagctagggaaaaatacaatagccttaattattgtccttgctaatgatgacggccctggagttctatcatttaacaacagtgagcactttttcctaagagagccaacagctctctacgtccaggagagtgttgcagtattgtacattgttcgggaacctgcacaaggattgtttggaacagtgacagttcagttcattgtgacagaagtgaattcctcaaatgaatctaaagatctgactccttccaaaggctatattgttttagaagaaggtgttcgattcaaggccctacaaatatctgccatattagacacggaaccagaaatggatgagtattttgtttgcaccttgtttaatccaactggaggtgctagactaggggtgcatgttcaaaccctgataacagttttgcaaaaccaggcccctttggggctattcagtatctctgcagttgaaaatagagccacctccatagacatcgaagaagccaataggaccgtgtatttaaatgtatctcgaactaatggcattgatttggctgtgagtgtgcagtgggagacagtatctgaaacagcctttggcatgaggggaatggatgttgtgttttccgtatttcaaagttttttggatgaatcagcttctggctggtgtttctttactttggaaaatttaatatatggtataatgttaagaaaatcatctgttactgtttaccgatggcaggggatttttattccagttgaggatttaaatatagaaaatcctaaaacttgtgaggcctttaatattggtttttctccctactttgtgattactcatgaagaaagaaatgaagaaaagccttctcttaacagtgtgtttacattcacatctggatttaaattattcctggtacaaacaatcattattctggaaagttctcaagtaagatattttacttcagacagccaagattatttaatcattgcaagtcaaagagatgattccgaattaactcaggtcttcaggtggaatggaggaagcttcgtgttgcatcaaaaactccctgtccgaggtgtgctgaccgtggccttgttcaacaagggaggctctgtgttcttagccatttcccaggctaatgccaggctaaactcccttttattcagatggtctggcagtgggtttattaactttcaagaggtgcctgtcagtgggacaacagaagttgaggctttgtcttcagccaatgatatttacctaatatttgccnaaaatgtctttctaggagatcagaattcaattgatattttcatctgggagatgggacagtcttccttcaggtattttcagtctgtagattttgctgctgttaacagaatccactccttcacaccagcctcaggaatagcccacatacttcttattggccaagatatgtctgctctttactgctggaattcggagcgtaatcaattctcttttgttctggaagtaccttctgcttatgatgtggcttctgttacagtaaagtcccttaattcaagcaagaatttaatagctctagtgggagctcattcacatatatatgagctagcctacatttccagccattctgactttattcctagttcaggtgaactgatatttgaacctggtgagagagaagctacaatagcagtaaatatccttgatgatacagttccagaaaaagaagaatccttcaaagttcaacttaaaaatcccaaaggaggagcagagattggcattaatgattctgtaacaataaccattctgtctaatgatgatgcctatggaattgttgcatttgctcagaattcattatataagcaagtggaagaaatggagcaagatagcctagtaaccttgaacgttgaacgcttaaaaggaacatatggccgtataaccatagcatgggaagctgatggaagtattagtgatatatttcctacctcaggagtgattttatttactgaaggccaggtactgtcaacaatcactctaactattcttgctgataatataccagagttatcagaggttgtgattgtaaccctcacccgtatcaccacagaaggggttgaggactcatacaaaggtgctactattgatcaggacagaagcaagtctgttataacaactttgcccaatgactcaccttttggcttggtgggctggcgtgctgcgtctgtcttcattagagtagcagagcctaaagaaaacaccaccactcttcagttacaaatagctcgagataaaggactacttggggatattgccattcacttgagagctcaacccaatttcttactgcatgtcgataatcaagctactgagaatgaagattatgtattgcaagaaacaataataataatgaaagaaaacataaaagaagctcatgccgaagtttccattttgccggatgaccttcctgaattggaggaaggatttattgtcactatcactgaggtgaacctggtgaactctgacttctctacaggacagccaagtgtgcggaggcccggaatggaaatagctgagataatgatagaagaaaatgacgatcccagaggaatttttatgtttcatgttactagaggcgctggggaagttattactgcctatgaggtgcctccacccttgaacgttcttcaagttcctgtagtccggctggctggaagctttggggcagtaaatgtttattggaaagcatcaccagacagtgctggcctggaagactttaaaccatctcatgggattcttgaatttgcagataaacaggttactgcaatgatagaaatcaccataattgatgatgctgaatttgaattgacagagacgttcaatatttccttgatcagtgttgctggaggtggcagacttggtgatgatgttgtggtaactgttgttattccacaaaatgattctccatttggagtatttggatttgaagaaaagactgtaagttaaacatatcaggggaaagccttgtttcaggctagcgtttcatgtaattttgagtagaaagtgtctcacatttttgttttggaagtcttggccaggcatggtggctcatgccagtaatcccagcactttgggaggccgcagcgggcagatcacgaggtcaggagattgacaccatcctggccaatatggttgaattcccgtctctactgaaagtacaaaaattagctgggcgtggtggcacatgcctgtattcccagatacttgggaggctgaggcaggagactcgcttgaacccaggaggcagaggttgcagtgagctgagatcacgccattgcactccagcctggcgacatagagagactccatctc

SEQ ID NO: 170488 - DNA, 621 bp, Homo sapiens
aaagtttctaagggaaaaattaattttttttgtttgtttttgtttttttgctatattataggtttgaagtaaatgaaacccatggaagtttaacattggtagcccagaggagcagagaacctcttggccatgtttccttatttgtgtatgctcagaatttggaagcacaagtggggctggattatatcttcaccccaatggtgggtctcaaaatctatcacagatgacttttacaaattattttataatcattattccttgagaattacagtgatttaggtcccatataaataaattattcttaaaaaccattgtatttttcacagtaaattaggacagaagatttcctcatggtaaaatagttcccttaactattttagtaaatataaattgaattttcattactattctaaatgttattctgtatgcattaactatttcattacagtatttgatactagagaatacaagctgtaatattaaagaatttatatcattagataatcttcccagaatgtttcttacacttcacgaaaattttaactctttcatttctttgtttttgctcactgaaacacgtttagtgttttaaaatacttttacttggtctcttcatgcctt

SEQ ID NO: 170489 - DNA, 1110 bp, Homo sapiens
  misc_feature (447)..(447): n is a, c, g, or t
cctgtatacctgtgccactttgtgccttaaggaacaagcttgctcagcgttttcatttttcagtgcttctgagggtccccagtgtttctggatgacatcatggatcagcccagctgtcaacaattcagacttctggacctacaggaaaaacatgaccagggtagcatctctttttagtggtcaggctgtggctgggagtgactatgagcctgtgacaaggcaatgggccataatgcaggaaggtgatgaattcgcaaatctcacagtgtctattcttcctgatgatttcccagagatggatgagagttttctaatttctctccttgaagttcacctcatgaacatttcagccagtttgaaaaatcagccaaccataggacagccaaatatttctacagttgtcatagcactaaatggtgatgcctttggagtgtttgtgatctacantattagtcccaatacttccgaagatggcttatttgttgaagttcaggagcagccccaaaccttggtggagctgatgatacacaggacagggggcagcttaggtcaagtggcagtcgaatggcgtgttgttggtggaacagctactgaaggtttagattttataggtgctggagagattctgacctttgctgaaggtgaaaccaaaaagacagtcattttaaccatcttggatgactctgaaccagaggatgacgaaagtatcatagttagtttggtgtacactgaaggtggaagtagaattttgccaagctccgacactgttagagtgaacattttggccaatgacaatgtggcaggaattgttagctttcagacagcttccagatctgtcataggtcatgaaggtgggttcctttttttgttaagcatattcattttcttttctatggatgttgtcttttgtctagttctttaaaacttgatagtttttccctttcattattttgttgaactgtgtgtgtgttaatctgcatagaacttctttgggagaaggctttataatgaactgtttagccagatttaggagccttgcaaaccaataccatgttctagcttgccattctctactggtatgattttaaggaagttaaacctgaaatgctt

SEQ ID NO: 170490 - DNA, 486 bp, Homo sapiens
tatagaatttttttatttctatgagatttacctatagtagctttctgtttaatgttcaatgttctataggagtttccttttaaatgttcagagcaggagctataccctctaggatatgcaaataatcaagtcttagcgaccttataaaatataatccacattatgaatcaaacagaatgagccttcagatctgattgcctaaggctcaaaatgttaatgctcctgaaatgccttgtacatattagctagttgaaattgcattaaaacaagagaacgaattgtagtcttgacctcagtctcatttcaccagcctttgcctgctactgccaacctgagaggggagcttctgctctgcagatggatggacagctgctgatcttcacctcctgtctgttcccacaattctaaaagaattaggcctgaggaacttaatcttctggtgttccattgtgaactgactttattaaattttttccaaagttcagt

SEQ ID NO: 170491 - DNA, 637 bp, Homo sapiens
cgacctcagcaatgcttgccaatgctttatccagatgctttctttgttgtttctggtaggtgttgctgacttgggtggagaggagccatagccccttttttctttatgctaatttcattctcctgttgcctatttcctgtctgtagactgcacatggccccggggggcttaaggtgattttccgaccttgcaatcacctcttaggatttttctgttaaacactcttaggtgtatgtgacagcagtagggacagaatgaactggcagtcctgtcacacgccgagctcaaagagagattggacagaaagagagagataaggtggtttaaaggcagaagtgtctcataaaccattaatactagggaggacgaaattcttatagtagtggtggctcaaaaatgatgacaacaaagctttgcagagcatctgctgtgaggcgaagaggtgagattctgggaagccaggacaagacactgtacccaggaactttatggtccaactgggtggggtgggaagcatggaaataaatcaatcccaatgcagggcggtctgtgtttagggtgccagctgatggctctcattggagtgcaggagagtgagcacatccaggcaggaagctttctgaaaggtggctttatg

SEQ ID NO: 170492 - DNA, 628 bp, Homo sapiens
cgcctgggtttgaatcctggctgtagcactcagccgtgtgacagcttaacctttccaggctttagtttcgttatctgtaagtcagggatattagtacctaggtttttgtgttgctgtaaagatcaaggggtcagtatgtataaatgcagaggacgatagtatctgtgctcagtaaacgccagttactgtcacagcgtgaagtggtcagtaattttgctggacaggagtctgattcctgggctcagtgaggcagtgtgaggagcacccacccaggtcctaaccaggtggtatcacatacttactcactgtcaggctgtgattaaagagaaaaacgagctttctttgtgggagtaaaaacaactcgcaaagaaagccaattgccaatgctgaaagcgtgaagcggcgtcaaggatctgtgtgtttcctggggaaaacagtgacatttgggttctctgtgcctctgggtcagatctttcacaaggtcaagggtctgtggtgtcagctgggcacacagcccagggcacacacatccagacagtgattagctcaagtttgcctgcggaggctgcgaggaggagatggctagagaagaattgcaattaagagcacccactgagtacatatatac

SEQ ID NO: 170493 - DNA, 799 bp, Homo sapiens
tcttggcattccaggcaacggaagagcctgaatgtgtcctgacttcttgcttagcaaaattggatcaccctgcactttgggaggccgaggcgggcggatcacgaggtcaggagatcgagaccatcccagctaaaacgcctgattatagtaactggctctgaattgctgcttctgctcaacttcctggatgctagcagtacccagggatgtaaagacctttcaactagagctcatagcaggcccttgtgtctgagaatgactgcttctgtgatctgatgagcacacgtggtgtgcatccagtggctctgctcttaaactaggcccatgactaccaacagtcattcttcctgggctgctgagaccagaaaataaaagtgccttccaaatggttcacagatgcagaggaattttgcctcaggatgaattgcatcttcagtctcacccaaacctgatttagataatatttcaatgagacttcggacttcagactttacagttgatgctgcaaccagttaaggcttttgggattgtcggaatggaatgaatgtattttgcatgtgagaagaacatgaagtgtgggggggccatgggcagaatattatggattgcatgattttgtctccccagaatacatatgttgaaattctaatccccaatgtgatggtattatgtggtgggaactttgggaggtaattaggttatgagggtggagacctcatgtaaaggattagtgcccttataagaagaaacacaagagcttgcttcctctctctgctctccactatgtgaagatagaaca

SEQ ID NO: 170494 - DNA, 767 bp, Homo sapiens
tcttggcattccaggcaacggaagagcctgaatgtgtcctgacttcttgcttagcaaaattggatcaccctgcactttgggaggccgaggcgggcggatcacgagcctgattatagtaactggctctgaattgctgcttctgctcaacttcctggatgctagcagtacccagggatgtaaagacctttcaactagagctcatagcaggcccttgtgtctgagaatgactgcttctgtgatctgatgagcacacgtggtgtgcatccagtggctctgctcttaaactaggcccatgactaccaacagtcattcttcctgggctgctgagaccagaaaataaaagtgccttccaaatggttcacagatgcagaggaattttgcctcaggatgaattgcatcttcagtctcacccaaacctgatttagataatatttcaatgagacttcggacttcagactttacagttgatgctgcaaccagttaaggcttttgggattgtcggaatggaatgaatgtattttgcatgtgagaagaacatgaagtgtgggggggccatgggcagaatattatggattgcatgattttgtctccccagaatacatatgttgaaattctaatccccaatgtgatggtattatgtggtgggaactttgggaggtaattaggttatgagggtggagacctcatgtaaaggattagtgcccttataagaagaaacacaagagcttgcttcctctctctgctctccactatgtgaagatagaaca

SEQ ID NO: 170495 - DNA, 944 bp, Homo sapiens
acctgaagagatgactgtcattctctgataagaggaaggagttacacctggtttgtgaacatatttatcttaataaatcacagggagttgttagagctcacccttttctttcatccaggagaatccagaagtgtcaatgtttctctggcaggagcccggcctgcaggttgggtgagaaactcacgaataggactctgacatgtgtgttcaactctcccttggaatgtctcacttttatttcagcacaattcccatgttcacctctgaggtgtaaggtggagtgggtagcctcctgcttggtgtgctaataaccaaaacagattaccaatcaccttccctttgttttccttggcatgctgaaaaaggcatacaaaaatactaatatgagcatcagagaaataaataaactcagaaaatacaagaagcagctgggcgcggtggctcatgcctgtaatcccagcactttgggaggccaaggtgggcggatcacctgaggtcaggagtttgagaacagcctgggcaacatggtggggccccgcctctactaaaaatataaaaattagtcaggggtgtggtggcctgtgcctgtagtccaggctgcttgggaggctgaggcaggagaattgcttgaactcggagggtggaggttgcagtgagccgagattgtgccactgtactacagcctgggtgacagagtgagtgagactccttctaaaaacaaaaaaacaaaaacaataaaaaagaaatacaaaaagcttagaacttgggtaatttttaaggtatagattttagattttagcaaaaatgtcttgcttctaggactggttttatcttatgccctttcttgagaattctaatgtctagtctcagaggacagtgaaaaactcacatatatctagtcagacttaactattgcatgtctctcgctgctcttcacaaggaag

SEQ ID NO: 170496 - DNA, 758 bp, Homo sapiens
attcacgttgttctccatacatggtttcttaggtgttggggggcagtcatctggaccatttactcagcttctagccacaatttctatttttttctctggggagtacatcttttgtataatgattcactcagaagccaagagtccttcctacaattcaaatgtaacagcagtagctactgttgttgtttattttccgttgtttatttattaagtattatgttaaatacttcagtatttttacagatttatgatgtagttgtcatacaaagaggtaggtacacagacatttgccagatcattctctgtcacactgcttaaagaaagagaacgttacaaatgcactttgagcatccggtgtacacttcagttgcattttccttcctgctcctgagagataaccactatcttctttaatgattatcatttccgtgtttatagttttatatgtttttaggtttcatggaaatagtattttattgtgtgtaatctctgccgcttgtattttttcattcaacattttgttttgtaagagttgtccatattgatgagtattcctctgataattttgtattttattgctctttgaaaaattcattgaatgactgtaccactatttattcattttcctgttaatgaaacagtgttactatggaattgttgtacatgtctccttgtacacagacttctctggatacatatatccaggagtggaattactatgtagtaggatatggacatcttcagattgactaggttgt

SEQ ID NO: 170497 - DNA, 510 bp, Homo sapiens
ccgcccagacgcggaggcaggcaccaggtcgacgaagaccatcccagcacagagcttccgctgaggacactgcaaggggcagccaatgcggaggcacagagctgtttgggaaaatcggtcagctggctctgagctgggaagaaagaggaattcacactgagcaacactctagccctttagtgggtctcattcccagaggataacaagatagagaaaatgttagcagaggcgttctcctaacagtgggatctggggggagtttgttttcctgcttctttatactttacaaaattcccacaacgaatgccataaaaaaaatgaaacaagatcataaaaaagagctggcaggtttggttacctgtgcgttggctctggggagctgacctttgtagggcgggtgctctgatgggggctgtaatgccgcggcgcccacaacctcacagggcactgtcttttaaccctaggtggatttcccaggcacgggccaagtcacctccccctgctgtcact

SEQ ID NO: 170498 - DNA, 2197 bp, Homo sapiens
cgccgcctccgccctcggcctcgcacttcctggcggagccatggctgcgcagcgggctggccgggggtctcctgaacccgggccccggccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaacttta

SEQ ID NO: 170499 - DNA, 2536 bp, Homo sapiens
cgccgcctccgccctcggcctcgcacttcctggcggagccatggctgcgcagcgggctggccgggggtctcctgaacccgggccccggccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaactttacatatcttgcttgaataactaaccctgggcccaggcagtgagcaaccccttgtatcttcacaggtctttgccccgtgttatgattcctcatgggtccttgctgactgtccccctgagagtagctggcacgtgggtaacacagaaatttctgtagtgaagcttgggcctcaaagggttctcttaggccacctagtccaagcctccccaaacctggctgaacttttaagaatacagatgcgtgagccccgctcagaattatggaatccaaaaccaccaggaacggggaggaggtggtgcccagaagctgtattttaactagttcttggaattctgggtatt

SEQ ID NO: 170500 - DNA, 1341 bp, Homo sapiens
cgccgcctccgccctcggcctcgcacttcctggcggagccatggctgcgcagcgggctggccgggggtctcctgaacccgggccccggccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtgagattaaagccagattatttcttttctcttga

SEQ ID NO: 170501 - DNA, 1551 bp, Homo sapiens
cgccgcctccgccctcggcctcgcacttcctggcggagccatggctgcgcagcgggctggccgggggtctcctgaacccgggccccggccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtgagattaaagccagattatttcttttctcttgaggactctctcggtttccttaacctagccttgactttccttacctctctggggccttgacaactatcctgcttctgaatgaggtgtgatgataaagtgacgagcagaataccccggggcctacatcctggacagggagagggagagccgacccaccccttcgaggggtccgtcatcgttcagagcagcactgcctggcggggctttctgtg

SEQ ID NO: 170502 - DNA, 1821 bp, Homo sapiens
ggggtgggattctaaaggatccccggatcggactacgctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaacttta

SEQ ID NO: 170503 - DNA, 2150 bp, Homo sapiens
cgccgcctccgccctcggcctcgcacttcctggcggagccatggctgcgcagcgggctggccgggggtctcctgaacccgggccccggccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgctgctgcccaaggaggccaactgcgagggcttcatcgaggaggccgtgcgctaccacaacaacctggcggcccagcccgtcatgcagaccaagcgcacggcgctgcgcaccaaccaggagcgcctgctgtttgtgggcggcgaggtctccgagcggtgtctggagctcagtgacgacacctgctacctggacgccaagagcgagcagtgggtcaaagagacgccgctgcccgcccggcggagccaccactgtgtcgcggtgctggggggcttcatcttcatcgccggcggcagcttctcacgggacaacggaggggatgcggcctccaatcttctttataggtatgacccccgctgtaaacagtggatcaaggtggcctccatgaaccagcgccgtgtggatttctaccttgcctccatcgaagacatgctggtggccatcggcggccggaatgagaacggagcgctctcttcagtagagacgtacagtcccaagactgactcctggtcctatgtggccggcttgccaaggttcacgtacggccacgcgggcaccatctacaaagacttcgtgtacatctcggggggccacgactaccaaattggcccctaccgcaagaacctgctatgctacgaccaccggacagacgtgtgggaggagcggcggcccatgaccacggcgcgcggctggcacagcatgtgcagcctgggtgacagcatctactccatcgggggcagcgatgacaacatcgagtccatggagcgcttcgacgtgctgggcgtggaggcctacagcccgcagtgcaaccagtggacccgcgtggcgccgctgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaactgtcgaattcggtaccagctcgatcgtacagtc

SEQ ID NO: 170504 - DNA, 1368 bp, Homo sapiens
cgccgcctccgccctcggcctcgcacttcctggcggagccatggctgcgcagcgggctggccgggggtctcctgaacccgggccccggccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgagcagcgtctccgcgggctcttctgcgacgtcgtcctggtggccgatgagcagcgtgtgccagcccatcgcaacctgctggccgtgtgcagcgactacttcaactccatgttcaccatcggcatgcgggaagctttccagaaggaggtggagctgatcggcgcctcctacattgggctcaaggccgtggtggacttcctgtacggcggggagctggtgctggatggcggcaacattgactacgtcctggagacggctcacctgctgcagatctggacggtggtagacttctgctgtgagtacctggagcaggaggtgagcgaggacaactacctgtacctgcaggagctggcctccatctacagcctcaagcggcttgatgccttcatcgatggcttcatcctgaaccacttcggcacgctgtcctttacgcccgacttcctgcagaacgtctccatgcagaagctgtgtgtctacctgagcagcagcgaggtgcagcgggagtgtgagcacgacctcctgcaggccgccctgcagtggctgacgcagcagcccgagcgcgaggcccacgcccgccaggtgctggagaacatccacttcccgctcatccccaagaacgacctgctgcaccgcgtcaagccggccgtgtgctcgtgctgcacgccaacagcgagtcgggcgtggcagtgtgggagggccgcatctacatcctgggcggctacagctgggagaacactgccttctccaagaccgtgcaggtgtacgaccgcgaggccgacaagtggagcaggggcgtcgacctgcccaaggccatcgctggcgggtccgcctgtgtctgcgccctggagccacggccagaggacaagaagaagaaaggcaaaggcaagaggcaccaggaccggggccagtgaccctagctgcgcctcttgggaccatcctcaccgtcacctcccagggctctgtagaccagcagcaacttcttagtattccggaaacattatgtacaacttagcagctttttttacttttatgattcttggtatttctatgatatcacagtaaccaattaaatactatctgtaacttta

SEQ ID NO: 170505 - DNA, 339 bp, Homo sapiens
gagactcagagagagtgaagctgggttctggcccaggcggcctgactgcaaagctgtccacttccccgccctgccctgccatttctttgctaatgacggctactgtctatagagtgttcatggggtgcccactccctatattcttaaatcctcatggccctctaagacggcaggctgttccccggctcggagggggtaagcctggcacagccctgagctctccctctgtctctgcccgtcgaccctgcaggttcacgtacggccacgcgggcaccatctacaaagacttcgtgtacatctcggggggccacgactaccaaattggcccctaccgcaaga

SEQ ID NO: 170506 - DNA, 290 bp, Homo sapiens
agaaagggcatctggcagacagctgcatctgcaaaggcacaaaggcttccggcaagtctgctgacttaactggagcactggcttcctggctggggtggctggaagacctacagggccggggctgtggagtgccctgctgggaactggactggatccttgagcaatgaggagtaatccacaacaaaatgcggtctgtgttttagaaaaataattacagcacacagaggagagactggggggtgaagaaactgggaacgcacagacctgctggaaagctcttatgaagaact

SEQ ID NO: 170507 - DNA, 379 bp, Homo sapiens
gaaaatcacttgaacctgggaggcagaggttgcagtgagccgagatcacgtcactgcactccagcctgggggtcgcagcaagactccatctcaaaaacaaaacaaaacaaagagggagcctaaagtcagccctttgctgcagcggcccctgcactaacaggacctggaagtgcccttcagtaacattgggacccacatcagtccagaggaaggccagagcagctgcaggacctgttcccagccttccaaagcaaattccttcccatctcgtcctggcaccccttctggaggagaggctagacccccctgaagtagaggagagggaagactcagaggctcagggaagacctcacccaggcagctgctgccccagggcttt

SEQ ID NO: 170508 - DNA, 405 bp, Homo sapiens
tagattatactttttccttaaagagagaggaaattgtctgactgcagggtaagtacactctgctaatgagttaaattatgatatatgaatactttaaacctgaaatgaaaatacgaaagtgtttgtgttcaagttatcagcattacttcctacttttttttttttttttttgagacggagtctcgctctgttgccaggctggaatgcagtggcacgatctcggctcactgcaacctctgcctcctggttcaagcgattctcctgcctcagcctcccaagtagctgggactacaggcacatgccaccacgcccagctaatttttgtatttttagtaaagatggggtttcaccatcttggccaggatggtctcaatctcttgaccttgtgatccgcctgcctcggcc

SEQ ID NO: 170509 - DNA, 484 bp, Homo sapiens
tacagaaataaaaaatgaaaagataagcaaacgtgggtgatatactcacatatcagagtgaagaatttttactggaaatccggatgattacctccattttacaaaataacatcaaagtctactacagaaagaacaagggctgggtctgaaagactgggagtgagtaagcagcaactgtagctcagtgagaactaaactggtagaaaaacattctaaaaatctaagcacagctcctctatagccaaccaagatgttcagtgtctccaactacattgtgcagtcttacacttaagaaaacgtttaacgatctttacataatattcacccagtagcaaaagccatacatctgtgcattattattccaactccctaccttcccatcctcacctcctatcagtcactgatttcacttcccaaatattgttctaacaggccctgtggccctgttctagttccagcttccatgtcttgctcagcttataaa

SEQ ID NO: 170510 - DNA, 482 bp, Homo sapiens
agataaagactgggtactggcaggtggaaggaggggaggatgaagtcaaagtcaagattctctgggttggagtcaggtcttcgcaacccactcaccatatgacttagagcaggcaggtaacgcaccctgaacctccatttccccatctgtcaactgcgaagtaatgacaactacccctttaaagactggtattcaaatctattttttgtttctcttaagaaaggatgctactgaaaaatggtaaagccctttattgggtgtgggacgaagaggtccacccaatatgacatgtaatcagttgaaggtggcttgttccttgcccccggtgagggagctatctgggtgggcctctttgcagagtggccatctgtgcgccacacataaccgtaggtgatgaggggcccaattccatgagaagctgttcagttttggccaggacctccctcatacatgctggatatttccatcgggcaggcagtctc

SEQ ID NO: 170511 - DNA, 521 bp, Homo sapiens
atctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactagttcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagtcgtgggcagttcaggagatacctgccttcatctttgttctttgttgccttaggttcttcagagaaagatcacaacaaaaaatgtacactgtcgtttacagcta

SEQ ID NO: 170512 - DNA, 105 bp, Homo sapiens
gctgctgggtagggaacaacagtgtctttacaagttggtgcattataaatacatttccataatttgaatcaagcctaccatctcctcctcatctccaaccacccg

SEQ ID NO: 170513 - DNA, 392 bp, Homo sapiens
aagtcacctggatgaatctccagagaattatgctgagtgaaaagagccaagcccaaagatgacctactgttcgattccatttatataacgttcgtgaaatgctctgcctatgctggacttgaagctttctgtctgtcaaaaaataaaagaagatggaaggaaggatgtacagaaggaagaaaaaaaaaagaaagaacctgtgactatgaagcaacacccaaagccactgtcagatgtcatggagatgagacctcacaagaaggccagaaaacaacagactaactccggatatgacaaactctttataaatacttataagtactgttggctacaatagttctaaagccttaacaaatgatgttgaagcaaaatgaataatgattattcctata

SEQ ID NO: 170514 - DNA, 328 bp, Homo sapiens
actcaattccgcttactctttcactatcttctttccactagtttcatcctaaactgagagaccaacatcaaaagaatcttctcaagtttctgagtgacggcaagaaactagactactgttaccaaggaactttttaaagcaaactgcttttgctgatatgaggagaaagttaattaataagaaaataccttaaatgtgttttgaagctgttaaaggtgtgtaacaattactctgaatttattatagcaccagttagagacccaggaaaactataaaattgcacatcagggcagagctgagagacgacatctgctttgggattgaaaaa

SEQ ID NO: 170515 - DNA, 805 bp, Homo sapiens
cacctctgtaactgttgcttgctgctttctctttaggcaacacccaaagccactgtcagatgtcatggagatgagacctcacaagcctactcaacgtgaagatgatgagaatgaagacctttatgatgatctgcttccacttaaagaatagcccatcatgatctgaaggcagcggtggttgctggtggaggatgtgagctttggaactggagctctttgattcaaagctctgccgcttactcactggataagaccatgatcaagttatttcatctgaaaaattgagttgactgcaggtaactgaaactgcggaaagtgaaactgcagataagagggaccactgtaaataagtgacatgaatgatactgcaaaggaccatagcctaaccagccaagcaaactggaagtacctttagactcacgctttgccaagctcagttccagaatcacatgatgaaaagaatgatggaaagaaaatgtttgtgatattaaaattaaggaaattactccaactcagagtttcatcctaaactgagagaccaacatcaaaagaatcttctcaagtttctgagtgacggcaagaaactagactactgttaccaaggaactttttaaagcaaactgcttttgctgatatgaggagaaagttaattaataagaaaataccttaaatgtgttttgaagctgttaaaggtgtgtaacaattactctgaatttattatagcaccagttagagacccaggaaaactataaaattgcacatcagggcagagctgagagacgacatctgctttgggattgaaaaa

SEQ ID NO: 170516 - DNA, 754 bp, Homo sapiens
ggcgccggtgcagaggtgctcaagcctcctcgcggtccgcagtcagtgccgccgcgcccggcctcccgcacgccccgcaggtagcgcccccgcccgcggcccagagtgcgctcgcgccggcaccagctcccggataaacggcgcgccgcgcggagatgacagccgaggagatgaaggcgaccgagagcggggcgcagtcggcgccgctgcccatggagggagtggacatcagccccaaacaggacgaaggcgtgctgaaggtcatcaagagagagggcacaggtacagagatgcccatgattggggaccgagtctttgtccactacactggctggctattagatggcacaaagtttgactccagtctggatcgcaaggacaaattctcctttgacctgggaaaaggggaggtcatcaaggcttgggacattgccatagccaccatgaaggtgggggaggtgtgccacatcacctgcaaaccagaatatgcctacggttcagcaggcagtcctccaaagattccccccaatgccacgcttgtatttgaggtggagttgttgagtttaagggagaagatctgacggacagaggacagatggcggaatcattcgcagaatacagactcgcggtgaaggctatgctaagcccaatgagggtgctatcgtggcagggtgcactggcagggtactacaaggacaagcctctttgaccagcggggaccctccggtttgaccattggcgaggggggagaaac

SEQ ID NO: 170517 - DNA, 257 bp, Homo sapiens
tattatgtttgcaagcttaatatccaaaaatgggccattcttccaaatgagagttccttcctgattatttagtatgctgatggtattgtcagacaggaagccatggttagaaagattcagaaaaatacaaacctttaagctagatgggcacttttgccctttaggtttatgaaaaatgccaacttttgtgaactacacaatcggaatcttgatttggttttcccggataacttatgtcataagaaatttggtaactc

SEQ ID NO: 170518 - DNA, 585 bp, Homo sapiens
actacccttatgaccttttttgcttaatgaagttacttcccttgcacccatgccccacgcttgggccataccatcctggcctctcagcactcagatgccaaattgaccacattggtaccactggacacatttaggactgaatttaagagaggaagaagtcaagccaacaggaaccaagtctgctttgattaacatgtgctgcaaacctattgggtgccaggcatttcaccagacactttataaaattgtgtcatttattgttccaagttcagggctctgagcttcagaggtgtgttaactactccctgattccacagccaggaagcagactgcctagtatgttgagcacaggggggcttgaccctgtgggcacaaagagtctatcaacaccagctgctttgggcagagctgccatgtcctggcctagaggctgtgtgttgtctcagcagctccaccctgcccaacctagaggagcagacaggggcctactgcagcatatggttgatccaagtggagggagggaagaggtctggaggttgcagcatccccaggggttcagagtagggctcgcatcagccagcaaga

SEQ ID NO: 170519 - DNA, 345 bp, Homo sapiens
acaaagatgcaggtgcgtctatgaaagcgaactttgtcgagatctcagtgacacactctgcttttccaaattgcctcaattggcagtgaatattagaaagagtcatggaatgtctctggaaagatacataggagaactagtgacattggatccttgtgggtagggagacactgtgtaagtgcatcaaagaggctgacttttcactgtgcacactccttcagaccactggaaattcggaattgtatacggtgtgcatgtattacctccttaaaactagctagctacctatctacctacctacctacccacccacctaccttcctacctggctaattcattagctaa

SEQ ID NO: 170520 - DNA, 223 bp, Homo sapiens
catggacatcttcaggaagccatcaatctgcctataataatgggtatatattttatatatgtcatttacataacagttccccttatctgcaggagatacatcccaagacccctagtggatgcctgaagctgcagatagtaccaaaccccctacatatactatgtattctcccatacaatcacattgtatagggcaggcagtgtatatagcatgaatacactgg

SEQ ID NO: 170521 - DNA, 504 bp, Homo sapiens
ctctgtgttatatccttgtattacataacaggacagggtggcttcagcccaggacataagggagaggcttgtcttccaagaggcagccatccctccctccccctggacttgtgtctgagggaaggagtttgccctgggttctggcaccaggtgctgggttctttgatcggcagccctggagtgacctcttggcaggtggtcagtttgggacaggaaagacacaccctcagagtggggacgggcctgcctcacatcctcggatgaccaaggccctgcttatctttccaggattgcttagaggactggtgggtagggggaaccaggccgtgtatttccccagtctctgaggacaaggaaaaccctcagacctgaggcgagcgggcgttctggaggctgggcccccagctgcggagcttgggggaccggcttgccctaggaggagcatgggcaagggcagaggccagggtgtcaggaattgtggttccaggcctggcactgcccact

SEQ ID NO: 170522 - DNA, 336 bp, Homo sapiens
ctcctctcaaattttaaaataatacaattgatttttttaatatccaaaaatagactgctatttcgtagcatttgggaggacagttttcctttagaagtgaaaagggatgattgagtgataggaaactgattaatctcaggatttcacaaggaaatgccgacccagcattgggccctcacacacaccattataattctttgatttcctgtcactgcagacagtttaaaaactgaaagtaaataggagacatggaaaatcaatgtgaggtgctgaattgttccagctgctgcggctctgttaattacatcatatttttatggagacattcggctcaga

SEQ ID NO: 170523 - DNA, 563 bp, Homo sapiens
gggctgcatccagacctctccctttcagggcccagcccctccagctccagcgaccccacctaggcacacggaacatatgtggaggaaaccagtgttcattttgttgaaagcaggggaattagagaaggaggcgagcttgaggaggggagaggctaaagggataaagcttccaacaatggcgatgttcctggattttgaaatacaatcaggtaaagcccgatctggtggaacgcccgtggccataatgacagctaacacccaggggctggagggggaagggcgctcaggcaggcgcgaaaacttgcacgccgccctactttgctcccgccccacttagcagccttccgcaaaactccagccctctcctctgcagcgcagaaaggccgcccgttcatgcatatgcaggaggataagtttagctcgcagccccccgcgctccgaccggcccagcgcggcactcggtgaatcacccgcgctcgggggcgggcgctcggctccggccgcggactggcgggcgactcagccactcgtggaccgcgcgccccggcctggcatcgcccttt

SEQ ID NO: 170524 - DNA, 530 bp, Homo sapiens
taagagagggtcctcctgcaagggccagacaaggaggagggcatgggcaggaaccgcgtccaaatcaacagcaaagacaaaggtcacctagaaagggggactccaccagactcttacccagcagcacgtccctcctgcctgggcctggtgagcgaggggctcaaggggaaactgaggcaggagctggcacttctgtgtgggtgaggagggcaccaatctgaggccccgcccgctccctgcttcggctcctctgtgttcccgggctgccgactctcaggaggctttgccacctgaagaacagggaggtcgagcaaggtaagaagagctttccagctcctgttccgacctgagagccgagaggcaccatcctgaagaatggccttggtcccaggcctccatgtgcgctgtggcagacaatgccagtcgatcacctctctttcctgacccagacacagcctcatgctcttcagccaagtgccccagggaagcccgccaccgatcagtcaagcctggagtaaaagatgaagcct

SEQ ID NO: 170525 - DNA, 423 bp, Homo sapiens
tctcagcaaagactatagcaccagacttttttttctgagacggagtctcactctgtcgcccaggctggagtgcagtggcacgatctaggcttcctgcaagctcggcctcccagtttcatgccattctcctgcctcagcctcccgagtagctgggactacaggcacccgccaccacacccggctaatttttttgtatttttagtggagatggggtttcaccatattagccaggatggtctcgatctcctgatctcgtgatccacccgcctcggcctcccaaagtgctgggattacaggtgtgagccaccgcgcccagccagcattacgcattttcattccagaagaacctgcctctctcccatgaaatatcccttgaattccctggccccagagaggctgggagccctgccgatgtctctttag

SEQ ID NO: 170526 - DNA, 656 bp, Homo sapiens
taccagagccgcaggggtgttggttaggaggccgctgtggcaaccaggctgggagccctggaaggggccagcagggtcagagtctagacaggatttggagacagcagatgggaattgctcacagaatgggtttgcctgggggctctttcttcatcctccaggtgtcctgcgacagatgaaccatttgtaacccccaccctctgtaccccagccctgggtcaggtgccccattattcacacacgctcctgacccctcattgccaggagctagcatggttgtcattaagcagtcacctgtggccctatgtccgagttccgcctgtgctctggccctcagggtcaaggtagcaggggcctggcctatgctgaccacactgagcatcctggccggcccctcctttcttacctccagggcttggactagggactgtctgttccccaggctcagtgatgctgttatcctggaggggcaagtgcttctcaaggaagtgtgggaggagggaacagtctcttacaggagaagcagggtaggcactgctgggacagacccctcctcattccatggaggcctcacatggggaacagaaggacggaggcctcacttggggagtaggagaatgtgacaaggccctctccggacccagcacctggccaga

SEQ ID NO: 170527 - DNA, 332 bp, Homo sapiens
ctcagggtagagtgtagtggtgtgatcatggcttgctgcagcctcaaactcccgggctcgagtgatcctcctgcctcagcctcctgagtagctgggactgcaggcacgtgccatcatgcccagctaatttttgtccttttttttgtagagacagggtcttgctttcttgtccaggctagtctcaaactcttggactcaagtgatcctcctgccttggcccactaaagtgctcagattagaagcatgagtgactgtacccagacaggataggcactcttaactcccatgttgtccaaaggtcaactattttatttttttaatttttttttatt

SEQ ID NO: 170528 - DNA, 251 bp, Homo sapiens
gagttgcaaatacaagacgtaacaagtaaaatactgttacgtggtgggtctctgtggcaggcttcctctcccccccatatggataattgtatactaaattcaccataaggtgaaaaatggatattgagttcccttcatgaaaagttatataaaatatatatttagcataaacttctccagagttgtcctttattaagtttctttacagaaactttaattggtgccatgattcttgtgggggaaagaatcat

SEQ ID NO: 170529 - DNA, 549 bp, Homo sapiens
atgttcatggaagctctatttccaattgcaaagacgtgaaagccacctcagtgcccatccacggtggactggataaaggaaacgtggtacaaatacaccatggaatactgcacagccataaaacaagaataaaagcatgtcctttgcagctggaggcctccatcctaagcaatttaactcaggaacagaaatccaaataccagatgttctcacttacaagtaggagctaaacactgggtactcatggacataaagaaggaaacagcagacactagagaatctgaaaggggcagagagggctggctgcaaagttgccttttgggtactgtgctcactacctgggtgataggatccactgcaccccaaacctcagcatcacacaatatagtaatgtaacaaacctgcacacgtccccccagaatctgaaatagaagttgaaatttaaaatagatatatctctttccatctctcctacttggacaagatgctcatcagaccccacagctggggctgccggaccccttccagggattcttcccagaggggcct

SEQ ID NO: 170530 - DNA, 124 bp, Homo sapiens
gagtaagagtcatccaaatttcaagactttcatttgtattctcatgctaatacaggagccaatctaaaagtagtattatataacataaagactcaagtattaattgatagctcttattaggatt

SEQ ID NO: 170531 - DNA, 744 bp, Homo sapiens
aaggagttcgagaccagcctgggtaacatggcgagaccctgtatcaatttaaataaaatttaaaaatagattctaaactaagtaaattgtttagcttattttacttgcttgacaaggcctgacaaaaataaatgatgtctttctgacacacaatataaaactggccgacagatcatatagagtagtgatagaggatttcagcaccctgggagatgctaaatatggtatagctgctaagtcttttctttgctgacaaagaattttatatcttaggagataaagaagagagtggtcataagtttaatctgtaagaacaaattgcttggtgaagtagaagtgattggaagtttttgggaacaggaaccatgacccaccccctaaagtttattacagcagaaatgaggagttctgagcatgtactttagggaaacagattttaaaatgtaaacatcattccaccctctgcaattttaaaaaagataatccttagagaaaattgaaagattgtcaacaagtaaaattatgattcactgcaaacaatactatgagaagaaaagttgccaggtggtgctgctactggtctggggaccacgctttgggaggtacccatgtatccgttggctttgtgactatggtaacacttaactctatttttgtaaggtgtctgttattttaccagtaaatatgtgataaaactgtaataataatgtaaaaattattaaagctttgagatatttaaaacat

SEQ ID NO: 170532 - DNA, 291 bp, Homo sapiens
ttccaagagtaacagtgctcctgctccaatgtgaccttacaaatcttacatagatttctctgtggtcaactctaatcagcaacactcagagacactcagtgaagaaagccctgggaaacactatttagtttagcccaggggaaattacaaggccatgtcaccttgaaactggaacatgaggagaggtgaggatggagctgctgcagccatgttgttaccataaagggaaagcccagagctgctgggcagctttgtggagcccagggatgaaactaatataatcaaatatag

SEQ ID NO: 170533 - DNA, 258 bp, Homo sapiens
ttaaatgagtttgtatacgtcaagggcttagtaaaatgcagagtacacagtaagtgctcattaaatacaagttgttattgttgtagttctgattggacagaaagcaaagggaaggggaaagtctggcctgagggggttttgctggatgtgtccttgtgcaggaaggggatgcaatgagtccccagatgccctgaggcaaagagaggcaggaaagagcaggtagatgccaaaagcggacatagcaggccaccaagccct

SEQ ID NO: 170534 - DNA, 290 bp, Homo sapiens
gttgctaatggtgagagtggagaagagcccaaagccaaaaaatgcaggcagactccagaatgtggaaaaggcgagaaaaaagatcccctagagcctctagagatgaaggtagcctttccaccacctagattttagcccagtgagatccacatcatactctgacatacaggagtgtaataaatttgttttatgccctgacatagtggtagtttgttgtagcagcaatggactagtaatatataaatatatatatacacacacacacacaaacactacccccccaccacaca

SEQ ID NO: 170535 - DNA, 366 bp, Homo sapiens
ccttaccattataaacaagagagtttaaatcacagaataattattttaaggaaatcagtatatatcattagaattatatttttatttgacatactaatattcttggtgatataactgtcagagttacttggagtatattaccaagttactcaatgtttttctagccagaaggctagatagatgtctagggaaaggcatattaatttagacttgtatgggtttttaaaaaatctttagcatttttgaaaaaatatgggccaggcatggtggctcacaccagcactttgagaggcccaggccggcagatcacctgaggtcaggagttcaagaccagcctgatcaacatggtgaaactgcgtctctact

SEQ ID NO: 170536 - DNA, 412 bp, Homo sapiens
tgtacaggacgggagggcaggggaaacggttggaaagcgtgacagtctgcttggctttgggtcagaaacggtcgctggatttgctcgaacggggagggggccagctggagttcagttcagggtagacgttttaggaaacggcagacgcgacagattgagcaaaaaactccgtggagccgagggtgggagacacgagctgcacccagcacagaggcaagaccggagagccaggtgtgcccggagccaggtgtgctcccgagtgggtcgggtcgatgcgcgtcgtggcccaggtggtctgtgtctgacgttcggtttcctcttgctggaggaatcgtgtttgttggaaattatttagtggaatacaaatgactgctgggtcatgctgggaattagattttaaaaacagaggaac

SEQ ID NO: 170537 - DNA, 628 bp, Homo sapiens
cagaaccactgaattgtacatttaaaaaaggaagaaaagaaaaatccaggatgtcagcactgtgctggccgcttcctggggccctcagtgagttcctttaaaagacaggcttagggtgacagaggccagcctggaaatggacaggaaacgccagcctttccgctgcggtccaacttgggctgacgccctcatcgcaacaggagagccctgcagggttgaggcaggagggtgaccggcgttagtcttcattgtaagattgcaggtccctctacatgggagcgagttgggccagggcagaggcacagagcaacatagactacaactggtccaggaggcagaacggtggagggtcgcgggcgggtgggtggtgcaccctggaggccgcgtggagcttcccagtgaactggcatgaagaaaagtatcacagcccgatggtggtgctgtttctggaggtggggaagggtgcgtggaggatccttcttagctttgaaaggaatttaggtctattggttataatcagtcatgtcctattaatttacattttcgctaatcttatttaatcttatgttaaccttttatattgattgttaagtcctatatgttgttgtgtaattagctataatgttat

SEQ ID NO: 170538 - DNA, 241 bp, Homo sapiens
cacaaaaatctgcacacaatttctaagacttcagaatctatctgtggccatgttccccaccccatccccacatgcaacagacaacacacagcattccttctaaagaacacttgatttcatagaggagaagggttaaagctgggataggcaaatacatgctctatggctcaagaaatgatattaatagatagagtttaagagcatcttcctatgatatgcagccagagaaggtttcaagttt

SEQ ID NO: 170539 - DNA, 325 bp, Homo sapiens
gcctggaaagagccgcatccctggccgtgaccaccggcgctactaccacgaccactggcggctggagtacctgatggacttcaaccctgcccggcacggcatggtgtgcatggtgtgcggcagctccctggccaccctcaagctcagcaccatcaagcgccacatccgccaaaagcacccctactccttgcattggagtccccgggagaaggaagtcatcagcaacagctgggatgcacacctggggctgggggcctgcggagaggccgagggcctgggggtccagggggctgaggaggaggaggaggaggaagaagaggaggag

SEQ ID NO: 170540 - DNA, 227 bp, Homo sapiens
cacgtgaggtcacgcgacgtagccccattaacatgaaacatccagaacagggagagcctagaggcccagcagaccagtgggtgccacggcgggagtgggcaggatgggacgggtcaggtgtgaaccgttagagacgtgggaggcccggggccatggggttgaccagccttgctacactctgctccagccccgtggataacaccccctgtgctgctggagcccaggag

SEQ ID NO: 170541 - DNA, 131 bp, Homo sapiens
cttccccacctccttttctgccctccaagactgccaaatacttgttgaacatatattattaaatgcctactacatgccagccatgattcatggtcttggggacacagcagagaacgaactgacaggactcc

SEQ ID NO: 170542 - DNA, 540 bp, Homo sapiens
accatatgctgcctgcaagaaactcacctaaagggtaaagacatttacagactcaaagtaaaagggtggaaaaagaaatttcatgcaaattgaagctaaaagtgagcaggggtacctacgctttatcagataaaacagtctttgaatcaacaacagtgggaaaatacaaagaagataattatataatgataaagaaatcaattccatgagaagacataataatcctaaatataaatgcacccaacactaaagcacccagattcatataacaaatactactagacctaaaaaaagagatagacagcaatacaataataggaaaaaacttcgacatcccactggcagcactagacaaatcattgagacaaaacatcaacaaagaaaatccagatttaaattgtactctagaccaaatggacctaacaaatttttacagaacattctacacaaaaaccacagaatatacattcttttcatctgcacatggaactttctccaaaacagaccatacactagaccacaaggtaagtctaaatacat

SEQ ID NO: 170543 - DNA, 440 bp, Homo sapiens
gttttcctttatccagggactaacattcaaggttttgtgaaaaagaaaattaattttgcattgacattctggatgttggtgataatttgtagtgacattatgcctattggttgtgattgtgacaggcaggcagactggatccaaatggacattacaagagccaaattaaatagtctgagcattggaaatttctgccttaaggaaagcagaagcttttcagcatgcacttgttttctacctccacaattatggattaatatacatcaattctaggcagttgaggaatgacatgagaggattaatggaactggacaacattacacaagtgaagtgaaaattctgtaatgatttttctgaggtgatgtagtagacaaggcaaatgggcatcagctcctagactttgcacctttagaatttcaagaaaatgattgaaaagagaa

SEQ ID NO: 170544 - DNA, 398 bp, Homo sapiens
agatgagactggagttgttaaaattgctactgaaatatgttccctatcaaatttaatccaaaggattattcttacttgattatagtaaagatactgctatcaacagtctataaagttcccctgacatctgaattaaaacaaaacaaacagtctgctatgccgttacctctttttgacatttaatattatattcatagcacccttttctttttcttttttttttctttttcttttttgagacatagtctcgctctatcgcccaggctggagtgcagtggcgcaatctcagctcactgcagcctccgcctcccagattcatgggattcccctgccttggcctcccaagtacctaggattacaggcgtgtgccaccatgcctggctaatttttgtattttt

SEQ ID NO: 170545 - DNA, 570 bp, Homo sapiens
ggtcataaaaatcacatgatacacagattttgttagaacaagaaccttatggctattttccagaaaactgttatttaaaaaacccttctgacatccacaatgctgatggcacccctaaaaggtatgtagtgtgtaacctgggtgacagagggagactccatctcaaaatagaaaaaaaaaaaaaagtaaccctagaatccttgtgttgtatcatttttctaaattgaaactttgatttcattctgctatttatggattgttcctgcccctactcacagcctaccttctttacattaaaaaggaggcctctttctgcaacacccgaacttgaagatgctctgtaaattagcacagattagtttactacgctcaggccactaagagtacagaggcctggctggatgagtaagaagaatcatggccactgtgtattgtgttcctactaagtgggccctttttgtataggatccatatttgttttcacagccactcaatgcagctataagaattattctccccatttgtcaagcttctggagtttacctgatttttctgaagatcacacagctg

SEQ ID NO: 170546 - DNA, 484 bp, Homo sapiens
tgggctggactgagtggctcacttctaaagaagcacttatagaaagcgaacagtgatgaaacccagaaaacactgccctgaccaacggatcaaggttaatgtcatcactgttgtcatatgtatgttgtagactcctgataggatgtgatgaggataatttgtctctatgagactttttcccaaaattcataatcccaatataatcatgagaaaaatattacacaaattcaaatggagggatattctacaaaatacctaactatccctcaaatttgtcaaggtcatataagagcaaagaaagactgagaaatagtctcaaactagaggattaaatctgtaacaatctgtgactactataaatctaaagttgttctaaaatagtttatttaatacaccagattaactaagtaaaaacagaaaaattacatgatcatctcaataaatgtaggaaaagctggcaaaattcaacactcattactgtgta

SEQ ID NO: 170547 - DNA, 618 bp, Homo sapiens
cttagttgattagagagggtttctgaggatgaggaagagggggggaaaccccaaacttagttcctgaagcaaaggtttacttccaacatcaaataaaaatccattcctgctggtgaagcaatgcaattattcatctaatcagcttttggcggcgtttgtgaggtgcagagaggcggggaagcggagagaagactactgccctttagagcagagcccctgctcgtgggctgagagcagcctggagtcctcccagtggtaggggaaggcaaacaaacctgatctgaaccttgtactttcctgggaggcaaatagaagagcagaaaacaggagggaggaagcaaaacaaatcactggttcgcccagaactctggtgtggaggccgggctggtgtcggaacttgttaataacacccttttagtttcttttcctgctttgccactgccatcactgaagtggtggaaaccaggactctgtgtgcacgcgcactcgcgtgtgtgtgtgtgggtgtggataagtggcaatattgatggatctgctgcagcctcttaatcctggtacatgggaggtgcctgcctcacctctaagaatctccccacatataaatagatattcatgtca

SEQ ID NO: 170548 - DNA, 394 bp, Homo sapiens
agagcatccaactgagacatgtacccccagctaactaaatctttagccaaagagagaaataactatcagtttcaaaagtcatgatgactacataatacaagcaaaccagctggtcaaaggaaacacagcttttcctggtaccgagacctggaaaaaaatttactacatagattctaatgatgatgatgatgatgatgccaacaggggtctggattagcaaggactctttcagttacaaacaacaggaacacttgcaaaccagcacaagcaaattgggcaactgatgagttcatttaactgggaaatattgggtggatctaatacagagtgcaactagatccaaaggctccaatggctcccaatgctcactcattcaagcatgtgagagtgagtg

SEQ ID NO: 170549 - DNA, 421 bp, Homo sapiens
atttctttggaaacgggatatcttcatataaaatctagacagaagcattctcagaaacttctttgtgctgtatgacctcaattaacagagttgaacctttgtgtggatacggcattttggaaacattcctttagtagaatctgcaagttgatatttagatagctaggaagaattccttggaaacgggaatatcttcatataaaatctagacggaagcattctcagaaagtgctttgtgatgtttgcattcaagtcacagagttcaatattcccttttatagagcaggtttgaaacactctttctgcactacctggaagtggacatttggagcgctttgaggcctatgttgaaaaaggaaatatcttcccataaaaactagacagaagcattctcagaaacttgtttgtgatgtgtgtattc

SEQ ID NO: 170550 - DNA, 465 bp, Homo sapiens
gctcacgcttataatcccaacactttgggaggccaaggcaaaaggatcacttgagagcaggagttcgagtctaacttgggcaatacagtgagaccctatctctaaaaaataaaaataaataaatacataaatgaaaagctttctctggatgcagaatggagaatggattggcaaaagcaatgagtagatgtaggaattctagtgtggagcctattgccataatccaggcgagagacaatgatggcttggactctagtaatagcagtggaaatataaagggtaaagggtttggagatgtgtgagatgtaaaatggtgatggtatggacatgggttgtgacggaaagagaggaggtagggatgctccctgggtttctgatttgtaatctagttgggtgctggtggcaatctctgagaaaagaacatgaggagggttaaatttgttgtgttgggatctagggaggcct

SEQ ID NO: 170551 - DNA, 283 bp, Homo sapiens
tctgtgattgaccaggcacggggcttggcgctgaggggcagagctgcagaccctgtggtgaaagagcttaaaatggcatgtggggttcagaagacaagaacgaattgaatgaactccatgtgagaggtgcagaggcttctgaaagagcaaaacaaggtggggttcagatattaatgctatgagcatttaataaacaccactagttgctcagcacaagagtggcaaacataagagacacagtccctggtcttggagggctgaagtgtactgggaatgacctttg

SEQ ID NO: 170552 - DNA, 364 bp, Homo sapiens
gagcatcaggcctttcctccttatcacctggttggggagctgaaaatatgttaaaatacagtcatctcttggtatctgcaggggatcagttcccagaccacctgcagataccaaaattcatgcttactcaagtcccacagtcatccctgtgaaacccactgacatggagggctagctgtatttattgaaaaccacatgtgaatggacccatgcagttcaaactgtgtgtggacccatgttgttcaagggtcagttgtgtatttgaagttaattagggatacaacaaataaatctgtttttccctccacatgtccaaatctcaggcttcatagagtctacctactccagtgctcctaccccgtat

SEQ ID NO: 170553 - DNA, 606 bp, Homo sapiens
taattaaattgttcttgtcattcagatctcagcttaataaatgtcatttcctcaggggcccctttcctatctacccaaattaaaagagttcctgagtcagtccctatcatgtcaccttgctatgtgttcatcgtggcagtgagtgttgcctgctactttctagcacctttagctgttaatttgcccatttgcagtcttctcccatgcaagtgctgtaagagtaaggcccttgactctttatccccagcacccaggacaccctgagcctagagtgagtgctctgtaattcataaaatggatgaatgaacagctggatgaataaacaagcttgacaaatgctggtttaaacaaaattaagtagaattctttacagtaagaccgttcgagcctttaatctactctgtggattgtgaatctcttgagcgtgtattatgtattcatgttcctgggaacagttttgggggagtattaatgtcaaaacttggtgtgttgaaggaattggattcattttcaagtataactaacttttaaagaacagtaaatcctatgtatggcacattttctttaagatttcttttactgttactatttctgctccatccctta

SEQ ID NO: 170554 - DNA, 320 bp, Homo sapiens
caagagatggtttagctctatgttgtccaggctggtttccaactcctgagctcaagggatccccctgagtggttgggactactggcatgcaccactggaaacccttattactactgttgactttaattccagttagtggactagttgagtgatcccagccatctcagcactggccaaagccttcctgtgttacctctacatgtaggcaggagactaaatagcttttcagaagccaatgaaagaaaagactgcttcggattagggagaaagaagccagtgttaattaactatttcaactgtcagcagccttcatctgaaag

SEQ ID NO: 170555 - DNA, 330 bp, Homo sapiens
gacctgtgtgtgccaggccctctgggttatggagaacatggaatctcagttggaatgatcacatacaacataagcatgcatgatcacattttccattccaaatgctgtcaccccatatttgacaacaggccagaatatctagtatcagctatgtcctggaaaatctaagacatatagtcatcatactaaatgtgcattttcttatttggcaaatatttatcaagcactactatttgccaggccctaaatactgaggataaaacaatgcacaaaaaaactgagaaatcccagccctcgtggaaaatacagacaataaataagtaaaataca

SEQ ID NO: 170556 - DNA, 254 bp, Homo sapiens
aaaagttcctagcagagtgtctgttgcataataatgatgtaagagcgttcacttctgcaatttggtgtgataaaacagaaaatgaaatctttatgtttgctttccaaacagcattttcattttttataattcataactcagggatatatatatagacatagatatataaatgtacacatacacctacagatacacacacacactctaccccccaccacacacatcactagtcatcatgaacacaatgaagcaga

SEQ ID NO: 170557 - DNA, 236 bp, Homo sapiens
tgaatacagctagtgcaggaagccctgggctttgactcgcttgttttcagtggtctccctgaagagctgcttctggaatcattcccttttctaggacccatttattttgagaagcaatgtggcaggttttgtcttttcatcagggtgtagagagcctgaaacccccacacaggagccacttcttgatgggggcaaagctgcgctatctagaaagctctcagtcccagaacctgcct

SEQ ID NO: 170558 - DNA, 388 bp, Homo sapiens
tccaggatgaaattcaaactcagttccccactccccaaggactctcgatagctcactccctcctgttctgctctctagctccagagagaagtgaggcagaaagatgctggacttaaagtcagaagacccctgactgtgtccaagttcaaggctcagtttgccttaatttcttcatcagcaatatgggcttcctaacttctgtcccacctatagcttataactctcagttgctctgaggactggaatgagatatcccatgtgaaagttcctacaaaccacaataggttatacaaatgtgaccgagtcattgtgatttttatcaggacttaaacatttagcatcttgtattgttctatcttgtctcactgatctggagtctccagatcca

SEQ ID NO: 170559 - DNA, 513 bp, Homo sapiens
gcctccctaccagacaggaagagccggagagagctggtctgagggacagcgtctctagccttgaatccatggctttcataaaccccttggacatctggtgagtgggctcttgggagagatgtcaggttggagagagctctggaggactgtctctggaggactgtttgctcaggggagatggtggcatgctgggaagtgaggggctgctcagtgagagagtgggaggcacagaagagcagaaagaagaagaggtgaatgaggagagaggaagtaggggtgtggaggagtcagtgggaggcgggaagagccagcctgtttgctgcactggtttgggaacattagagtgaagaaaacagatgttggggcaaacaatacagtctttcactttttggtatttttttggtggctttttaaaaaattctctgtcatattagcatattagcatcatgcttggttcatggaatgagaggccactgttgttggccctcttcataagtggacgttccttctcca

SEQ ID NO: 170560 - DNA, 248 bp, Homo sapiens
tcaaggctctgataattctgacaaagcagaaatatcactgtgatggtcgcttaatggtaaggcaaggcagatgtgtttgtgaattcttaaagctcatgcatctccatgattcttgttaaatcaataaatcttaaccaatttgcatgaacattaacaaaagcaccaaaaggaatgttttccagacctagatggtttgagaagcatctaggtttggaagatagagtccttcctttagctgtagttgatga

SEQ ID NO: 170561 - DNA, 320 bp, Homo sapiens
cctgaaaagacactttccttatgcgtgccactcagaggagccattttgctccagccttcaactcctcattgctagtaatttcaaatacttttcctggaattttgtggttctctcagtgattactttcatattgttttctcttttctgtcccatttctgctttgtttagcaagtaccagtaccagtaatagcttactttatagcaatttattttcacaaaaacccgtcagagactttaatagctatgtatatgtcctctatctttgtattcatggcttctagtcattttcaagataattgcattgatccagttattgagct

SEQ ID NO: 170562 - DNA, 764 bp, Homo sapiens
gcagcagtttccggggtagcctgggtggagactttggcagggccagtggtaggggaggcatcaccccagtcacggtcaaccagagcctgctgagcccccttaacctggaggtggaccccaacatccaagctgtgtgcacccaggtgaaggagcagatcaagaccctcaacaacaagtttgcctccttcattgacaaggtacagttcctgcagcagcagaacaagatgctggagaccaagtggaggcccctgcagcggcagaagacggctcagagcaacatggacaacatgttcgagagctacatcaacaaacttctgctggcagctgtacactctgggccaagagaagctgaagctggaggtggaacttgataacatgcaggggctggtggaggacttcaagaacaagtacgaggatgatatcaaaaagcatacagagatggagaatgaatttgtcctcatcaagaaggatatggatgaagcttacaagaacaaggtagagctggagtctcacctggaagggcttactgaagagatcagcttcctcaggcaactgtatgaagaggagatccgggagctgcagtcccagatctcggacacatctgtggtgctgtccattgacaacagtcgctccctggacatgaacagcatcatcgctgaggtcaaggcaccgtacgaggagatcgccaaccacaaccaggctgaggctgagagcatgagatcaaatatgaggagctgcagacgctggcttggaagcatgggatg

SEQ ID NO: 170563 - DNA, 385 bp, Homo sapiens
tacagtaggaaataaatgagtggcagatgagggccagaatatgagctttattatttattaatttatactgaccacaaatgtttgtcggatgtccactatttgccagccacagttaggggctgggaattctgtggagaacaaaacaaagctcttgctctcacagagctgacactctgctcaaggctgggcaggggcatgtacctgaggcctgagaagaaaatgggcattctgaaaactggccagagaaaacttctcagagaagcctgtggctggggggctcagtctggccaattttcaggcatggaatgggcatggtcgggactgaactctgatggtgcccatcccgcaggggcagaggttgccccctctctaggagtggctagga

SEQ ID NO: 170564 - DNA, 421 bp, Homo sapiens
cccactcagccatactttgtgccatcctaggcactgggaatatagccatgaacatctgtacatttggaatatgagaggactgtgattcaatcgcttgaatatgatcaaataatatctgtaaagacagaaattaaaagacatggaatcaagagggcaacatagactcgactagttttatacagtaggatgtttatcctaactagaaaatcaatgcattattgttaaaaagagaagcagcattctttacaaacagacatttttcttagcaggcacccaattctaactccacatgaaaaacctaaaataaaaagattttctttctttctttctttctttctttctttctttctttctttctttccttctttctttccttctttctttcctttctctttctttctctccttccttccttctttcc

SEQ ID NO: 170565 - DNA, 321 bp, Homo sapiens
ctgaggacccgcaacaacttcgtcattaagatctcaagaagtgtgtggacattcggcgtgtgcaatgtccagacactggcgaggaagaaactgaaacagctgtaaccactcacttaaatataccatggcattcgtacaaatgatcgtcgactttgaacccaagagctggggtccaataggaagacaactccaaatcaggccttaaaaacctggtttcagaatacacattgctgccttgcctttgtgggtatggaggctcggcgtgtgcagcaacaacttcgtccatacggatctgcggcgtatggattctcggcgtgtgca

SEQ ID NO: 170566 - DNA, 206 bp, Homo sapiens
agaaactgatgcgtgtggtaggcagaaaactagtcccccaaatatgcccatgtccttatccctgcaatatgtgcatatgttaccatacatggcaaaagggactttgcagatgtgattaaggttaagattttgagataagaaaattatcctagattatctggatgagttcaatgtaataaataataaagatccttctaagtgaaaga

SEQ ID NO: 170567 - DNA, 1502 bp, Homo sapiens
ttattgactccctgtcacattttctcaaatagctgcattccaaattttcactaatcttttctttaaaaaaatcctctctctacattttttgagaagattgatgccaactgacacgaactattgtaaatgtctatcttactactggaaatttttgtgtcccttcatctttatcaaacaatcagaacaggcactgactaacagcagctagtggcgcctgctgaatatcaggccagatgtgtgatctcagattcatcacctgtaaaatggggtaaataacaccaaacaggtgtaaaaactaaatgcagaaaaatgcctcgaatatgccaggtattcaacaaatgttaaatacaagtggcctgtccaagttttgggaacatatcatactatcacagcagcctaaaaaatccttacaatgtgagaaagtacaggctttattagacagggtctgtctgttaacagtggatattagtgtgatgagtcacagctccagctgtgttgctacatttcaaatggaactctgctgcaagactgttcacacatgctacatttcacatgagcctcctgtgcaattttattctaggctaccagaaaatttaagccatttttcagctctttaagaacataagccctttcactgagaaaattccagtccagtgccacacacagttcactcaactgtgctacttcatgcatgctattctgttcaccactaaaagagactttcaacatgaacttttccctctgtgatgcaattttgtgtgtgtgtgtggcgggggaggatgtaagagcacagtgagaagataagagttttcccgttttcctctctactcaaatcccgtctcctcaacccttttaaaactctccttacgatatttaacaaccatttcagtcactgtggaattctgttatggagagtaacatgaatttaacttaagctttcttttgtggaactctagctggaaattgctcataattccagaaaatgtttcttaacctctaacgaagtacatttaacttgaattttaaaagatttgaattgcctctcaccttattcaaaatcctttaacgaagaaagctttccagtataaagaaactgttctgaaataaactagagttctgagtggtggcttacttaaagttgtgttatagctgagtaagtaatatattattttgaagagaatataaaattgacttctctcagcccactgacccttcctgtcttgtccccatacaatgatttataggaaaagtatttgtaatacagacagttacttttctatcttcaactcaactgaaaactcagagaaaaactacagctggattggaagaaaaggacttgcttgagacagggagtaaaaacacagccaaagcatgactttagaagaaagaaaagaacataaaagcttggcataagaaaaggaaagaacaactccatttgagaaactagaaaactatcgcaaggcatgactcaaagtataacaatatacaaagataattataac

SEQ ID NO: 170568 - DNA, 449 bp, Homo sapiens
gcgctttatccacaaaaaaccttcccccaaactaattcctaatatttaatatgtgtttaaatgaatctttttctatacaatgtaaatggtaactttggtaaaatgttcccatgagttgttagaaagatttaactagctttgtaatttaagttttaaaacataaatatttgcagcttgatcttcttttgatagtgattgttggagcccagaattcaacatttataaattctcattcatgcaaacaaaacacagaccatcatcatacaacttactcctcatgtcctgagagaagaatcttctacttctttcagtctttggcctcccagtaaattccaatttcaaacaacttttaacacaaacttcactcttagatttttaacaagcttttcacacatacatcattaatgcttcccctaatctttcatgttgtactggctattgggcagttg

SEQ ID NO: 170569 - DNA, 289 bp, Homo sapiens
ccatagttaagaagttcatagcagctgtgtttggaacagctaccgatacatcaatggtaggcctagttttagaagtttcaatagcaacaagaaaacgtgcatgttgtggggtgaggggaaggacacctgagacaagtacctggtgtccttgtcctctgcaggccctcagcctcagccagaaaccagcatgcagttttccatcccttcggccctgcagcctcagacttccaagcctaccaggctattgaaacttctaaaactaggtgctattgaaacttctaaagctagg

SEQ ID NO: 170570 - DNA, 314 bp, Homo sapiens
aaaataagatccttgaccccaaataaaccagcttagtgactaagcagatttcatgtattccattcctaaagactcccttagtttgatatttcaataaaatgattagattataaacttcaaacaaatagaaactcttaagaaagtgacaacaaatgtacaaaacatgaaacaagtgaaaaatatgaaatatattctggaaatggtatctataaagtttgttttataaaaagttaaaataataccactaagggatttcttccccttttcttgtgttgaaacacttcagaatacccatgtatataggcatttacaaa

SEQ ID NO: 170571 - DNA, 486 bp, Homo sapiens
gacacagagagactccatctaaaaaaaaaaaagaaaaaataaaaaagaaaaaaaataattagagattcaattcagaagaacagtatctaactaagaagtattccagagaacagagaaaacaatcagaaggaaattattggaaaaataatactggacaaacgcccagaaccagtaggcttgagatttcagattgaaaaacctttgtgtatgcagtatcataaattcacataaatgaacaaaaaaaaatctaccagtgataccattgtgaaatttcagaaacaaaacatgatactaaaactgagaaaggtgagagagaaagagagaaaataaacacagctaacatgcacaggattaggatgagaggtgctgacttgatagcaatgttggaagttggagggcagtggaaagcaatgcttctacaagcttgggaaaatacagatattttcagacaagcaaagattcaaaccacaataaattcctgtataa

SEQ ID NO: 170572 - DNA, 414 bp, Homo sapiens
ccccaacaaagaaaacaacaacaaacaataaaataaagatataggcattaaatatatggatatatgatgcataaacaaataattttttttacaatacttcaggttacttgaagccttcttttgagtgactagatttaagtttgtgaaacaaggttttcagaagttttggttttattctctcagaaattttggcttcattttttcaacaaaacttttattgactgtttatttagcagatattaaatgtagcaaaattactatgacccagctgttgtccacaaggagcttatagtctaatcaagaaccaatttgtaataacaatgaaattaaaatatgattgtatattgaggtaagtgataatagaggtatgaaaagaaaatgccatcgcaatgtagtggaggggttggggaagga

SEQ ID NO: 170573 - DNA, 684 bp, Homo sapiens
cagaacagaagccctgagaggttatctgccttgatctgtactgtgtccccagcactcaagacagctctagcacacagtaggtgctggagtttcagctgtgaccaaaaccagatcccacccttgtgcacggggaccaggaggaattaggagctacaccaagccctgccttggagacctccctggtttgtgcctcggtttccttgatctttacagacttcaaacccacaaaaatcagccccgggcaccaagagcccattttccctggtgcttagatggggaaactgagtcccagagagtggtgaggactggttcaggcccacacagctcccttgggaagagaacttgggcttcctgcctcctgtgagccacggttttttgttgttgttgtctttttttgtttttgtttttgtttttgagacagagtgagaccctgcctcaaaaaacaaaaacaagaaacacccaaaaaacaaaagccataaagccaatagattaaatatgtgttaaggattgactgtttgccatgcctttaagaaaaataaagttggccaggcgcagtggctcatgcctgcaattttagcactttgggagggcgatgtgggcaaatcacttgaggtcaggagtttggaaaccaccctggcccaaattggtgaaaccctggctcttcttaaaaataccaaaaattag

SEQ ID NO: 170574 - DNA, 524 bp, Homo sapiens
cagaacagaagccctgagaggttatctgccttgatctgtactgtgtccccagcactcaagacagctctagcacacagtaggtgctggagtttcagctgtgaccaaaaccagatcccacccttgtgcacggggaccaggaggaattaggagctacaccaagccctgccttggagacctccctggtttgtgcctcggtttccttgatctttacagacttcaaacccacaaaaatcagccccgggcaccaagagcccattttccctggtgcttagatggggaaactgagtcccagagagtggtgaggactggttcaggcccacacagctcccttgggaagagaacttgggcttcctgcctcctgtgagccacggttttttgttgttgttgtctttttttgtttttgtttttgtttttgagacggggtctctctctgtcgcccaggctggagtgcagtggtgccatctcggctcactgcaagctctgcctcctgggttcacaccattctcctgcctcagcctcccgag

SEQ ID NO: 170575 - DNA, 659 bp, Homo sapiens
aatctatggtatttttttatggcagcccaagccaacaaagacagcatcattgctgtcacttacagacaagaaaactaagactaggagagagaaaagttaaacttgtccaaggtcacaaaagccagaaacaagtgaggtgagaagttgaccttgttctcctcaatccaaggccaggactcctccactccacatgtagatagccacctcacagtcaacagccaaatgtccacaccccagagtcagcattagaccaagatgtcttaccaggagacaaatgcctcatcttgaataaatatgttctaacaacttacccatgtaaaacattgaatctcatgagaaacaaaaatgcaaagtatgtagaaaactatgtttaccacttaactgacagtgataaaaagcttaatgatatccttatagtcttggaggggtttgtatatgtggtgaaacaggtgctcacgcactgctgatagactgtaaattggtcctagagagaaaaataaataaactggaaggagatatgctgtatgtttactttttttatggaaacatatgatatacctggaaattcgattgaccatgcatctatttcttcaatgggtatgcacagttgagctgttcccatgcaccaggcactgtaatgggacaactgcacatgacag

SEQ ID NO: 170576 - DNA, 279 bp, Homo sapiens
atcctttcaggctctctgatccgcagactggatgtttagggtgcacgtgttagtggaagccctgactaaactgacctttacaaaatgaggacatttatttctgcctccaaatgtgtgggggcctccacctgagggtatggtcatcattttaacaaacaaaaaagcaaaaggcacagctgacacacacaagtgccctgtaggagaacctatgcattactccaaactctgctcagatgtgtaacaaacttacaatattaacaaactctgctccaaacccca

SEQ ID NO: 170577 - DNA, 357 bp, Homo sapiens
catttttttaaatctaagaatctgaatttaatatctagcaaatatgtttgagagagacttccaaaaattgaaaatggatatcatggcattatttttatgcttttttgtgctttataaccctcctcttctacttgaccatcttctatgatagtggagtaaaagtcatgaggtacacctctctttatttaaatatatagtttttcactaaataatattgagcattctgggtatactcattttttaaaaaactgtgcggattgttttcttccaggcagacagttgtgaatagaatagaattctgctcagcattctattatatattttcaatagtgtcactctcagcacccaaataatcaa

SEQ ID NO: 170578 - DNA, 1080 bp, Homo sapiens
tctgaagatgcgccttactttgtatctggaacaaggataagtatcttctgtatcctgctctcagctgtcactgctttttaggccatcattacttgcttggcatactgcagtgcctcctaattgtctctttgtttctgctctggcctctctcatgtatcccccacatggccgctggttctcttttctttatggggtctttgtaatgtaatctctcctcctctagcctccccatgcccctcatttctccagtgtgctgtgctgtattaccaggtagcagaacgtaccctaatatcgcatgccttcctctgacctaacttttccatctgaccaattcctacttatctacaaggctcagtccaaggaaaactgataccgggaataatcataacaattgtgcacgcctcctcagctgctatgacaccttgccattatttcatccggatacttatcaagctacttgtaatgatctgtagtcttatttggactactagattgtgagctgtaatacaagtattttgtctctagtattaagccagtttatttggtttctatcattaaatacaatgttgaaaaaattctcagggtccaaggggagatgcttgggttgagtcagagataaagtaggaatatgcagttgaggaaggtaaggaagataatttagctgaagtaaaggaaaagtgcatagtgtgttcatagagtgggagttaagtgtaagagacattctagggaagtgaaggagaagctgaaagagcaagtagagacggtaaggtgaagctcctcttgccatgtgaaagagatcaaactttctccttaatttatgggaggagcgagcatagagaagtctgtgatgtctcacaaggttctcacttttacaattgaatatagaagtagctcttaggagaagcagaacgttcagaggggaagatgaatatggttttgggtacattgccttaaattgcatttttggtatttgggtggcgatgtctagtaagtaaaaagccaggaatgtgattttagagcttagagctagaagcaaggaactaggagttgtttagatgatgaaaactgaaatatgtatat

SEQ ID NO: 170579 - DNA, 698 bp, Homo sapiens
caagtatttggtgctctagtattacagctcacaatctagtagtccaaataagactacagatcattatcaagctacttgtaatgatctgtagtcttatttggactactagattgtgagctgtaatacaagtattttgtctctagtattaagccagtttatttggtttctatcattaaatacaatgttgaaaaaattctcagggtccaaggggagatgcttgggttgagtcagagataaagtaggaatatgcagttgaggaaggtaaggaagataatttagctgaagtaaaggaaaagtgcatagtgtgttcatagagtgggagttaagtgtaagagacattctagggaagtgaaggagaagctgaaagagcaagtagagacggtaaggtgaagctcctcttgccatgtgaaagagatcaaactttctccttaatttatgggaggagcgagcatagagaagtctgtgatgtctcacaaggttctcacttttacaattgaatatagaagtagctcttaggagaagcagaacgttcagaggggaagatgaatatggttttgggtacattgccttaaattgcatttttggtatttgggtggcgatgtctagtaagtaaaaagccaggaatgtgattttagagcttagagctagaagcaaggaactaggagttgtttagatgatgaaaactgaaatatgtatat

SEQ ID NO: 170580 - DNA, 401 bp, Homo sapiens
tctcaccagggcaaccactgttcagatttctttctccaaaggttagtcttgcctgttccagaacttcatagcaaagttgtcatgtggcttgtacttttacatatctgacttcttttgttcagcataatgtgtgtgagattaatctatgctcttgggtaaattatcagtagtattttgtttctgtttattactatatattctgtcttatgaacatattacaatttgtttatctgttcctattgatggacagttgggttgtttccaacctgaattataagcaaactagctatgaatattcatagacaaatctttgcgtggatacatgtttttctttctcttcagtaaatactaaagggcagacctggtggtcacagaacatattatgtttataagaaagcacc

SEQ ID NO: 170581 - DNA, 322 bp, Homo sapiens
tccagcacacgcgaatcacagaccatggtggttgatcctcaggtagttagggaggaaaataaacaagaagttatatatttaaaaccacgtttcaattttacacctgattaattgactaaataaagggcattagcacttctacttcctacagtccctccctttacctctggaaactagtgatttctaggttgttttgtgttgttaaggtgggccaccttttctttctgttctgcactcatagtcctgtttttaaatggattcacctctcatcactagccttttgtatggtgcctcggcgtgtgcagtttggacattcggcgtg

SEQ ID NO: 170582 - DNA, 267 bp, Homo sapiens
ggattgtataggagtaataaaacaagggtgactgcagcagggaggagtacgattactacacacataacagcttattgcctctcatgcgttcaagcacagctctatgccattcattacaacagacagccagggcaaactgccatagagctcactccagaaaaggcccggtcttgagtgcagagactaaatcttctcacttacatgtcttcctaatgtttccttacttcatcttcccatatcgagaataacttgaggagaagcaaaaca

SEQ ID NO: 170583 - DNA, 503 bp, Homo sapiens
tgtacagctctgtagaaatgtgaaggattatttttgttcttcagctcgccctctaacaaaggctgaataagtactgaattggccaaaaaagggagggcaaaggaaggaatgtgaatcttagggggagtagcaaaaaagctggaataatccccacactgtgtttccaacacttttcatgaagcccgagctccaagaaacagtacacatccagggagggaggtgagaaactggggacttgagggggaagggggttaggaggagagggaaaaggagcccactgctgtcaaagcccaggaggacatggaaggtccttgcctggtgaggagaagaagagggtgtctctcgagtcccagctcctgctgcgtcttccttcgtgatccagactctcttgtgatccacaaagcacagcttccagctttgagccaagaaatgctgccttccagtgccccccacctggcagctactgagcagattcaaatatgctcagggttggagcccagaga

SEQ ID NO: 170584 - DNA, 412 bp, Homo sapiens
aggtgggaggattgcttgagttcaggaggtcaaggctgtggtaagctgagatcacactactgcactccaccctgggcaacagagcaagaccctgtctcagaagcaaaacaaaacaaatatactaattgcccaagcatcattatcttttgtagattaatctattttaatgtgcctactgactgcagcagaaattatgtgtcctgaacagaaacaaatttctatagttttatatcttcccagaaatactattgttcaacatgctgaaagatatagctgagaacctaaagatctagtaatatgaaatgatgtttggcttctctgaacttaccacatcaagaaggcagcagtttgcaagcaatgcccctcctccaccaaaaaaggccttattatattctaaaaccaaggaaactgt

SEQ ID NO: 170585 - DNA, 747 bp, Homo sapiens
aagtcttaaatgtagctattttctttttaatttccataggtttttgggaaacaggtggtatttggttacgtgagtaagttctttagtgatgatttgtgagattttggtgcactcatcacctgagtagtacacacggaactgaatttatagtcttttatccctcactcccttcccatcctgtccccaaagtccattgtatcattcttatgcctttgcatcctcatagcttaactcccacatatgagtgagaacatacgatgtttggttttccattcctgagtgacttcacttagaatgatagtctccagtctcatccaggttgctgcaaatgccattaattcattcctttttaaggctgagtagtattccattgtatatatatacactacattttctttatccaccagtcatgctagttatgttctatgaagtagccacaatcaccacattactgaatactgaattattgcccctaggggaaatatagggtttgttactctgagctgctggtcactttttttttttttttttggtcaaccaatcaatacataaccttgctttatgtatgtttctatttaaagacaccttacttaatatatgctcttaattctttaacattaaacacatggccaatagcactctaactcatgcctgaaggaagtttttctaacccacatatttctccataaggcacatcactgctttcttgagttaggaacactacacagcacctcagcacagactaag

SEQ ID NO: 170586 - DNA, 186 bp, Homo sapiens
tactgtcatttggaggagaagagccactctggctttttgagttttcagcactgattctttgcttatctttgtgggcttatctaccttcaatctttgaggttgctggcctttcaatagggttttgtgggattctttttgttgatctttttgttgttgttgttttctgtttgtttttcttttcatagt

SEQ ID NO: 170587 - DNA, 315 bp, Homo sapiens
ctctatggactcatccaatccctggaccacatcttattctgtgaaacatatagaaacctagcttaagtaaattaataaaataaaatgaaacacgtaaagattcagaatgtgtctgaattagtacccaactacattacttaggtaatatttaggctttttaaaaaaaatttatgcaacctcatgtaacacctgtgtgcttggaaatgctgactattcttgtgcttaaagcttatccatgatctgcttcagagtttgtgtaacacaaaccccccagtttacatatatatatatatacacacacacacacacacacac

SEQ ID NO: 170588 - DNA, 416 bp, Homo sapiens
atgccaaattaaactttcatgcaccacttctgaataaattaaagtactaaagcaaaacaaacaaggaacaaagacagacaacaacgtggggtgaggaacaggcagaactaacccaagagtaaaatggagagaaattcgagggcgacaacaatgcagcagccctcgaagcccatcagggcatcccacaaagagtgtgaagaagaagctagaagatccgagagcaaagaaaggtgtaggtttcttctactcaaaagaaagaaggggaaacagaaatgctaggaaaagaaagcagcgtacagtcagctacaatacgaaatatttaaaaacccagtatgattttgagtaaattacagttaaagaacaaaattctcaaaacacatttgttgaatggcacaaatataaagacccatctgaaa

SEQ ID NO: 170589 - DNA, 384 bp, Homo sapiens
caaacaatagcttcatccaaactctgacatacactctttgtacagctgggctctgaaactgttttatggaaagagtggtcattcagtgtacttcgaggcacgcttagatcatgcttagggtgagataggccaagggcttagttaactcgcttatttaggtcgtagagatgtgaattttgacattttcatactagactgttagctttcgtacaagagttgatcgtttatgtgggaagtaactgtcactttaaaacaaattttatttttactcttgtttggtgcaaattgtgtccctgggttttatttaccttttccttcttagtctgtggcagcacgaatggaaaagcattacattaaataaatgtaatataagtgcatttttct

SEQ ID NO: 170590 - DNA, 412 bp, Homo sapiens
ggacaaatgcagaggcattcacattttccctaatagtttcaaacttttaccttgtctaagaaaaaattaaaaggtagatttaaggagggaaaaaaatgggctgaggttcttaatgctatcatttaacagaccatgttaaatgcccatcatataggtaaaacaggtccatcaccattgccaccagattccatacaggacaatgagacttagatccttaggtattcgactactaccaaaaaaaatatgtcaagttggttaacccaccaacatgttgtatttattatctgaactagagaaactaaatagtactttctattgagcatatcctagaacttgtaccatcttttccccaaaagttaaacattaaactaccatctatttcctctggacctacaaacttcctataggtaca

SEQ ID NO: 170591 - DNA, 344 bp, Homo sapiens
cctgggctcaagtgatcctcctgcctctgcctcccaaagccctgtgattgcagctgcgagctaccgcacccagctttcttttcttttgaacagttggtaaatgtgactctcttgagatctgtgcattcaagtgtaggtctctggggattcagtctcatactatcaaatattctcactttaaatatacaatatgctagagtatctctaactttttgtagcgtgggtatgaaagattgcaatattagttgaaaatatttatttttttccccatcttcttatttagagatggcgacattcttagtgtgtagactgaaataaatcactattgaaatgacatcaacgtg

SEQ ID NO: 170592 - DNA, 103 bp, Homo sapiens
gtatcctttttatgtatgctggatttgatttgctaaaatcttaagaattttttggtctatgttcatgataaactgtggtctatagttttcatgtaatatctgg

SEQ ID NO: 170593 - DNA, 716 bp, Homo sapiens
ggctggaaccacatttattaagccttcctagaggaggtgaccactgaaccaattattttaaaaatcagaatgaggcaggtgaaggatggttgtaggaggccttctagacgaagcagcaggagcaaagacagggaagcaaagagtgcaatatgtacaggcaaacacaagcaggcctctgttactgcatgcagggtgggtttaaagagtagtggcaatgaggctggagatatggcagggaacagttcttagagagtcagttttagccttttaggagtttagactctatccttaaagggaaaccccacatttatttatttatttatttttgagcacatatgtggtattagttcgtctttctatgcatgaagaatttggcttattaaaataattttaattattgggtatcagacccatttgtaaacagaaaaatacagttaagtgttttcttaggaaacagaatgtaaccgtactttttaaaacatcgtacagccatggattcaaccaactgtggatggaaaatgtttaggaaaaaaacaagaaaaaataataaaaaaccaatacagttaaacaaccatttacatacatttacattgtattaggtattataagtaacccagaaagataaagtatataggaggacgtgctagcttatatgcaaatactactctattttatataagggacttgaacatttggattgtggtatctgtgggggt

SEQ ID NO: 170594 - DNA, 332 bp, Homo sapiens
tgaatttatttatctttcccctaatccaataaatgtctctccttattcttcctatttacctcaccattaaataccgaaggttttcctatttcctcccaagttggcacattaacactctaatattcattctgatctcacagtattgaatctgagcatagaaacctcataacattcccagggataaatctgctacccaattcctaaaagataacacacagtttaaaaaaataaacacagtggtggtaattatacaactgtatacatgtgtcaaaatttgtcaaactgtacacttaaaattggtgaattttattgtatgtaaattatacctcaat

SEQ ID NO: 170595 - DNA, 451 bp, Homo sapiens
cacaccgtgagtggtagaggcgcagcagcagggcagacccagggctccagggcacgtgtgggccagggtaggtgaggcaggagagcttgcctgcagggcggcagggttggtgacgaactggccgcctcacgatggcccccactcactgagcactctgcgctgggctctccctgaacgcctacaggcctgagcctgctggtccgccacttggtgggtatgttcacttccattgtgtagacaggaaatggaggctccagagaggttaggtgacttactcagggccaagcagaagctaagtggtgtggtagaagaaacagaatctgaagtgaaacggacctgggtgggaatcccagctctgccggttccgcgtctaaggaccacctcccctgagagcgcccacccctccatccctcctgagcaaggtttctgggccaggagccatcctgtccca

SEQ ID NO: 170596 - DNA, 411 bp, Homo sapiens
ggcaggtacaggtttttatttggggggtatgaaaatgttctggaattaaataatggtaatgttcacacaaccttgtaaatatcctttaaaaattgaattgtttgcctcttaaaatggttaattttatgttgtttcaattatgtctcaattttttgaacgtgtgtgtatattatatatataatcctctaaactaacataaggagactatggaaaaatacttaactgatccgaaatgtgcaagaaagatgtgaaaaagcaacatagactggcaggacaaataatagcacatagaaaatatggtatattttatctcaaaatattaacaaacacattaaataaaaatagactaaattcttgtgtgaaagctaaatattttcaggctgtattcaaaatatattgacctagatatac

SEQ ID NO: 170597 - DNA, 303 bp, Homo sapiens
attctgactgacagagataaagatgctacatagaccacaaacaactgaaatcacaggtatcatgagagtttagttacagtgacaaaagcaaaaaagaacaaaggaagatcaggggatctgtgaagcatttgctctctcttttcgtaaggagccaagacacccacagtaaattcccctgtagagagctgctaccttaaagcaggatttgcattttcagaaatgcttccttcctctcctacatttcaatcgtagtaagaaacatttactcacattttcaatcttctgattttctagaaaccctag

SEQ ID NO: 170598 - DNA, 279 bp, Homo sapiens
atcccttgttataggttttcaatacggaattacaagaaaattaaatacaccaatatttttaacccctaactccaaagaacctgttgtaaggattagaaataatatattgaaaagactcagcatatacaggtaattgaattaaaaattcttatcaaccagccacttgggaggctgaggtgggaggatcatatgagcctgggaggcagaggttgcataagcccctgcagattgcaccacagcactcctgcctgagcggcagagcaagacactgtctcgagg

SEQ ID NO: 170599 - DNA, 289 bp, Homo sapiens
cttgaactcccgacctcaagtgatccatccaccttggcctcccaaagtgctggaattacagaggtgagcctctgcacgcagtgatcatacaattttatgtgacagtttccctgagagcaaatacttattttcgaatatgaaggtatgtttatgtgagatcaggcctactaacatatatttagaaaataataaagtgacctcaacttctgtgaaagaccctgcaaaatgagagaaaaccaacaaaaagggacaaggaaaggagggggttatataggtttgataggaagaa

SEQ ID NO: 170600 - DNA, 309 bp, Homo sapiens
gtggtggcaggcgcctgtaatcccagctacttgggaggctgaggcaggagaatcgcttgaacccgggaggtggaggttgcagtgaaccgagatcgcgccattgcgctccagcctgggtgacaagagtgagactttgcctcaacaacaacaacaaaaaagataatgtgtcccactggggttagctctgttacaatcacagaattacagagcctgtagaaagatctgcagatctttagaaacttaatgcaccttagaatttccatgcctggactaggaggccttgtgtagaggaggtttactggagatgag

SEQ ID NO: 170601 - DNA, 488 bp, Homo sapiens
tgcaattgaaagtagaggctttctctggagggaaaggtgaggaggatgtgatttggaagaacagcatggggaggcatcagttgtattgtaatgtttattttttaagctgaatgataggtacgtagatgttcattgtgttctttttgcctttttgtatatcttaaatatatggtagtgccatgattagcaggcttaatagccttgtgagtttaaatgtcactttcaaatgctgtatttttggtggagttgcttaaacacattccccttggaatctatacaaccagttaaaaaaatcatgtataaaccaccatgaaatataatgaaatgtactgtatatgcattttcatgaatgttgtgtcaaagggcttgtaggaaaaaaagatcgttaactcttttgcattcagtgaaaataggtggctttggaaatagtttcagccttgctaacagtttttttttcatgcttagaattaaacgaaataatttggaat

SEQ ID NO: 170602 - DNA, 310 bp, Homo sapiens
ctgggtggtgataacaagcagagcctcagaaattctgtaagggcccaagaatgcaacacagaacattcagcaccaaatgttgctaaatgtttcaactactttgaaaaatttaactgttccaaagcacgtctgtgactatgtatgactaaatgtgacatttataaaaatatgacagagcactgtagtcccagctactagagaggctgaagcgggaggaccgcttaagcccaggaagttcaagtcttcagagagttgtgactgcactactgcactccagcctgggtgacagagtgagaccccttcgctgaat

SEQ ID NO: 170603 - DNA, 223 bp, Homo sapiens
gattgcctagaccagcctcctatcagagactaatatgtcatatacaaggctacacagatgatgtaagtaatctatatttagaatagactgcagttaaaaacagactcaaagcagttgaacaacccactgctcaactgatttccaaccaatgcagttggcagaataaggccattttaagttgacctggaaaaaaaaatattttaagtcaggggtcagcaaacta

SEQ ID NO: 170604 - DNA, 361 bp, Homo sapiens
aggaagtgcagtagaggaaaatgtaggtggagacttccttacaccatcgagaccacacaaatgggcatgtgtttatagaaaggcccagtggtgaggatggcaatggtggtgagcactcccgagcacaaaggtggatgcccttcagctgtaagatcccttttccttgaagaattctccacagcaagctggctggccagccttgacttttctcttcctgaagggagcctggttctctactgactcagcagggaatgtgtcctttagtgctacttattgatgtgaggatatgaaaaacttccccaacctcaaatttgggacgtccttaccagtgtttctcaaatttcaatcactctagggctac

SEQ ID NO: 170605 - DNA, 439 bp, Homo sapiens
ttttcccatttcaaaaagagtacattctacatgctacattctaatgacttttatatctgtatctgtcttccaagcccatattagaaaggcaagcatagtgcagcagttgcaagcaggccgtcattttattgagatagacataccacttaataccaaaggaaaagactggaaattgagaccagaatacaaaatgtagtagctgggaaccatgctatgtggaatcaaactgtatatgcaacactgactgctaaagaaaattgtgaaactgtacttgtaggttttacttggaagctatgatcacagaccttagatggctgctttatactgcctggcagagtttgtatgctgtacttctcagacaactttttcaacctaaatcctttctctccaaaacttaagcatctgtacctcagcctcaccctaagctcttgaaacaagc

SEQ ID NO: 170606 - DNA, 173 bp, Homo sapiens
caccatcccacacaacactccagttgtgatcagtggattaaagcaacactccttggtgaataggcttcttttgatggtacttgcatttgaaaagagttttgttgaagcaatttagcttctaattaatgcattctgtgggggagatgttttttcatggagtcatcttcttgtgc

SEQ ID NO: 170607 - DNA, 294 bp, Homo sapiens
catccagaataggcaaatccataggcagaaagcagattagtgattaccagaagatgagataggggaaaatgtacaatgactgcttaatggatataaggtttattttggggatgatagaaatgttctggaattagaaagtggtaattgcacaacactgtgaatttattaaaagccaccaaattgtacacttaaaatgactgaaatggtagattttgttaggtgaattttttttttttttttttttttggagacagagtcttactctgttgccaggctggagtgcagtggtgcgat

SEQ ID NO: 170608 - DNA, 361 bp, Homo sapiens
cctagagtgaagatcttgcagctcactaggaatttccttgtgggcaaaatatgggggaggcatgtaacttttcatctcgttcaggaaccaaaaacggagaggcaggtttgtgtgacccagttcctagctagacttctccctttggcttaatgagtttggggtcccaagatttaatttcctttctcactgggccttcagatgccagctgctcttggctgtgagaccaggagtacgagtaggcagtgtgatggaaaaagcgccgtgagtaggggtacctaaattctcttttgttaccagctctgcagcctgggccgcacttgcagctccttaaccttagcctatccagccacaaaagaaaggt

SEQ ID NO: 170609 - DNA, 214 bp, Homo sapiens
ctgggcctgtttcctcctctgcaaaatgggagacaaactgccactccatcacagggctaacatcaggacttaagtgttagctgtgatcaccattcagcaagctgtcaaattatgagctggctcctcctgtcacccggtcacgccccctgcttcctctgaggctcccaagtagggtctatgaaggcttctgaccttgtgccccgccatccactca

SEQ ID NO: 170610 - DNA, 112 bp, Homo sapiens
cagcgagagcttcaagatcctcagtttgggtctaacatagagaatccaccagaaacacatttttttttcaagttttattttaagttcaggggtccatatgtgataaagttta

SEQ ID NO: 170611 - DNA, 1461 bp, Homo sapiens
agtcaccatgctcggcccaacatccacatgtttaaagcaaaacctgtggacccatgacgttgatttgccctatcccagttatagttaccatcaagtcccactcggagaagagacttgttggtaaaacagttctatttttataatagtagaagaaatccagctagcaatgtaatcctctttcttaaatgtaattgtacaactaacagtcatcacacatatgagggtagccagcaacgtgagagacaaaattcaagattaagttccaaaatcaacatggaggacaatttagtaaagagactagacctcttttataaaattataattactatgtagcagaaaggagccaggacaagaatgaataaacagattacaaatattgttgctgaaataaaaatgttcaataggaggattaaagtccaaaaagaaaacttccccaatacaaaaagagatagaagacatagagaaccaattcagactattaggaatctagaaagaagaaaatggagaaggaaatgctatcatgtggaagaggatttcctagggatgaataaaattcattgaatgcccagcaacagtgactgacaaaatactcactaagatacttcatagtaatactgtatcatatcaaggagagggagaaagagtgtcagtgattttagagaagccaaagaaccatattttcagtgcagcctttagtacatggggagacacacacacaaagctatcatttgtttagctttgtgatggcggtattagaagtttaggtggaaaatttggtgtattctggactgcgactttctcctctttgcatcctgattatattcatgaaatttgttaaaatcactatgagggattttctcatcctcagtcttttcctattctctataaatctttaataaatctcacactctcaagaggtcagagcatttgaaataaaaatcttaacagtattgaatattggtatatttcatccatacaatcaggaacaaatttaatagtaggaaaggaaataggtacattatatgtgtttctgtatatttatgtttatgtttttatttacatatgtatactgaatatatatttgttactgcttatagatcacatactatgtttcatcaactttaagatttcattaactataaaaatgtcattttatgaaacattaaagaaaaatattgcaaattaactcatgaccttataaagtacatctggatttcagagatgttaagtgtgaaaaaatatcttagaattcattagatatgcttagcaatatatgatactatgcagtagattccattgttttcttgaatagaggcttcagttttctaaataattttccacttataaagattaaaaattagttctgttaaaaatatgtatcatcttctatttggagatagttcagggaactattagaaaatatttacatatacctgaatttttaaaatctgtagctatata

SEQ ID NO: 170612 - DNA, 1407 bp, Homo sapiens
agtcaccatgctcggcccaacatccacatgtttaaagcaaaacctgtggacccatgacgttgatttgccctatcccagttatagttaccatcaagtcccactcggagaagagacttgttggtaaaacagttctatttttataatagtagaagaaatccagctagcaatgtaatcctctttcttaaatgtaattgtacaactaacagtcatcacacatatgagggtagccagcaacgtgagagacaaaattcaagattaagttccaaaatcaacatggaggacaatttagtaaagagactagacctcttttataaaattataattactatgtagcagaaaggagccaggacaagaatgaataaacagattacaaatattgttgctgaaataaaaatgttcaataggaggattaaagtccaaaaagaaaacttccccaatacaaaaagagatagaagacatagagaaccaattcagactattaggaatctagaaagaagaaaatggagaaggaaatgctatcatgtggaagaggatttcctagggatgaataaaattcattgaatgcccagcaacagtgactgacaaaagagtgtcagtgattttagagaagccaaagaaccatattttcagtgcagcctttagtacatggggagacacacacacaaagctatcatttgtttagctttgtgatggcggtattagaagtttaggtggaaaatttggtgtattctggactgcgactttctcctctttgcatcctgattatattcatgaaatttgttaaaatcactatgagggattttctcatcctcagtcttttcctattctctataaatctttaataaatctcacactctcaagaggtcagagcatttgaaataaaaatcttaacagtattgaatattggtatatttcatccatacaatcaggaacaaatttaatagtaggaaaggaaataggtacattatatgtgtttctgtatatttatgtttatgtttttatttacatatgtatactgaatatatatttgttactgcttatagatcacatactatgtttcatcaactttaagatttcattaactataaaaatgtcattttatgaaacattaaagaaaaatattgcaaattaactcatgaccttataaagtacatctggatttcagagatgttaagtgtgaaaaaatatcttagaattcattagatatgcttagcaatatatgatactatgcagtagattccattgttttcttgaatagaggcttcagttttctaaataattttccacttataaagattaaaaattagttctgttaaaaatatgtatcatcttctatttggagatagttcagggaactattagaaaatatttacatatacctgaatttttaaaatctgtagctatata

SEQ ID NO: 170613 - DNA, 146 bp, Homo sapiens
gatgctgtacacaggggagccagatatataagcaaataattagcatgcatgggctatggaaaggtgctcacgatggatcacgttcaataaaaaactatatgcaatgcatgcccagagttttgtaaaatacacgttaggaaaaagtt

SEQ ID NO: 170614 - DNA, 706 bp, Homo sapiens
ctcttcataataaatcttgctgctactcactctttggatccacaccaccattatgagctgtaacactcactgcgaaggtctgcgactttacttctgaagtcagcgaaaccatgaacccaccggttggaacaaacaactctgcacacgccacctttaagagctgtaacactcacttgcaaaggtctgtggcttcactcctgaagtcagcaagaccatgaactcaccggaaggaagaaactccagacacatctgaacatctgaagtaacaaactctggacacaccatctttaagaactgtaacactcactgtgagggtccacagcttcattcttgaagtcagcaagaccaagaacccaccagaaggaataaattctggacacagaagttaatatcaataattacacaaaaacccatataagaagtcactctggaacaagatttttagcctttgagccctgagtctatttttattgttaagtatttcatgtttatttttttctcatcctctacaaaaaagcagcagtaaacatgtgatgaccagccctttgtcagttaaactttttcccctggggcattagaggaattttgtatgagaactctcaaaatgccttacatactgctacgactaagatgttacccagagaatcttactttcttggtatcatttattcactttggggaaaaaaaaagcaacccataactggta

SEQ ID NO: 170615 - DNA, 340 bp, Homo sapiens
tgcttggttatatgtgggaagaaatccctgtacattgagaatgagaagtagcttagagcagtctgagctatgtgaggtttgcaaaatgtatcacacccagcgagtcatgagtatacttcagtcacacatacatacctgcacccaggcaattgtttaaaagcattttcttctttctttccttacctgtagtttccagactagctgataaatgacctaaaatgttatcacaagttgcagaatgtgacccttacccattatcttcatgttcctagaatttgtgatacaaaaaaaaaaatgtatagccaatcaatagcttatgttattttaatgaaccagtgta

SEQ ID NO: 170616 - DNA, 173 bp, Homo sapiens
tatattccgggtttacctcttaaaaaaatgacctgcactaagcactaaaattctttctcaaggctgtttgtgggactcaacaagttaagaccctagtactgatggtttttcagaaagtctatgtctaactagctcacaatgatatccaagctatcagctctctggctttattt

SEQ ID NO: 170617 - DNA, 584 bp, Homo sapiens
aatttagtaacaccagatattctccaaacctaagtttcacttggaattgccttttagtcatactttgggataaacagacacttacaggatgatgggctgcctcagtacatcagctgttttaagtggacagccccaatagggtttcactgcacttgaattagagtacagtaagtcagttggttaacacacactccattggtttagagcccgggaaatcggcatagggactaagctgtagtttcctttgtattttctaagcacatccaaagaaattaattttgcatgatgggaaccaagacttaaatagaagatgttttcaagtggcatgaagcatttcagaagccctcatttacacagtgtaacactaatgtgctattgatgtcattcctacctttttaaaaccagtccccaaatgatctcagataggcagcatctcatgagcctagttgctataaatacaggttgagtatccctaacctggaaatccaaaatgcttcaaaatctaaaactttttgagcattgacgatgatgtgcaaaggaaatgctcactggagcatttcagatttcagactttcggattaggg

SEQ ID NO: 170618 - DNA, 697 bp, Homo sapiens
tacatttcttgcaataatttgtagaatttacatctttacaatgttcaacattcccattcagaatcatgatatagatcttcatttaatcaaatctgtgcatgtgttagaaaattcaaagagtgtatttttatagtattgtaacttggtaatttatggctttagttgctattgagagtaaattttccagcatatttttaaactggttcttgctgataaaatacccggtgattaaaatatatgtatatagttgtcgttttacatataaaatattttaatcagcttgtctttgattactggtaaagtgagcacatttccatgtgtttattggccacattaatttttaccttttaattgctgctactgctgcttctgcttcttcttcttgttcttcctagttattcttgttaattttaacaattctttatattttaaggatatctttggaatatgttgtgaaagtattttcccagtttatctttttttcttaacttgttgctattttttgacgtattttaaaatatgtgcagaggcaaatcaatcatttgtttattttgtgataccttctttgcatttatttttagaacactttttattaaatgacttatcttcccttcctttttttgaggtaatgtctctattgtatactatatatatttgtatctatttctggactttatattttattccattgatatgg

SEQ ID NO: 170619 - DNA, 556 bp, Homo sapiens
tgtaggcggctgccaaaaccaagctcttgtaaggtccactgtctctttaagttccataggaaacacacctttagagctataaaatggcatgtctctcctttattacccaaggagaggcacacactggctcatgtttccctttctgtcatgacttccatgaatttcacagctaagtgtgctcgactgaagtaactctttcttaacctaagttttctggtacaattatcgcctctacgtccaaatattatgtctcctgttttatctttcttttgtctatttcatctttcatagagaatgtcactggatctttcttagaaggtgatgcatcaatagcaactgcagtttctaaaccaaaatttatcacatatgaagtcatatagtcatctgacaaaagggcagaatatttgaaaccagaactgtcccatatcctcatggaagataaaccctagaaaataaatacagggtggtgaggctggggtggggtggagtagggcagaaaactaacctttactgaatatcataagctgagaacttctcatgtattctcatttgatcc

SEQ ID NO: 170620 - DNA, 207 bp, Homo sapiens
caccaggaggaggcagcagcctttggggggttggtaggggaacccaggaacccggggaagggctgctgactatgggcctcgtggcagggtgctgatcctctctgagcctgcaaaatccacctctcgtctcagattgtgggaggtgagaacatcaacatcaggaagaaaggaagccagaagctgctggttgtagaaaaataactaaaa

SEQ ID NO: 170621 - DNA, 752 bp, Homo sapiens
agcacaatgtaaatttttataattttttaggtgcatgaaaaaatatatgctctttcatcgttgagtacagttgcctatatatgccaattggctgatatttattcacatgtataatatctttactttttaactctgttctaacaattatttgaaaatatgtgtaaaagtttcctactctgattgtggatcagtctatttctctttcatttttgttattttttcctatatattttaagctataatttttggtgcatacaaataacattttaattttcattttgttggctctatcaacaatatgaaatgctctttcttatctcaagtaatactttttgctttatagtctaattcatttaattttactatatctactccacaaatacttagatgagtatttgtatgacaaatattttcccattgttttactttttgccttttgtatctttttatttaagatatgtctcctctaagttacatagtattttaactttttgtgtatactgactaactttgtcttttttgcctcctgtagaatatttcctctgtttacatttgatgtaatataattaagtgggtttaagtctatcattttactacttttgtatattttttggttttatgttctccttttcttctattttgccttttatctaatcaaacttaaaaaaagttcttctctctctgtttgttagttaaaaattattttcattttagttgttatcccagagatcacaacatacatttttaactta

SEQ ID NO: 170622 - DNA, 269 bp, Homo sapiens
acagaactgtaatggattttctcttccttacgattttctaagtaacattttcttttctctagcttactttatcataagaatacagtaggcaatacatataacacaccaaatgtgtgttaatcaactgtttatgttatcggtaaagtttctggtcaacagtaggctattagtaattaagttttgggggagtcaaaagttaaacttgaatcttcaaccgtgtaggtggtcagtgtccctaaccctgcattgttttagggtcaactgtatat

SEQ ID NO: 170623 - DNA, 375 bp, Homo sapiens
  misc_feature (302)..(302): n is a, c, g, or t
  misc_feature (350)..(350): n is a, c, g, or t
cacccctcactgccttctcctggttcatcaaaccgtatcactctgctgaaatgcgtttgtctttagttgagaactatccctgccttttacaatttgtctctcttagaggcatgctgctttgacctattcaccctcaattttttttttcttttttcttgagacggagtctcgctctgtcacccaggctggagtgcaatgatgtgatcttggctcactccaacctccgcctccagggttcaagtgattctcgtgtctcagcctcccagctactcgggaggctgagtcaggagaattcgcctggnaggtggaagttgcagtgagccgagatcgcagcactgcattccagcctnggcaacaagagcaaaactccgtgtc

SEQ ID NO: 170624 - DNA, 184 bp, Homo sapiens
ccacccccatcttattggtcctcccgggccgaggcctccctgcgattggtcggggaggtccgcgaaggccccgcccatctctccgcccccgtccccgtccgccggtactttggacggcggcgtggcgcccctcctcccctcccggtccccgccccctggagcaaatgctgccgagctgcggccg

SEQ ID NO: 170625 - DNA, 866 bp, Homo sapiens
ctcaagttgaagggcatcggccacagcagaacagttccccacggctgatgggcactcacaggcaggcaggagggagcggttccgcacgacttcccggccccctcagtgcccattttacatctgaggctggcagaccagaagggccacgggattttgagccccagcctgaggccgggaagagggagctggggcaaacagagagcccaaaggcgggtccgattttgaagagtcaatttcctttgaagaggcatcacccacccggaggtggcatcacctgcccaggaagtatcacctgtgcctagaggaggcatcacccgcctagaggaggtatcaccacccagaggaggcatcacccacctagaggaggtatcaccacccagaggaggcatcacccacccaggaggtggcatcacccgtgcccagaggaggcatcacgcacccagaggaggcatcacccgcccaggaggtggcatcacctgtgcccagaggaggcattgccgccagcccaggaggcatcacgcacccagaggaggcatcacccgcccaggaggtggcatcacctgtgccagaggaggcatcactaccagcccaagaggcatcaccacccacctaggaggcatcacccccgagaggaggcatcacctgtgcccaggaggcatcacccgcccagaggaggcgccccaagttggcagggtggtgggggctgggcctctcagtaaatggtccagagcttcccctggcagatcaactgtttcttggggacttaaagaagaattggggtactgggactcccacttagtgaccccggagcctgaggtggcccacggaggagtgcccaagccctcagcagccagaccagctccaca

SEQ ID NO: 170626 - DNA, 823 bp, Homo sapiens
ctcaagttgaagggcatcggccacagcagaacagttccccacggctgatgggcactcacaggcaggcaggagggagcggttccgcacgacttcccggccccctcagtgcccattttacatctgaggctggcagaccagaagggccacgggattttgagccccagcctgaggccgggaagagggagctggggcaaacagagagcccaaaggcgggtccgattttgaagagtcaatttcctttgaagaggcatcacccacccggaggtggcatcacctgcccaggaagtatcacctgtgcctagaggaggcatcacccgcctagaggaggtatcaccacccagaggaggcatcacccacctagaggaggtatcaccacccagaggaggcatcacccacccaggaggtggcatcacccgtgcccagaggaggcatcacgcacccagaggaggcatcacccgcccaggaggaggcatcacgcacccagaggaggcatcacccgcccaggaggtggcatcacctgtgccagaggaggcatcactaccagcccaagaggcatcaccacccacctaggaggcatcacccccgagaggaggcatcacctgtgcccaggaggcatcacccgcccagaggaggcgccccaagttggcagggtggtgggggctgggcctctcagtaaatggtccagagcttcccctggcagatcaactgtttcttggggacttaaagaagaattggggtactgggactcccacttagtgaccccggagcctgaggtggcccacggaggagtgcccaagccctcagcagccagaccagctccaca

SEQ ID NO: 170627 - DNA, 330 bp, Homo sapiens
agtgctcaatcctggtagtgaagccatttgggaacttgttcaccaggactccaatttgacagtgtgaatgaatgcatgaagagaaacatatcccaccagcctttgcccacatattttgtgttttgccttcagatggctttgaagtgacctacatttttcacatggcctccccatgagaaaggatgagtttctgagtacgtgaggaggctggctgtgtccctgtggaacacagcaaagctaactggtcctttggggggttaggccttacatgtagtcctcactgcacagaaccacagtcagctggaataacaacctggagaaagccagtca

SEQ ID NO: 170628 - DNA, 269 bp, Homo sapiens
atatctacaaaaaaacttgccgagcgcggcggctcacgcttgtaatcccagcacttttggaaggcagagaaaggcggctgcagagagagcgatgctcctgtgaggcgtcttccaccagctcctgaggctgcagcacagcgctccgcccgccctcatctccggggagaggctctttgaattttctcactaaacaaacattgattgcggccccaggagaaacgaagacggaaggagctgtgctggggagcaggggttttagggttgcgttt

SEQ ID NO: 170629 - DNA, 133 bp, Homo sapiens
gtggcatgcggtagggatctaactcccccttccaaaccgcccctccctgtatagtttgagtcgtttaggagatttcccttgcgttcttttcatctattatcacatcattatcacttgctgtggcttttatagg

SEQ ID NO: 170630 - DNA, 364 bp, Homo sapiens
gccaaactcacccttttataacagcactaatcccacccaagagggtggaaccctcatggcccaatcacctcttaaaagtcccacttcttaataccattacaatggcaattaaatttcaacatgagattttgagaggacaaaattcaaaccgtaacaacagtctttaagaatgggaaaggatagtgaagctgtactgaaactctagtcctttgtaaaaaaaaaaaaaaaaaaaaaaaaaatcccattaattcagtcattcatcaacactatatgccacacacttttctagataccaggtatatataaaaggaaaacacaaaaattctctgctttcatgggactgtttttgtaacatactgagtat

SEQ ID NO: 170631 - DNA, 341 bp, Homo sapiens
tagtctcctaccccaaagttttgccttttccagaatacattcatataccttcccatggtatccttgggggaaatttgttccaggggttctcctccaggatacaaaatcctcagatgctcaagtccctcaatacaatgagtttgtaacttatgcacatcttcctgtatattttaaatctctagattactttttttttttttttgagacggagtctcgctgcgtcgcccagggtggagtgcagtggcgcgatctcggctcactgcaagctctgcctcctgggttcacgccattctcctgcctcagcctccctagtaggtgggactacaggcacccgccaccac

SEQ ID NO: 170632 - DNA, 334 bp, Homo sapiens
aatcacatcaggtaaatggaggctctaaaagaacctctgaaagtggagaaaggcatcttactctgtggtgggggattactgagccacagaaactaccaggcatatgtcaggtgtgggtggcacagggagtgttcttaggaaaattcaacatatgaatctgcacatttgggagcatatgtaaatatatttcccatgagctaagtgcctcccttagcaatgagaggtccaaactcagtaagttgcctggggccaactttaccaatggagggaaaaggccggcagttggacaagcggtgtttccactgtttggcagggcaagaatgcatagactccc

SEQ ID NO: 170633 - DNA, 503 bp, Homo sapiens
aggacaggccaggaactcggtgtggtagggtcagctcactctgtactcaaagatctgtcctgggcaatgaagtatcccaggccaaacatccacaatgtgtaattaaagagcagacaggagttcatggggcaatggaggtgatggagaaacagggattgggggccaacttcattttttcctagggaaattccatataatatagacacgctgctgtatcagtgccacctgtcttcatcttctgcctgtctgctcccttctgtaggtctgggtcacccacttacagtcgtcacttattaaacatgtcactctagggcagaaccagaccaacccagggtctggccctggaagtctgatatggtttggctgtgttcccacccaaatctcatcttgaattcccaagtgttgtgggaggggccccgggggaggtaattaaaacacgggggcaggtctctcctgtgctgttcttgttgtgatcgtgaaggagtctcacgagatctgatggt

SEQ ID NO: 170634 - DNA, 420 bp, Homo sapiens
tcaagaagactagcccaagagtgctctgctttcaggattctgcttccaattgccagtgggaacgattgctggttgcaagtggggaggggtccatcgtcaacgccagagaatggcaaactccttttgccagggccagctagtacagattttaggttttttgggctctgcggtctctgtcacaactactcaacttggaattgttcctataaattttataaaattaatcagggaagaagggaaggggagaaatgaaaataaaccaagcttgcagcacatttggcattaatcatgaggtcagcctgctctctgtcctgcttcttcatatttgctgcctattcccccagaatcacacagaccctgttgtaagactatagtcccccttaattgtaccataggtaacatcttaagcattgtgagaca

SEQ ID NO: 170635 - DNA, 254 bp, Homo sapiens
acacacatacaggagccactgattacttttaaaaaggacaatttacgtggtatttttaactagctttcttaacctgtggtcagcatattccatggtatcaaatgagaggatctgttgagggaaagcacatcaaaactgaggtccaatcgagcagaattcactacttacctagatggcatgagcgcaatgttcaaagaaaataaaattctgaccatgatgaagaaggaaccctatataacaagctctcccaattc

SEQ ID NO: 170636 - DNA, 745 bp, Homo sapiens
aaactaattaaatgaatgaccaattcaccaaattatggaggatttttcttctttttaagttttggagttttgctacaactattttgtagcccctcccctgtcccacatcccactgggagcctgggataatctgcgtctgactgtcagttactgataagcaggacatcccacaaacagattttcagcgaattggctttcagcaaactgatcatttggcaaagtggtcattaggcaaatgggtcatttggcgaagaggtcatttagtaaatcggctttcaacgacttcccctatgagatttctctagagtgagcattttcttgggttaaatgtacacttcatttccataattaatactcactagcggctagatgggaacagacaattaaaaaccctctggtttcttaacaggagcggaggtgcagagggcatctgctctgcaaggcgcagtgatcaggctcagcattgtcacaggagctcttgcggttctgtttgttactagtgtgacatacacagcaattcaatggaaaaaggactgagtggtatttgagtctcccgtagttgatcatcatatgtcttgataacccatgacaactccttgccacatgccacgggaggtccagcactccaagagcccagcagccagggccggattcatgggcttgcaacctggacagtcccacagggacacagaagagtccccactgtggtttaataatctgccatcaccatcttgaaattctttat

SEQ ID NO: 170637 - DNA, 380 bp, Homo sapiens
cttaatactccaagcatttccactgggataagtgagtgtacaagagaaatatggttcctgtctcagaactttaaacaaaccattaaaaatacaaaaagggggccgggtatggtgactcacacctgtaaacccaggactttgggaggccaaggtgggtagatcccttgagctcaggagtttgagaccagcctgcccaacatggagaatctttgtctctacaaagcatacagaaggttaactgggtgtgatggcatagtcctgtagtcacagctacttgggaggctgaggtgggaggatcacttgagcctgggaggttgaagctgcagtaagccatgattgtgccactgcactccagcctgggtgacagagtgaaatcttgt

SEQ ID NO: 170638 - DNA, 492 bp, Homo sapiens
ccagggcttctaggcatcaggagcaaagacacgatgtggcaatcctggttgcatgggcaagagtgggagaggggaagtggagtgagcatgaagtggctgccgagggagcggcggtgctggggaaagcggctctaggccacatcgggaggatcctgagtgccaaggagcccctgaaggtcttcgggcaggaggagcctctcagacctccacctggggggagttctagggtacggtgcatgagattcatttaggaagctcttatcagcatccaggatcaggcccagcagctgcatgggggaccaggtggagagaggggtggactggcaggttccggcaactcccccaaatctgggattaagaaaaggctccgaaatgatcatatggttctcagcctgggtgaacagagaaggggtctaatttggtcttttgttcattttgttttgtcttgttaaatcttcagtgcttgaaacagtggtgagcccatcataaacc

SEQ ID NO: 170639 - DNA, 294 bp, Homo sapiens
gatgaggacagcaggtcacagtaggagccagggattggggatgaggacagcaggtcgcaggaggagccagggtttggggatgaggacagcaggtcgcaggaggagccagggattagggatgaggacagcaggtcacaggaggagccagggtttggggatgaggacagcaggtcgcagtaggagccagggtttggggatgaggacagcaggtggcaggaggagccagggattggggatgaggacagcatgtcgcaggaggagccagggtgggggtagagggacagcaggtcgcag

SEQ ID NO: 170640 - DNA, 718 bp, Homo sapiens
ccagcacagtcatttcatcccccgtgcattccccaaaagcaaaaccaaagctcagcatgtgcttctagaactttctatatctggtgttcaggggtgggtggggtgcaaacggccaggccagcacagtcatttcatcccccgtccgttccccaaaagcaaagccagagctcggcatgtgcttctagaattttacaatcttgaattacggcttcaaaataactcacattccactataaggaggctcagaggatgccaccgagtggacggacgtgagcaggaccacagagacaacccagtgggacacgcaacactgttcccaagatgttagcaggggaaagagtcggacgaaatggcgaagtgtttggcacaaagaagaccaacaaatgacacaccaagccagtaaagacacctccgtaagaaagacacattcctccccaaatctactttaggagctactgctgtcaactctgactttctggaagtctaactagtacaaggtccaatcctcaatcgcttatgaaacaaaatcagaaaagaaccgggtagaaccctagtactccgcattataaaaagcacttccggcgggcacggtggctcacgcctgtaatcccagcactttgggaggccgagggtggcagatcttttgaggttagaagttcgaaacagcctggcacatggtgaaaccctgtctctactaaaaaaaaaaaaaaaaaaaaaa

SEQ ID NO: 170641 - DNA, 734 bp, Homo sapiens
caccactgaggaggccaaatggagtttggtggaaaatctctaattcattcaaggtattatatgggcaagcaatggctgtggcacagggtcccctgattactttgtaagaatgggtgggagggatgctgattttcaatccttttgcagatcttctctcatagtaacacaatagaagatactttgccactatgttgtttgccaaactcactgtacctacttgactggtaacaaaagtcccaagagttacttgggagaagacacttgaaaaagtatttttctaaatatgggcaaggatgctgcccttccccaaactgttagtataccacctctctgaccaattttcccaaggaagatattggggtagggtgaggtgtaaagaaaaagtggtcatgtaaatactggtaataaaagctgttcagtggggtagagttgggttgcaactgtagccattctaaaaatgggctatcaatgtccttttagccaaaagactttagtatacatcctcctcattctaccctcaggatattggatctttgcccctgatgggtatccatcccctttgaaactttagaaaggcaggttatatacagaatgttcaactaaagacatttccttaagtcatactttcatgctttctaaactataatcacccttatcatcccctgctgttatgctttccctctgctccctgtggcctaatgttcctccaccaccttattaaccttcaggatact

SEQ ID NO: 170642 - DNA, 119 bp, Homo sapiens
ttagagggcttagatatcaagagatggacttgcttttagttctttttcccatcctgttccctccctaccaaaataaaattgaccagctaatccgacttaataacactaaagaattactt

SEQ ID NO: 170643 - DNA, 763 bp, Homo sapiens
acaccttaagccttaagatctcaattccaagcatctcataatctgaacaaccctttctatttctggatcaattcccctaatacctccattcttaatacttcttcccaaacagggaagataggctcagtggattagattgaccctatcttaggccactaagtggattagaccactgaacctaacacttttttttaaagcatgcatcaattacctttatatcttaatttctcaccactctaatccctgccttgcccctttctcactgtcagtactcacctgacaaaaccccaaacctgttaaatctaactctctgtctattccatacctcttaccaagtagctgaacaagactgaagaaaaacacaactattctggttgtttgcactttaaattcatgaccacaaacctcaaagtgggccctctgtgctgccaggcaatcacactgctcccctttacagcaaaaggctttgaaaaggagttgacttagttgctatctccatttcctcccctcccattctctctcgaagctactctgtctgatcaggctttcattctcatcactcttcttagtcccagcagcatttagcagagttgattagtccttcctgtttaacaggtttctttacaaggcttctaaaacaacatatggttgtatctttcttccacctcgctggtcattccactttactcttcttggtgcacctgcctcctgaccaaccccagggctcagttctcaggccctccctctctatcaatactcggtc

SEQ ID NO: 170644 - DNA, 418 bp, Homo sapiens
cttggtcagtgcgtgtcaaatgaataaacaacaagggactgatcttcagtacaaaacaccccttctgcaatgtctgcttgtcgatcacacatggtctcaggaattcttttttatttaatttaatttttggggaacaggtggtgtttggttacttgaataaggtatttagtggtgatttgtgagcttttggtgcacccatcaccttgtgtgagcagtatacactgaacccaatttgtagtcttttattcctcacccccttcctaccctttccccctgagtccccaaagttcactgtatccttcctatgcctgtgcatcctcatagcttagctcccacttatgagtgagaacatatgatattgggttttccattcctgggctcaggaattctaagtgatgtatgtgtgtttgtctgacca

SEQ ID NO: 170645 - DNA, 215 bp, Homo sapiens
attgctttactaaggggcaggtacattaacttggttattgaggcttgatgggatgtttacctggaatgttctcaaaagggtgtgggtgagaactcccatttctgctttggctgaatctcttcatgtctgcctgtgatgcctgggactgtggcaactgttttataatcatgaagcaacaagtttaaggatgaagtcaataggctgggaggattaat

SEQ ID NO: 170646 - DNA, 409 bp, Homo sapiens
agagccagggaagtatctgggaaatggcaggaagaaggagggcggagccttgggctgctcccaccgagcaggttgcaaagctgcttctgggacattcatcctttccagccaggactagctgagcagacctaaccccggggccagcagcaggcactacccatgacagccttgggccaggtgtgtggggacagaatggggtccctctgggcacaagatggggtgtatgctggggagggggcatttctggcacaaacaccaggatgagcccaggcaaagggtgtgcaatgttccagggtgtggtatcctgtggcagacccagaatctccctccaaggaccaccacaaggcaatggtctctgtctctgggccagggtcacggtgaaatgtcactgtgaagacctgtgcttgat

SEQ ID NO: 170647 - DNA, 1104 bp, Homo sapiens
ttccagggctgtgtgcaccatcaacaaggcaaagctcctaccctggtgagcctacatttacgtgaaggaaagggttaaaaaggcaactgagatgcttcctggtagtaaatttaacagtacagctgtgattaaaaactaagccggatcagaagatgggggtgagattcctttaggcaggttgggcaggagccacactgaggaggcagcatttgccttgagtgggcactgctggtttgaggaggtggagttctgtcacccccacagcaccccagggctgctcgaggcactgccccacctcagtctgtaaactttgggcagaagaagttcaagttttcgacatcgaactttcttgtaaaaaagaagaggcccaaagtttgaggcggtgggattccttatcttgtgttgactttcacgggtcatcttcaccccaggcggtttctgctgtgaactcacaaatgagtctttgtccagttctcacccaacaactggcgtctcctttttaaaagccagcttctcttccctgccaaggtgcatacagcagtttggggccacactttggctctttagatgggaccttgtatacagctgacacggcctgcccaggtgacactatgaggggctgaggcggctgccttttccctttcaaaagggcgttttgttcctgtggccttgtggaaaaggcagaaggctctgaggcatctgaaatttggagaaagtaagcagcgtttccgctctgactcctcggacgcttcccccacgtgaccttcccaggagccccgctgcctttttgcctcccgcggctgcctcctgccatctctgcggccagatgagccttgggattggcctcttgtgggagagtttcctggcatcctggggacttgaaaaggggctcttttaccttctctccttctgtatttgtagggtcttgggtttatttttcttgaactttccttgtgcctggtttgcatttttaccttgctggtcctcggccagtttaaaaaccctgctccaggtcttgtcgtgttgtggttctgcatcaggaagctgcatcctgcatcaggttagggacttggatttagaaacatttcagtatgagtctttgtt

SEQ ID NO: 170648 - DNA, 791 bp, Homo sapiens
ttccagggctgtgtgcaccatcaacaaggcaaagctcctaccctggtgagcctacatttacgtgaaggaaagggttaaaaaggcaactgagatgcttcctggtagtaaatttaacagtacagctgtgattaaaaactaagccggatcagaagatgggggtgagattcctttaggcaggttgggcaggagccacactgaggaggcagcatttgccttgagtgggcactgctggtttgaggaggtggagttctgtcacccccacagcaccccagggctgctcgaggcactgccccacctcagtctgtaaactttgggcagaagaagttcaagttttcgacatcgaactttcttgtaaaaaagaagaggcccaaagtttgaggcggtgggattccttatcttgtgttgactttcacgggtcatcttcaccccaggcggtttctgctgtgaactcacaaatgagtctttgtccagttctcacccaacaactggcgtctcctttttaaaagccagcttctcttccctgccaaggtgcatacagcagtttggggccacactttggctctttagatgggaccttgtatacagctgacacggcctgcccaggtgacactatgaggggctgaggcggctgccttttccctttcaaaagggcgttttgttcctgtggccttgtggaaaaggcagaaggctctgaggcatctgaaatttggagatcgttgcaagtcccagtggacgaagttgttgctgcacacgccgagaaaccacactgcacacgccgaatgtccaacctc

SEQ ID NO: 170649 - DNA, 198 bp, Homo sapiens
tgggaattgagtgcaacatttcgggtctcagcttagatgtcacttggctgggtagcctttcctatcttggcagttctgggtgacgtaccattttcctaagggatcttacagcaccaagacatcttgaatcagagctcttaacacctgtatctatagattagctgaacaaattcattaaggccgacagtgagccaggcc

SEQ ID NO: 170650 - DNA, 538 bp, Homo sapiens
gagaccgcaccattgcactccagcctgggcaacaagagcgaaactccgtctcaaaattaaacaacaacaacaaaaaaggacaatctatgatatgttgtaaaatcattcggacttttggattactgttattttgtttcagcagcagtgggacagagagaagctatgccatatccttcccttagactatgctcaaagatattatgttatactggcttttctgatgatatttactttttgtttttatagttgttgcattgatgttactcatttaggaaaggtgaaagagaaatccctatgagaagcacaatgttaaatcaagattcattttagttataaatatgacctggatatttggagatatcttgaaattctctgttttgggggtttgggttgtgggggattggcttgttttgtttgaagaaatctgtatgtgaaagagcttgtctgtaacttcacacatatgttgggcagaaaccgctgcaagttagtacagggatttttgatcgaagaataacacacggtttctttttccaagccc

SEQ ID NO: 170651 - DNA, 243 bp, Homo sapiens
gccaggctgccacattgcaaaatctctccagataagtgaagctctgtgctcactcagataggaaaacttcccctactgcacttgaaatattttatcctcaaggtcaatagtcctccttctttctggaaaagtgaacatggaccagaggcctctctgtccaggtcaaaacacaggttctaaaatgtcctcccaactggcaatctgtatccatatggactaaaggcaatgtcctggcctttaggt

SEQ ID NO: 170652 - DNA, 483 bp, Homo sapiens
caagtaagcatgaaaaatgtacacagaactgtaagacatgttactatgcatcaagagcattaatttgcacaattgtctataatcttatgtttattagcaacacactctcgtgtatccagataaattaggattaaacaatgtgatcctgacatattaacacctcagctaccctggaattagtcttacccacctaaaacaaaaccttctccctaaaagccctcacaagaagtcccttatataaaagctgctttcaatcaaacaaaatcactttgctcttagaggagaatccctctgattgatcactcaacttacttgctcttctttttaaggcagcatttgaaaaaaattatatctttttgtctattagcacacaaaaattggaaacagcaaatttaagaggtcagagatggccaggcacaggggcttacgcctgtaatcctagcactttgggaagctgaggtgggaggattacctgagctcaga

SEQ ID NO: 170653 - DNA, 484 bp, Homo sapiens
atctgcctgccttggcctcccaaagtgctgggattataggcatgagccaccatgcctagcctagaaccatttctatctgcagaaactacaggtaatatactcagagacctgagtaactgaaaatttagttaaataagatctttgcattcccaaggatgaaatgatctagtctgagtgaaatttttggtgatttgagcttgttataagtataagtcagggccagccttggtgggtcacgcctgtaatcccagcactttgggaggcggagatgggtggatcacttgaggtcaggagtttgagaccagcctgatcaacatggtgaaactctgattctactaaaaatacacaattagccgggcgtggtggtgcatgcctgtaatcccaggtactcaggaggctgaggcaggagaatcgcttaaacccgggaggtggaggttgcagtgagccgagatcgcgcgccattgcagtccagcctgggcaacaa

SEQ ID NO: 170654 - DNA, 453 bp, Homo sapiens
aggtgctcttttgttgtgattaggaaattcaggccaaatgtcttggaagtggcagtagaggtcagaattgagtgtttgtaaaagagcacttatctctaggtttttaagcttttcagcagaaaccatgatcaattcggagatagcatacagaaagattaaataacatatgctgaacctccttttgtcttcaaagccccagtttagcccagcctgaaaacagttgagttaccagtgacagtatggtaatcctgaccagcattcaataccagaagaacaaattattttaggttagacatgaggaacaccttcctgaccaaagggttgtaaaatattaagaacttttacagaacttcctcagtatgttttaaagggcaactaggcgtagattagatacggtttctttaagaattttgtgtgatatataatgcatgaagaatcaactgacagagtgag

SEQ ID NO: 170655 - DNA, 250 bp, Homo sapiens
ggaagagattgtattctggaagtcaatttgcagtcagttgtttggaagacggtttttcatataagtaatcatacctgtttgttaatggtctccagccataataaactgtatacctgagcactgtttaggagaaagaaaattccaaatggaaattcctactgtaactcctactgtggccgagaagggttgggtaagtgaaacttattgactagatgtctactgaagaagagatagtcattgttaaaaaaag

SEQ ID NO: 170656 - DNA, 334 bp, Homo sapiens
attttaaatctcttgttttagcctcttctacttgtagagctaccaatcctagaagtttactagcaactctgcattgttacattttaatttgcattttgttttgcatatatttaatttgcatttagttttgcatttagtttgattgttcatttgcgtctctcctttctgaactgcctgctgttctttgctcactttttctattttattattattaagactagtcacgtgtagtagtgagaaggagggaaagagtctattggagttttaatatcatgtatacagtggatattaagaatatcaacacttccttttttttttttttgaaacagagttt

SEQ ID NO: 170657 - DNA, 281 bp, Homo sapiens
gagcaaggccactctggagtggggacactatctcattccagtagcagccctgtcacagactcctgggctcccctgggacctggcagccaccggaggcgaggggtctttcaagacctctcagctggtagacaggcctagaagctggcctcacagaggcaggaatgcagggaccagggaaaacatcgttgggagagctggaaaagggacagctggatggtgtctagtgttttgaaaaatctttgatttattggtagtaaaatatgtacatgctcattgggaat

SEQ ID NO: 170658 - DNA, 114 bp, Homo sapiens
tgctgggattaacaggcatgatccaccatacctagcctgaatatatatttttaaacttttctgtggcaaaagatacgtgattaagtcatagatcaagaagggatatttgaaaca

SEQ ID NO: 170659 - DNA, 544 bp, Homo sapiens
ccaggaggtgggttcaggggccctgctaccctgctccagaaggggtttggtgagatccaggagggctccctgttggagggggcatttgaactggggccaaaagaggcatgagatttccacaggcagaggaggcagagggagaccacatgtctgaacctctgttatgtgtcaggccctgtgccaggctcttcttgggcctgtcacttgacagcccttaacacaagggctgaacgccccctctctccatcccgcaagggaggctgtgagctggtgctcctcctgttcctctcaggccctgtctggggctgggagcaggtggtggaggtgagacctgggctcatttgttgggcaagtttcactcagtttccaaccggggtgagcagattgcctgcgtctgctgctgtggtgccacggaatggatgccaagccactctggccgctaccctcccctgggaggctgggtccctgccaccatgccccagcagagagtgtctgggaaacccctgggctgccctggttggtgccacatggtggccacctggcg

SEQ ID NO: 170660 - DNA, 410 bp, Homo sapiens
tcctctcttctgtcccccagctctcatttccagggtgaatattttgaggaccaaatgagggaatgggtacaaaactctttgtaaactttatgtaagtgctgtttagatataaacttttatattctccctgcactcctctatcaaactccctctaacccatcccaggggcaggctatgagcaaagtctgccttaaaactctactgccctaaccctcaaaataaaagatatatacaggtgaatcagccagactagaagtaggagagcagttgaagagaaaatttttacttttcctctgcagaacagcagaagataacaactttacgaaaagttccttccaagtctgactattcataaagttaaaacaaacaaaattacaagaccagaaaagtcaaggtgcatctgatataac

SEQ ID NO: 170661 - DNA, 319 bp, Homo sapiens
cctcttcaatgctccttttattaatatgattttaaaacaagatactgtgatcattcacctggttttttgttcttatgaaggtgctttcttgtgtggagaactttcttttatgtttttttgtctgtttcaattttgtgttcctgagtgggggaagatctcttgagggttctatttggttatcttgatctgcctcctctccttgttattttctatgtaaaagatcatgccatctacaaatacagacagttttatttgttctttatactctgtatgccttttattatttcttgttcttgcctaattgctcagcctagaatct

SEQ ID NO: 170662 - DNA, 328 bp, Homo sapiens
atatttttttttccagtcactaaaggaaggctgtcatttagcatgctataataagtactaaataatatttgttagggattctttttatgttaatctacctcctttcgtggaccttatgttttaaagatgttagtttaataacacgtatttattaatttctacttgtcattttttattaagtacaactatatcttaacatacaataccagagcttctggtcagctgaaatgagcacacagtagtgtgctgtagtaatctactttattccaaagctaagaagctggtatttgaatcagtacattcattctgtcataagtaagtgtatggt

SEQ ID NO: 170663 - DNA, 598 bp, Homo sapiens
cactagaggattcgtatgagtggcaatgtgactgagaggaataagcactacagtgggaatcaagaagcttggactgtggtactgttttatgcaatttagctacatgtccttgactctacacttatgaagagatgagcctagatcacttgtagccttccaaatttttttgaccatgatccattgaaaaatatattttacattacaactcagaaaacatctaacacacacacacacaccccatttccccaggtaatacttatccttatggagtgtgaaacactctattttctgtttttttcttgtctttctaaaatgctggttatatcttaccaattaatttcatgacccatcaatgagatgtgacttcagtttgaaaaaagtatccaagatgatctctgcataaatttctggttcccaaattccatatatgtaaagatctgatgctatttcatgccatagtgtttttccttctttgttttctttaatcgggaggagttcggggcagtaacgcattttgtaaatttaggagtgttaaggaatgacaacttccataatgaagccattgcctcacatgccactcacccaagaattctcatct

SEQ ID NO: 170664 - DNA, 144 bp, Homo sapiens
aggtagcttcctagaggaataatgtattcaatggataagctgttaccttacccttaaaatcgttttctaaattcttttttgactcttagatttgtaatataactcatctccccttttgtctcactttgcctttctctttaaccg

SEQ ID NO: 170665 - DNA, 1245 bp, Homo sapiens
ggtgagacaatgtggctatcaccatcaaagacactgggacaaacacagttgtgtgatacccagaggctcttcagaacaaaggcttaattttatcattcatttatatcactcaaattattttctcataactttatttttggcctgcaacaaaaatctctcaattcctcttcagatctttccttaaagtggaactaagtagaacacatgtgactcagattttaattattgcttatcttatttggatatgttttatcctcattaaaatgtaattattatagaaatgacagccccattgccaggaaaattgggagtgttatatgctctgttcagcttttggtaaaattttaattctatcaggtcaaattattattgtgttatttgtctacttttgttgcaacaggaatggaaggcattccacagattggtcaatttgtttgccttttgttgtgtgtctctccataaatctcaatgacaaatgtctttttaatttatctatttatctgtgttattttttgtctattaaccaaacttgatgtatttttcttctaaaggggttcagaacacgtcacccccaaatttattgttttgcatattgattattttgagctggagacacttgagaatcagcagatacagaaaatacgctttgaacaccttttatctaaaagcaggccataaaatttcccgtgaaaaagatgcccttcttgtaccaggaagagaagaccatctttatcactggagacttggagttgacaccaaaatcaatcgtacaaacaaatctattataatagtccttatcttccactagtctctcccatatatttcctagtcactgtcccacatttactgcctttggcccaagcctctttgttgtcacatcctcacaatttattgttgtttgtttaaaaagatatataactattgaggcctaataacttcttcaggtcttaattttccttatgaagactcccgtgtacatatgaaaaaaattaaacttgtatgtttttctcttacaaaaaaaaaactaaccagcacacacaacaaaatttttggcgcgccttcgccctcggaaaaagtttctcaaaaccaatccgttgggccggggccccatggttagtgacatggcactaaggtggcccaagagaacccgggcgtaccacggttgggttcccccataaaaacccgggcaccgcgtttgacacccacgtggcttcgggctccggtctagccacggcccggccttaa

SEQ ID NO: 170666 - DNA, 381 bp, Homo sapiens
gagaattaccgaaacataacacagaaacatgaagtgagcatatgctcttggaaaaatggatccaatagacttgctcatcacagagttgccacaatacttaattcattaaaaaaaagtgctaggtgtggtggctcacaactgtaatcccagtaccttgggaggctgaggcagaaggatcgcttgagctctggagtttgagaccagcccgggtaacataggttctgtttgtacaagaaaacaaaatagccaggtgtggtggtgtgcacctgtggtctcgagaggctgaagcaggagaattgcttgagcctgggaaattgaggctgcagtggaccatgactgcactgctgcacaccagactctgtgacagaacaataccttgcc

SEQ ID NO: 170667 - DNA, 252 bp, Homo sapiens
aactgggtaatttattcatctattcattagcaaatctctcctgtgtttagcactaagaacacaaagatagattttgcagtatggtttctgcccccaaggaaatcaaaggggtagataatatgtaagctaatacaaggtcagaaatgtaatgtgaggcatctataagtactatggttgtgaaggaaggagtaatgaatgtgttcagtcaaggaaaacattagtaaagaagctatatatatataacaaaaacaa

SEQ ID NO: 170668 - DNA, 396 bp, Homo sapiens
cattgttcaccatggtcctagcttgattttcttggggtgtgattattctttcttttctctctttctctctctctctttctttctttttctttctttcgagatggagtcttgctctgtcacctaggctggagtgcagtggcacaatctcggctcactgcatcctttgcctcttgggttcaagcgattctcctgcctcagcctcccgagtagctgggattacagatgccagccatcatgcccagctaattttgtatttttgtagaaatggggtttcaccgtgttggccaggctggtcttgaactcccaacctcaggtgatctgcctgccttggcctcccaaagtgctgggattacaggtgtgaaacaccacacccgccccccgccatgcctttttctt

SEQ ID NO: 170669 - DNA, 892 bp, Homo sapiens
gccgcccaggtccccccgggcgtcgatgaatgtggggtaccattccttgatgatgtggtcatgtttgtagtcggccttattgtcctttagatgttccacggtgttccgctcgctcttctcataggcctcccggggcttccggacagacaccttgcattctcggaccttgttgacgatgaattcttggatgagaaacctgatatcttccatgaggcagtcatcataaagaagtctgaatatcttggttgagagctagacttggaaacagagagaccctgtataataacagactaagaagtaaggaagacaagcccagccagtcccacaactatttcattaataccaggtaaagcaacagacctgccagtgaagcatcttggatcctttagctttagtaatgttcttgtagtaatttcggaagtcaatactttccttaagaatactaaagttttcttttgggaaaagagaaaaactgaggagaggaaacaaactgtcttataccttcttccatggtctttggatgaaggttaagttatgggccccaaaagtgggctagcctcatttggactaatactccatcctaagcagtatggtttcgaactaagttgcctgagactttctgtgcctccatttgtcacatggtataataatacctagttcattggaattgtcgtgagaatgacataagtgaaagtatgtatatttccatgttctataataaacctggttttctaacaaatttaccaagcaaccaataaaccaagttacttggcacatcgaagttactttattccaagttaataattatccgggaatttacccaaatccacaatttgccacactccttagtacattaaacgaaaacatcttattttaccggatcaccactctc

SEQ ID NO: 170670 - DNA, 687 bp, Homo sapiens
gccgcccaggtccccccgggcgtcgatgaatgtggggtaccattccttgatgatgtggtcatgtttgtagtcggccttattgtcctttagatgttccacggtgttccgctcgctcttctcataggcctcccggggcttccggacagacaccttgcattctcggaccttgttgacgatgaattcttggatgagaaacctgatatcttccatgaggcagtcatcataaagaagtctgaatatcttggttgagagctagacttggaaacagagagaccctgtataataacagactaagaagtaaggaagacaagcccagccagtcccacaactatttcattaataccaggtaaagcaacagacctgccagtgaagcatcttggatcctttagctttaggaaatctactccagtcctgtcctgtggaaactaatgggagtgccaggaggcctaaccatctgaggtgaattgaaaagaaaaagcagcgtgctgattgcagtgactggtgcatggatctcgatggctactctgtactgtaggcagtgatgacaccctgttgaggagattggtaggagccatagcaacacaggaggcacaattttagggatggtttacattcctagctggagtttccacaaagcccaggtgcttgcatagagccttacccttgcctataaacaactacatggtt

SEQ ID NO: 170671 - DNA, 487 bp, Homo sapiens
taaaattaagtctgttccacagccagagatcactcccatatcccatataactactccacaacttgagcctttactaacaaagaaatccaaagaacaaggtaaatgcttcagtggaaattatcagcacagaaaaatcctaagccacatattcagttattgctcaaacaacctcctacaaaataaggaggggagtcaggctaaacaacaacaggctaaagaaattttaattgaaatgtcactttcactattaaacaaaaaagccatcactgtgattgtgataaaagttgatggtgtcctgtttctttgtgtgaaattgcttttctctcatcactgacttaatttgattgcaccagtttgtcagctgtcacatttggcttccctcagttgcaaaatatagataatgacagtctaagcaatttaacagttatgtgtcaacattttacttcttctaatcaagataaactaagaattatcccccccaccccat

SEQ ID NO: 170672 - DNA, 553 bp, Homo sapiens
agtcctatctgcagcacctcagaatgtgaccttatctggaaatagggtctttgcagctataattagttacattaagatgggctcataccaaagtagtgtgggtccttaatccattatgactgatgtccttacaagaagagggtaagaccaggcgtggtggctcatgcttgtaattccagtactttgggaggccagggcaggtggatcacctgaggtgaggagttcaagaccagcctgaccaacatggcaaaagcctgtctctactaaaaatacaaaaaattatccaggcatggtggcatgcacctgtagtgccagcttcttgggaggcagaggttgcattgagccaagatcatgccactgcactccagcctgggcaccagaggaagactctgtctcaaataactaaataggagaagagacagagacaccgagggaagaggccagtgatgacagatgcaaaggttgcagtgacgcatctacgagcaaaggaactccaggactgctggcagccaccaagagccaggaaaaagcaaagcacgatgctctcctaagt

SEQ ID NO: 170673 - DNA, 2082 bp, Homo sapiens
agcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgttaagctggacccgccctctgacttgcagagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccagacttggatgggggcccacagggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcacca

SEQ ID NO: 170674 - DNA, 2178 bp, Homo sapiens
agcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaagtaactgctgcaagaacggacagacactgctgcagagaacttgccacggtgtttcatgctgtggctggtggttccaggctgcacgctccattctaggaaaggggccctcagcccagtcccttgcaggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccagacttggatgggggcccacagggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcacca

SEQ ID NO: 170675 - DNA, 2261 bp, Homo sapiens
agcagctctgtaatgcgcttgtggtttcagatgtgggcggcctgtgtgaacctgtcgtgcaaagctcacgtcaccaactgctgcagttatctcctgaatcaggctgagggtctttgctgtgcacccagagatagttgggtgacaaatcacctccaggttggggatgcctcagacttgtgatgggactgggcagatgcatctgggaaggtcctggtggtgactccaaccctgccctcacatatcccaagagcaggctgactgccttccccattcccacctttccagtaactgctgcaagaacggacagacactgctgcagagaacttgccacggtgtttcatgctgtggctggtggttccaggctgcacgctccattctaggaaagggctggaccttggagagtgaggccctgaggcgagacatgggcacctggctcctggcctgcatctgcatctgcacctgtgtctgcttgggagtctctgtcacaggggaaggacaagggccaaggtctagaaccttcacctgcctcaccaacaacattctcaggatcgattgccactggtctgccccagagctgggacagggctccagcccctggctcctcttcaccagcaaccaggctcctggcggcacacataagtgcatcttgcggggcagtgagtgcaccgtcgtgctgccacctgaggcagtgctcgtgccatctgacaatttcaccatcactttccaccactgcatgtctgggagggagcaggtcagcctggtggacccggagtacctgccccggagacacgttaagctggacccgccctctgacttgcagagcaacatcagttctggccactgcatcctgacctggagcatcagtcctgccttggagccaatgaccacacttctcagctatgagctggccttcaagaagcaggaagaggcctgggagcaggcccagcacagggatcacattgtcggggtgacctggcttatacttgaagcctttgagctggaccctggctttatccatgaggccaggctgcgtgtccagatggccacactggaggatgatgtggtagaggaggagcgttatacaggccagtggagtgagtggagccagcctgtgtgcttccaggctccccagagacaaggccctctgatcccaccctgggggtggccaggcaacacccttgttgctgtgtccatctttctcctgctgactggcccgacctacctcctgttcaagctgtcgcccagggtgaagagaatcttctaccagaacgtgccctctccagcgatgttcttccagcccctctacagtgtacacaatgggaacttccagacttggatgggggcccacagggccggtgtgctgttgagccaggactgtgctggcaccccacagggagccttggagccctgcgtccaggaggccactgcactgctcacttgtggcccagcgcgtccttggaaatctgtggccctggaggaggaacaggagggccctgggaccaggctcccggggaacctgagctcagaggatgtgctgccagcagggtgtacggagtggagggtacagacgcttgcctatctgccacaggaggactgggcccccacgtccctgactaggccggctcccccagactcagagggcagcaggagcagcagcagcagcagcagcagcagcaacaacaacaactactgtgccttgggctgctatgggggatggcacctctcagccctcccaggaaacacacagagctctgggcccatcccagccctggcctgtggcctttcttgtgaccatcagggcctggagacccagcaaggagttgcctgggtgctggctggtcactgccagaggcctgggctgcatgaggacctccagggcatgttgctcccttctgtcctcagcaaggctcggtcctggacattctaggtccctgactcgccagatgcatcatgtccattttgggaaaatggactgaagtttctggagcccttgtctgagactgaacctcctgagaaggggcccctagcagcggtcagaggtcctgtctggatggaggctggaggctcccccctcaacccctctgctcagtgcctgtggggagcagcctctaccctcagcatcctggccacaagttcttccttccattgtcccttttctttatccctgacctctctgagaagtggggtgtggtctctcagctgttctgccctcatacccttaaagggccagcctgggcccagtggacacaggtaaggcacca

SEQ ID NO: 170676 - DNA, 321 bp, Homo sapiens
agatgggcaatggggatcaagtgaggtaagaggcacctggcaccctacaacgtgcagtatggccaccttctgttgtttgtgtaggtctcctgttgacccacaccttgggttccaaacccccatcggggaaacattcatgggatccttcgagagtcattgctagctctgtgtcaggtactgtgtgccattggtgctgggatggctgctgcagatcgatttcgttcacgatgtggaatcgtttgttagccccacagcctttactgtcagcattctctttctgagctgcttttttttttttttatgattttaataattttttca

SEQ ID NO: 170677 - DNA, 492 bp, Homo sapiens
gatctcggctcactgcaacctccacctcctgggttcaagtgattcttctgcctcagcctcccgagtagctgggactacaggcgcgtgccaccacgcctggctaattttttgtatttttagtagagacagggtttcaccatgttggccaggatggtctcgatgtcctgaccttgtaatctgcctgcctcggcctcccaaagtgttgggattacaggcatgagccactgcacccagccagatcattgtatttttaaaggtggatggtagatacttcagtgttcgttatattattatttaatgtgttcttgatacctaaaatattacataataaaagagacagagtgaatgagagtttttgaaaggtttaatgtaacaaatttttatacttcttttttaccagtttttaaaaaattttatttttaatttttgtgggtatataggtgtacattttatggggtatgtgagatactttgatgcaggcatacaatacat

SEQ ID NO: 170678 - DNA, 490 bp, Homo sapiens
ctgtcacccaagctggagtacagtggcaggatctctgctcactgcaacctccgcctcctgggttcaagcaattctcctgcctcagcctcccaagtagctgggattacaggtgtctgccaccacgcctggctaatttttgtatttttagtagagacggggtttcaccatgttggccaggctggtcttgaactcctgacttcaaatgatccacctgcctcggccttgcacatactgcttgcacatactgttccctctgcctagaacactcttctctccctttttctagcttattctctcttcatctttggctcaagtatctcatcctcagggatgtctccctctcctgctcccccagactgagctggtctcccttcaccttcccagaatcctggcttcgtccccagggccccaggcacttagacatcgggtgtggagggggttcaatggtggccccaaagagatgtgtccatgttctaatccctgaacctgt

SEQ ID NO: 170679 - DNA, 330 bp, Homo sapiens
tttgacccaatccccacccacattggccccagctctgtttcctgtctctgtgcacctgggcaccttgccccatttttctagctaaaactaacttgaaaccctcaccaggattggcaggtgcccctagggcaaacacgcagcatgaagagggaggggtctctggcctgtttgaaatttgtttcctttttgattttggcctctggagaatttccctttcttgttttccgtaagtgtatgcctttgaaaataatactgtaatactttattttgcatttaggaaaaattggaggagccctccaatcatttagtccattggagacaataagctct

SEQ ID NO: 170680 - DNA, 1352 bp, Homo sapiens
  misc_feature (1039)..(1039): n is a, c, g, or t
cactgggagctgcaagatcctcgtccgagaaacggggatgcaggccccgggccgtgcagacagggccgtcagaggtgatggtgtgcatctttagcaggtggcacaactggcgctgggaactgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcaaaaaaaaaaaaaaaaaaaaaaaaaaaaaaaaaaaaaaaaaaaaaaaaaaaanaaaaaaaaaaaaaaaaaaataaaggcggcctaatttctagcttcctgggccaatccgccctatagggagtggactttacaattagacgggcggttgtaaaacaacggggggattggaaaaacctgtcgggaacccaaataaattggctggcgttcctctttgggcggcgggtttactatgggaggggtcccgaatcggccggccctttccaacaaggtgcccccccttgaatggcggaatcgcaaatggcaagcgctaaatgtgtttgtcaacaacttccgcgttaattgtttggttcgcggtttttttcttt

SEQ ID NO: 170681 - DNA, 297 bp, Homo sapiens
cccgatagcccgacagccccgactagcccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtcgggctagtcggggagctgtcgggctagtcgggg

SEQ ID NO: 170682 - DNA, 478 bp, Homo sapiens
tcagtttcccctctgtaaagtgggactgtccaaggaggtccctcgctggccccccgtgcagggagggcttcaggctgcggcaggtaggtagggggctggcaggcacccacttgccgttggcccccactgtctcctttgcttgcagagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170683 - DNA, 386 bp, Homo sapiens
ttgttgtctcagaccccttctttccttcaaagcacttatcacaatttgtaactgctttatttctttgttttcttcttagctgtctccccaattctctttgtataatttctatgaagagataagctggaaacatctctccttggcccttttcttttgcaggtcctgccagacctccttcctgacctctgaggcaggagaggaataaagacggtccgccctggcagtgatgtctcgtctctcttccctcctttttagctgaggcaggtggcagggtagaaggcatggtgtaggatctgggacctcaaaagtcaaggcctggacctgagcagatctgcaataatgtcagactcttggggtgaaaagggggatccagcattctggaggtc

SEQ ID NO: 170684 - DNA, 3036 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170685 - DNA, 3401 bp, Homo sapiens
  misc_feature (3088)..(3088): n is a, c, g, or t
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcaaaaaaaaaaaaaaaaaaaaaaaaaaaaaaaaaaaaaaaaaaaaaaaaaaaanaaaaaaaaaaaaaaaaaaataaaggcggcctaatttctagcttcctgggccaatccgccctatagggagtggactttacaattagacgggcggttgtaaaacaacggggggattggaaaaacctgtcgggaacccaaataaattggctggcgttcctctttgggcggcgggtttactatgggaggggtcccgaatcggccggccctttccaacaaggtgcccccccttgaatggcggaatcgcaaatggcaagcgctaaatgtgtttgtcaacaacttccgcgttaattgtttggttcgcggtttttttcttt

SEQ ID NO: 170686 - DNA, 3113 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggaggtgaggcccgggccccagcccggctgggggccccgcagcacccgcagccctgaccgccctcccctgcgttgccgcagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170687 - DNA, 3085 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatccttgatggcgagggagcccctgagtccagcccacccctgctgccaccctagatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170688 - DNA, 2570 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaaggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170689 - DNA, 2042 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagcccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170690 - DNA, 2743 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtcgggctagtcggggagctgtcgggctagtcgggg

SEQ ID NO: 170691 - DNA, 2626 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagcatgcattctgcggggtctctgcatctagtagggccgatctctgcgctcctgacggtgctcgcctttatccatttttccaggtcctccccgtatgccgccccggaatggcgggggggggcaaattcaccagcaggggctaggaatttggaaaatatactgtaattcagacactcagcttctgatctgagtatagggtgaattgatggaggggcatagctagtgagacagagctcgcctcctacaaggaggagaatgttgcaaaccgttttccccttcccaacctgggactatatgatttctta

SEQ ID NO: 170692 - DNA, 2094 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctgtgagtcctgggatggagtgtccgtgggtggtgaaggcagctgggagtgggggctggggctcccctcggttca

SEQ ID NO: 170693 - DNA, 1160 bp, Homo sapiens
cactgggagctgcaagatcctcgtccgagaaacggggatgcaggccccgggccgtgcagacagggccgtcagaggtgatggtgtgcatctttagcaggtggcacaactggcgctgggaactgggggtcccttccctcaggagtccttatggaggcagaccctcacccagtgagggcacggagcccccgggggccctggagggaggagcgaccgcaggctctctgggccccgtgactgctgtgactcaggttcctttgcaggtgtgcacagcagggacgccctgactctcgccctctccctggcaggaggtggtccaggccacgctggtggtcctggccttggccatggtgcccatcctgctgcttggcacacccctgcacctgctgcaccgccaccgccgccgcctgcggaggaggcccgctgaccgacaggtgggaccggggcctaaggtgtggggggctgcttgcggggagaggccactgtccggtgtgtccctgactcctcgcttcctgacagactcctgagtggccaggagcaggcctggcgggtggtgggggacctcctggggctggagtgctgccaacactgcctgctcatgccccaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170694 - DNA, 595 bp, Homo sapiens
actctagagtatccctcccacagtccgacagatatcgatcattcgatcttactagatttcacagagcatgtactttattgttatttactgtcactaccttcccgggtcgtgacgtggcaaacctcttgtggagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170695 - DNA, 349 bp, Homo sapiens
attccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtgatgtctcgtctctcttccctcctttttagctgaggcaggtggcagggtagaaggcatggtgtaggatctgggacctcaaaagtcaaggcctggacctgagcagatctgcaataatgtcagactcttggggtgaaaaggggcagaaaagggccaaggagagatgtttccagcacattctaacttggagtgagcaaatg

SEQ ID NO: 170696 - DNA, 2697 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170697 - DNA, 960 bp, Homo sapiens
  misc_feature (647)..(647): n is a, c, g, or t
actctagagtatccctcccacagtccgacagatatcgatcattcgatcttactagatttcacagagcatgtactttattgttatttactgtcactaccttcccgggtcgtgacgtggcaaacctcttgtggagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcaaaaaaaaaaaaaaaaaaaaaaaaaaaaaaaaaaaaaaaaaaaaaaaaaaaanaaaaaaaaaaaaaaaaaaataaaggcggcctaatttctagcttcctgggccaatccgccctatagggagtggactttacaattagacgggcggttgtaaaacaacggggggattggaaaaacctgtcgggaacccaaataaattggctggcgttcctctttgggcggcgggtttactatgggaggggtcccgaatcggccggccctttccaacaaggtgcccccccttgaatggcggaatcgcaaatggcaagcgctaaatgtgtttgtcaacaacttccgcgttaattgtttggttcgcggtttttttcttt

SEQ ID NO: 170698 - DNA, 2663 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaactttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170699 - DNA, 1965 bp, Homo sapiens
cagagtcagctgagcctgctctgcagggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggca

SEQ ID NO: 170700 - DNA, 2484 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacctgaactgtgacgcacgcgcgctgcggggagccgtgaccgcagagaaaaaggccggttgtgac

SEQ ID NO: 170701 - DNA, 2916 bp, Homo sapiens
gcctgcccggaaaggagtgagcggcgcctagtcccgggctggcgggagtgcagttctgagtcccgcccggcgtgcgcggagcggggcagccagcagcggaggcgcggcgcgcagcacacccggggaccatgggctccatgttccggagcgaggaggtggccctggtccagctctttctgcccacagcggctgcctacacctgcgtgagtcggctgggcgagctgggcctcgtggagttcagagacctcaacgcctcggtgagcgccttccagagacgctttgtggttgatgttcggcgctgtgaggagctggagaagaccttcaccttcctgcaggaggaggtgcggcgggctgggctggtcctgcccccgccaaaggggaggctgccggcacccccaccccgggacctgctgcgcatccaggaggagacggagcgcctggcccaggagctgcgggatgtgcggggcaaccagcaggccctgcgggcccagctgcaccagctgcagctccacgccgccgtgctacgccagggccatgaacctcagctggcagccgcccacacagatggggcctcagagaggacgcccctgctccaggcccccggggggccgcaccaggacctgagggtcaagtgagtgagggatgacctcatgccctttctggccagcccagaacccctggccagtcgctgggctgggccaggctgagctccgactccttgtccagtgctctccccaggctggccccgcctcctccttcaggcccggaacttcccacagtcccaagccctagccctagggggttctcctcttctggtcctgcccgggaggcctcctgccttcccctgtgggcagggccagtgtgcccaattgcccgattgcccgtgctgggcagggtcctgcccggggggcctggtgggggaggcagggcaggaggttggagcagccctgcccagccccgtggccgccagctttgtggcaggtgccgtggagccccacaaggcccctgccctagagcgcctgctctggagggcctgccgcggcttcctcattgccagcttcagggagctggagcagccgctggagcaccccgtgacgggcgagccagccacgtggatgaccttcctcatctcctactggggtgagcagatcggacagaagatccgcaagatcacggactgcttccactgccacgtcttcccgtttctgcagcaggaggaggcccgcctcggggccctgcagcagctgcaacagcagagccaggagctgcaggaggtcctcggggagacagagcggttcctgagccaggtgctaggccgggtgctgcagctgctgccgccagggcaggtgcaggtccacaagatgaaggccgtgtacctggccctgaaccagtgcagcgtgagcaccacgcacaagtgcctcattgccgaggcctggtgctctgtgcgagacctgcccgccctgcaggaggccctgcgggacagctcgatggaggagggagtgagtgccgtggctcaccgcatcccctgccgggacatgccccccacactcatccgcaccaaccgcttcacggccagcttccagggcatcgtggatgcctacggcgtgggccgctaccaggaggtcaaccccgctccctacaccatcatcaccttccccttcctgtttgctgtgatgttcggggatgtgggccacgggctgctcatgttcctcttcgccctggccatggtccttgcggagaaccgaccggctgtgaaggccgcgcagaacgagatctggcagactttcttcaggggccgctacctgctcctgcttatgggcctgttctccatctacaccggcttcatctacaacgagtgcttcagtcgcgccaccagcatcttcccctcgggctggagtgtggccgccatggccaaccagtctggctggagtgatgcattcctggcccagcacacgatgcttaccctggatcccaacgtcaccggtgtcttcctgggaccctacccctttggcatcgatcctatttggagcctggctgccaaccacttgagcttcctcaactccttcaagatgaagatgtccgtcatcctgggcgtcgtgcacatggcctttggggtggtcctcggagtcttcaaccacgtgcactttggccagaggcaccggctgctgctggagacgctgccggagctcaccttcctgctgggactcttcggttacctcgtgttcctagtcatctacaagtggctgtgtgtctgggctgccagggccgcctcggcccccagcatcctcatccacttcatcaacatgttcctcttctcccacagccccagcaacaggctgctctacccccggcaggaggtggtccaggccacgctggtggtcctggccttggccatggtgcccatcctgctgcttggcacacccctgcacctgctgcaccgccaccgccgccgcctgcggaggaggcccgctgaccgacaggtgggaccggggcctaaggtgtggggggctgcttgcggggagaggccactgtccggtgtgtccctgactcctcgcttcctgacagactcctgagtggccaggagcaggcctggcgggtggtgggggacctcctggggctggagtgctgccaacactgcctgctcatgccccaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccatgctgtccgaggttctgtcgggctagtacggggggggat

SEQ ID NO: 170702 - DNA, 1295 bp, Homo sapiens
  misc_feature (982)..(982): n is a, c, g, or t
cccgaagaagccaccaggaagaggaagacacccactgcgatgatgaccactggcaacagagagccagtggtagccccctggattatggtctgactcaggacaagctgtgccccgacacccacggcaatcagtcccactgcacaggcgcaaaaggccagcaggaggacgtagagcaagaacttcacacatttcattcctccttccaccgccatggctgtcgggctagtcggggccgactagcccgacaggaggtggtccaggccacgctggtggtcctggccttggccatggtgcccatcctgctgcttggcacacccctgcacctgctgcaccgccaccgccgccgcctgcggaggaggcccgctgaccgacaggaggaaaacaaggccgggttgctggacctgcctgacgcatctgtgaatggctggagctccgatgaggaaaaggcagggggcctggatgatgaagaggaggccgagctcgtcccctccgaggtgctcatgcaccaggccatccacaccatcgagttctgcctgggctgcgtctccaacaccgcctcctacctgcgcctgtgggccctgagcctggcccacgcccagctgtccgaggttctgtgggccatggtgatgcgcataggcctgggcctgggccgggaggtgggcgtggcggctgtggtgctggtccccatctttgccgcctttgccgtgatgaccgtggctatcctgctggtgatggagggactctcagccttcctgcacgccctgcggctgcactgggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcaaaaaaaaaaaaaaaaaaaaaaaaaaaaaaaaaaaaaaaaaaaaaaaaaaaanaaaaaaaaaaaaaaaaaaataaaggcggcctaatttctagcttcctgggccaatccgccctatagggagtggactttacaattagacgggcggttgtaaaacaacggggggattggaaaaacctgtcgggaacccaaataaattggctggcgttcctctttgggcggcgggtttactatgggaggggtcccgaatcggccggccctttccaacaaggtgcccccccttgaatggcggaatcgcaaatggcaagcgctaaatgtgtttgtcaacaacttccgcgttaattgtttggttcgcggtttttttcttt

SEQ ID NO: 170703 - DNA, 369 bp, Homo sapiens
gaggtgggcgtggcggctgtggtgctggtccccatctttgccgcctttgccgtgatgaccgtggctatcctgctggtgatggagggactctcagccttcctgcacgccctgcggctgcactggtgagcgaccacccactggcctgggctgctcaaggcgtgagttcccctcaccaacccctctgcttctcacccccagggtggaattccagaacaagttctactcaggcacgggctacaagctgagtcccttcaccttcgctgccacagatgactagggcccactgcaggtcctgccagacctccttcctgacctctgaggcaggagaggaataaagacggtccgccctggcagtgatgtctcgtctct

SEQ ID NO: 170704 - DNA, 406 bp, Homo sapiens
cttcatttcctttaatctaaaacatgcttctactttctttgatctttcatgacattggcattttttaagagtcaaagatagttgtcttgtaaattgtcccacaatccggatttgtctgtttcctcatgacgaaattcaagttaagcatttttgggaaaaatactgcataggtgatgtatccttcctgcctcgtaactgcagatggcctgtaatactaagtttgatcacttgaccaaggtgaacttccagatctctccattgtaattattttgctgggtacagtggctcccacttgtaatcccagcactttggaaggctgaggtgggaggattgcttgagcccaggagttctacaccagcctgagcaacatggggaaaccctgtcactactgaaaatacaaaagtac

SEQ ID NO: 170705 - DNA, 417 bp, Homo sapiens
ttttaggaaagcaggttaatacttgcaccagatcctgttcacaggtatactgacagccccatcaacctctggaaggggaagaaagctccactgaagtaaaaataaaatcctagccaatttccataacagaaaaccaaatttgcctcagttgcaaatattttgttaccagggaaaagattcattttagacaccagataaggaagaagcactgatcaaagttcataatggttagaacagctgatatctgagagaaataggtctctatattatctaaattttattacaatactaagcagatctccagaaataaacagtaatgtttagttctttggagaaatacaatctctaaattatattcaatcatagcttttatctaacgtgaataaaaggaactattaaaaatccttaaaggcgggg

SEQ ID NO: 170706 - DNA, 394 bp, Homo sapiens
aatggaagcaattctcagaattaaaaatagatctagttaagtgtggttattactggggaatgaagctctgggagacttactgttttgagttattaccataaacatatactacttttatttattatcaaatttcttgatgtgtagttaacaaatgataaacctcaaatatttaaaatgtgcaatttgataagctttgacagaaatacacacatttaaagccatcaccacagttgaggtaaacatatccatcctcccaaaaaaagacacatttaagcttctcagtctgaatagtctgtgtttagtaacttatgtatagactttgtcttttagctatatcatcacttaattcagataccttttaatgacttcaaagattattttaatgataatacag

SEQ ID NO: 170707 - DNA, 382 bp, Homo sapiens
ctgctaacagtattttttaaaacatctctgtagtatctttatacttattacaagggataatacatatattgggtcatttgatcctctggataattctttgaagcaattaggaaaccaatcgttatctccatttacaattagaaaaaactgattgagactcaactgagaccagttttagaattcttagaattcttatctgtaagtatattagtatagggactctactcattctctttttaataagtaggtaattttgttgccccattcttaagagttagtgggaacaactaaaagagaatactgttgcccttaagagaagaacttcaaacctctggttttaggaaggagaatcttgcaggtgtagatgactagactgtgaggc

SEQ ID NO: 170708 - DNA, 463 bp, Homo sapiens
gaggtactaacagtagattctttgaagggactgggataataggaggttgctatcctttcatgttttaaggcagtttctgctttttccgtaataagcacacattgcttttataaaaataaaaataattcataaaagttcacttctgaagactcaggagaaaaagactcagcttaggtaacccctacataccaaagtatccccccgagcagaactgcctccctaggctgtcaccactgcctcgcacacgtatgactaatatcataccgatgacactttaaggcagctgcttatactcatgtctgtttctcttatagactgtgagcctcttaaaaccagtgaccattgctttttttatctttaatctctagcagatacctctgaatgcctgtcatgtcatggctactcaatgaatattgcagaataaacattgcattgtgttgtcaagttctcgtagaactttcca

SEQ ID NO: 170709 - DNA, 622 bp, Homo sapiens
aaagcctctatggatcacctgaaggggcataggaatcactgtcatacacagagtctattgtctcatgatttgcagtgctaggattctcccctgtagggagccactcttctgtatgttctgctggtaaatgattggtcactgaacaactggaaaaaaaagaactccacccaccttccatttctttcacttgccaatcagagcggtgatctttcatggtttctcttgttttatgctgtgctaaatcttttactaatatcccaagctgagcagtgttggtagtcaagacttatggctttagtggtagaatttatgtgatgcctggacacttttggccccaaatattttccccattcttcctgaaattcttgactttatacacattgactgaacatgtgtctttattttgctgaatgtctaaaattacatcatgagaagctcatctctttacattaacaagcttctaccttttaatatctccagggctgtcagcacatgaagacagggagtagtcatcatccacttcggaaggaatttaactgacacagccgctcacagccgctaactcttgatgttgaaatctacctgtcttggtgatcatcccacaaggtggtaaggggtaggt

SEQ ID NO: 170710 - DNA, 272 bp, Homo sapiens
gtcactttttggggttgtctgaggtttcctcctgaatagaagtgatgttagaagtgatgacatgtctgagtgagtgcatcctatcaggaggcacatttctcccattactggtaatgatttgatgccctggatcccttaattcccatcctggtttccaactatacccaaaggaatttgaaagttgtattcagtattatttggcaaacattggctcaacatgagaagctctacagaagaagggaaaaaagagcttctgtcctaagtacgcgaac

SEQ ID NO: 170711 - DNA, 195 bp, Homo sapiens
tataataaagttactttcaggctgtgtgtataagacatatatgaaaaataaatgaattttatgtttagatttggatcctatccttaagatactcattagggcgtgagccaccgctcccgacctatgtatcagttgtttttttcaagtaaaaatgaaaaaagaattttctttcttttttttgtcttttttttagaa

SEQ ID NO: 170712 - DNA, 318 bp, Homo sapiens
cttcccgatagaagaattgtgaaagggaaaagtgggtaattcacaaaggagtgaaaacaaatatctataaaaatacagacaaaattagacaactaataaaagaaatgaatattagaacaagaaaatatttctacttgcctttgccaaattgacaatgactctgtaaattatttttatcaattgtagccaatcaaatggacaaatatttcacatatatgttatgtgtgcttgattaatttcctgttgcttatcaagaaaagaattccattcattcttccaccacatgtttattaaacacttaagtctcagaagcaccat

SEQ ID NO: 170713 - DNA, 421 bp, Homo sapiens
caggacagtcttaaggaatatttttgtaatggaggcccaaaatataagaaggcctggagctgaaggagttgatgatggagctctggaaagtaggtggagtgtaggtacagcaaagccagcctggctgccagttccctgagacagtgttctgtttatctcctggttggcagtatttacacaagtaacctatacaccccggccctggatatcaggctggagtactttctgtaaatctttcagaggaaggcaagttagtaggcagctgggcatttaaaagatttcctggggaagttggaggagttttaggattaaaggaatttgttcagaggttgagactggattttgaggaaagatgtttaagtcagggacccagagatcggaagatcttctggtagatcaacatcaggcagttgggagtaaa

SEQ ID NO: 170714 - DNA, 219 bp, Homo sapiens
ctatccacacttcaccatgacaatgactgctaacctgattcatggacttatctctcacctcagttactgcagtgcctctctttactcatttttatgccacctcttccttcataaataacaatgtgtaatttaaaattcaatactgctcatatttccaaacagattttttaaaaaagaacttactgataatctatatattctaacaaaaaaattgttctc

SEQ ID NO: 170715 - DNA, 115 bp, Homo sapiens
tggcaggggggtggggggtggttctcatctgtggccccagagatattgggaattgtatttttttttttgctatgtgctccaaatagaagaatacttaacattcctggatagagga

SEQ ID NO: 170716 - DNA, 295 bp, Homo sapiens
aaatactctgaatggaacagagaacattacgtacatgtggatgccaaccttcttccacaacctagtaatttactttcacaaaagccacagtacattttcaaaatttttggagagtactttgcaactttagatgtgttccatgtgcaggtggcttgatgacagagttagtgacaggcaaaatgatctagggtataagtggacactggcagcaaaagaactgcaaagactgactcaaagttttcaaagaaaagagacaagatttttttttttttttttttactattacacctattag

SEQ ID NO: 170717 - DNA, 249 bp, Homo sapiens
tcaacatgtgtaagcagagacccccagttctaaactggttattaaccctgggaatagcacattggaggctgccaggtgatccaaacactagcatcaaacacttaattttaactgttgtaagagagacaatagatagtataaacaagcagagagaatataggacaaacttggaagggcagtgcttgacttttctagttgtgaataaattctgaaccttttcttccacactttatctgcatttgtcatata

SEQ ID NO: 170718 - DNA, 496 bp, Homo sapiens
atgtgtgctaaattaatgttgaaaacgtgagcttttggtctcccaggtccactttggtccatttctttgtgattcgtacttcacactaagcactcgttagaaacaacctctggagggatatcagaatttcaaacaatgttaacagagaagctgagtcagtctgggattaagttcagtcctagttcagccaaaaggaattgtctggaccctgttcctgcttgaggagatatcataattgggcagcttgtgtgagccatgggaacacacttgaatacatttacatgagaacatatttgtcttagaaataggtacgccaaagtgcatgacacctggctgggtgcggtggctcacacctgtaatcccagcactttgggggaccgaggcaggcagatcacttgaggtcagaagttcgagaccagcctggccaacatggtgaaaccccatctctactaaaaatacaaaaattagccgggcatggtggcaggtgcctgtaatc

SEQ ID NO: 170719 - DNA, 469 bp, Homo sapiens
  misc_feature (1)..(1): n is a, c, g, or t
ntctccctgtaaataagggttttccttcaactcctgtccattctactaggtggttggacacagctcgtctatcatccttagagaatcattccgctggacctccaaccctgcagccaggtcccttgcgtttccctgcaggtctccgcatgctgcgctgtcatgatcattttcttattttctcactccttttttaaatttttttccaaaaatccatcatggtctcctcccggcaataatgacaacaactactactactgtctatactgacggcttagtgtataccagacacggctctacaccctctacatgcattaacgtgttcaatcatagggaccgtcattatccccattttacagatgagaaaacggagctcaagaagtttagtcaagcttagtcgcacaactaggctaggcacagtggctcacacctgtaatcccagcactttgggaggccaaggcaggtggatcac

SEQ ID NO: 170720 - DNA, 317 bp, Homo sapiens
ttttctttgaagcatttttaaaccataatatgttgtaaggaaaattgaagggaatattttacttatttttatactttatatgattatataatctacagataatttctactgaagacagttacaataaataactttatgcagattaatatataagctacacatgatgtaaaaaccttactatttctaggtgatgccataccattttaaaagtagtaagagtttgctgcccaaatagtttttcttgttttcatatctaatcatggttaactattttgttattgtttgtaataaatatatgtacttttatatcctgatca

SEQ ID NO: 170721 - DNA, 433 bp, Homo sapiens
gctgtgatcaacgggagatgtctccccagggcgaggtactggttattcccacaagagtaacaagatggaaaactggaggcagtgatccctgaggccctaacgctgacccttctgagccacctagttccaatcagagctgcccctgccttacactgagggctgctgaactgtctggccctggccctacactcagcaacaagcctagagcctcactggcccagctgaggctgccaaagtagctgcgtggcatctggaatatatggtaaggcagccatcccaggcatctgcaaccgtggtctcccttcccttctcccgcccccagctgcaggctggctcccaggcaggccctactggcagggtctgatgccagtggtggggtcaccaaaggtcaccttgcccacctccccatttccaccatgacctgcccttgcct

SEQ ID NO: 170722 - DNA, 425 bp, Homo sapiens
caacactaaaccatttgttcctttctctttgccttcaacatttcccaatcagaattacttttcttactggacccttccctgcaaactggttcctcttcctgagttctctctctccatagaaggccacagtcattcaaattcaaaacctgtcatctttatttttttccctttatatgctatgactattcctgtaaaaaaaattttgaatgtttcacaagttcttcctctgctttccctcgtcccatcctacctacccacttgtatacatgtgattgtaaaaaatctcacatctagtttccctggttccattcttcccttttgccagtatggatagttgatatctgccctacatcagggcatgtcattgtcctgtttaaaaacctttgaatgttccccactgaattcagaataaacttgtctcctta

SEQ ID NO: 170723 - DNA, 452 bp, Homo sapiens
tgggggccacggcgaggaggctgagcgccccggccgggtggagtccgtcgcggcgaggagcgcgccgattctcaggggactttgccgcctgccggaggcgcccttgctgcggggtcgccccgggtcattcggccgcggtcctgcccagctgggccgccagtagtccccgcttccggcgcggcgggatgcgtggcgcgagcgcttagtccctcggaggggaggacgcgctcccgttcaccggtggacggcgggcgactccccgagccgacgaccccgacagcgacgggagcgacgcgcggctttctgacgggcgcgggcggcgagcggggccctgcggtcctcgggtcggcggcagacgctcccggcccgcgaggaaagcccgcgggaggcggctcctgccgctcgctagtcgctcagagcgcttccatttcctcctcccgacgcaacctggc

SEQ ID NO: 170724 - DNA, 748 bp, Homo sapiens
agatggagtcttgctctgtcacccaggctgcagtgcagtggtgcaatctcagctcactgcaacctctgcctcccaggttcaagtgattctcctgtctcagcctcctgagtagctgggactacaggcccatgccaccatgcctggctaattttttaaattaagatggagtctcgctctgttgcccaggctgagttcatatacagctcgacgtctcatcaaaggggtagaagagcatctcttttttttttttttctttgagacggagtcttgctctgccccccagtctggactgcagtggcgcgatctcggctcactccagcctgcacaatagagcaagacttcgtctcaaaaaaaaaaaaattgagattcaagatggctaagagtttggcaataagtatatattatgcaaggaagcacatacctgttattgagaaagggacgcttcttattcatctttatattattttaagaataattaatatctaatagtacttatgagctaggcactgttttaagcactttatatttgatctcagaaaattctatggaggttctgggccttttgaagctaggccataagaagttttgcagcttcagttgcaggctatctagcacactggtagctttgagctgccatgtaagaaatcctaccactttgagctgccatgctagagaggtctcatgtagatattctgtctgacaactccagctaatcccagcattccagtcatccttaccaaggtgccag

SEQ ID NO: 170725 - DNA, 313 bp, Homo sapiens
ggcagtgctctggaagggacttgtctgagctgggtctaaaggagtgagcctggccaggcaaggaaaggtgagggggagagtgtgcacatgagtgcaggtgcggggagaccaagccaccttcgggggctggccaggcaaggaaaggtgagggggagagtgtgcacacgagtgcaggcgcggggagaccaagccgccctcgggggctggccaggcaaggaaaggtgagggggagagtgtgcacacgagtgcaggcgcggggagaccaagccgcccttgggggctggccaggcactgacgctggcatctgtggcgg

SEQ ID NO: 170726 - DNA, 359 bp, Homo sapiens
gagacagagtctgtcttgtcaccctggccggagtgcagtggcacgatcttggctcactgcaacctctgcctcccaggttcgagtgattctcctgccttagcttcctgagtaactgggattacaggtacctgccaccatgcccggctaatttttgtatttttagtagagatggggatttgccatgttggccaggcttgtctcgaactcctgacctcaggtgatcctcctgccttggcctcccaaagggctgggattataggcttgagccaccttgcccggtccactggttagttctaacactagctagttctcaaactcatgccacaaattgtaagtatttaatacagcagcacttcact

SEQ ID NO: 170727 - DNA, 207 bp, Homo sapiens
gcagccatgccagtgttacccatattgcatgtcgtggtagtagatgcagccccccaaaataaaagtcaaaagatgctggcacattcctgaggttcttctcagccactaacaattggtgtagttcatcatcacctggaatgaccaaaatgtctcccatggaaatgtggctcagctctgtaggcttccatttaactttgtcaggttctg

SEQ ID NO: 170728 - DNA, 449 bp, Homo sapiens
attgaaatttgttgcttaaggaatcaacttgtcatttttgggaaatcatgtagtctatatgatcacattctggatcctttagtatgaataaaaacctattttgtgtgtgtttataactaatctttaacgtaggctggacgcggtggctcatgcctgtaatcccagcattttgggatgccgaggcgggcggatcacctgagatcaggagttcaagaccagcctggccaacatggtgaaaccctgtctctactaaaaatacaaaaattagttgggcatggcggcaggcacttgtaatcctagctacttgggaggctgaggcaagagaattgcttgaatctgggagacagaggttgcagtgagccgagattgcgccactgcactctagcctggacaagaagagtgagactctatctcaaaaaagtaaaaaatataaaataaataaataaaaa

SEQ ID NO: 170729 - DNA, 453 bp, Homo sapiens
cagcaccccactcccaagagcccacatggcagggcagggcctggagactggagggcgagcccctgagaccccaaagaacatcgaccagtcccaggagggctgctgaaccctgttcaggctccccggccaaaataccactgagggcatcagcttgatgaggtgcagcgactgggatttgattactctggccctgcctcaggcttttcccactctttcctgtggctccagacaggagtacccggcccttcccactcactgccccttaagtctccctcagcatccctcccaccccagcgccccagcccctgccagccacctgctcaaggcaggcctctctccctccctccgggcgcctgccctgccctctccgcctcccgatggctaggacaagatgatttacaagagcgtggcgggagggacggcgagccagattaatgcaccagtgagcggccg

SEQ ID NO: 170730 - DNA, 220 bp, Homo sapiens
tctgccctagccttggtgatgaggccctcacagcttgtgcatggcatccctgtcgataccaaacatcttcagcagctcagctggcttcccacttcttgcttcctgcttctgccagtgatgcctggatttaatgtatctgagagaaagaggtttaaagaggttgggttgctcaggcgtggtggctcacacatgtaatcccagcacgttgacaggtttaggt

SEQ ID NO: 170731 - DNA, 350 bp, Homo sapiens
agcaacatcccgtacgcccaatcccctaacgagtgtgtgataaaaaagaactggcaaattatagggtctatagaggattcttatggttgagaaaattccttgttctcaagggcacacacaggcctaccctctttttcatgtgtattcattacctaaatgcacctgtagctagtgcatattttacgtagcaaattccaagtatgttttaaactttaagcttttgtacttaacagcatagacttgaggcaacaggacttagttataaaatatcctcagaaaatttgaagctcatgaaaaagaaaagtcaatatgagctggtaaaccagcacttttttgggcgtacggggaga

SEQ ID NO: 170732 - DNA, 210 bp, Homo sapiens
atatttctattcatatccctgtctcgagtctttttaaagaaatatgagagcacacaaaattatgaaacacatgaattatgagcactcaaaaaatattccaagcattagttaaataaattatgttccatacattaaacgtgatgttttgccacaattagaaatcacaagagaatggccaggcgtggtggctcacacctgtaaatcccagca

SEQ ID NO: 170733 - DNA, 380 bp, Homo sapiens
tacgacgtaaagcatgtataggagaatggctcttgaagtccctggaaggcctgtgtggggccccgtgtaccactgctcagtgagtctgacacagccgagttcagggcagccatgcagagtgacaactggaactgaaatccagtctgctcccagccaggccgggcctcggtggggacatggccacacaagtaggtagaagtctttctttacatgaagacctgtctgcatttgaagctgtgctggggctgtaggtgcccagagggggcttttttctgagtgacctgggcagaggtgacacctcctctaatctcatgagccagagctggcaccatttgctgaccggtccgtccaggtgtggtggcctttcctgatacaaaggc

SEQ ID NO: 170734 - DNA, 351 bp, Homo sapiens
aaatctagcctctctttctgcagatattgcagtattatctaatatcacgctcactccattaataccttcaagtgaaagtttatattggcatctgttatatttattatttcggagtcatactctggtggaaaagaggtctgagcaaccctgatagaatatagataacgcataacagtcatttcaggggcttgaaactgcttttccactatggtggaagggacgatccacccaactagccattacctttaccaaaaaataatccaccctggtctgcccattagaggaaggtgtcttgtcttccaccaaaaggaagaggggttgtctgaagttttacttcagtgcttggtttca

SEQ ID NO: 170735 - DNA, 414 bp, Homo sapiens
cttgaccaaaaacctgaaagaagtgataaataaagcccaggaattctaagttactcaggatgcagggtctgtttcatgtgagtgacagtggaatcttcaatttctaatatgattttgggagaggaatgtgttcatagaagaaatataggccctgaggtgacttcctaaatttactgttagaccgagaccaaagccatctgtatttaggacatgggctgaacccagatgtcacacttggtggttttggtctcctgatggatccagggctttggattatcctgaagccagaggatgttgaaatgggactaaagtctcctatttgtcagagccagcataagttcagtgtgggacagttagagtctgaggataaaagtttttcctctgtatttcgcctgaattttctttctctaagaa

SEQ ID NO: 170736 - DNA, 243 bp, Homo sapiens
ttattgctggagttagcagaaggaaaaataaacaaaagccaaatagtgaaaaccttgtactcatttattcttagcagtttgtgttttaccttttagaaaatgtggagcctttgaaggtttctttaaaaagtattttgggacatttttgttagagaggtatggcaggctcattacaattaatttagcattacctaaatttgaatcctggctccagttctagctggttctgtaactgtgggcaag

SEQ ID NO: 170737 - DNA, 168 bp, Homo sapiens
tagaagcaccctgtgctgtgttccctcccccttggaggtctcttgagccttctcatctgtgaagtaggtgaaggcacaggagggccacgtgaggctcacacacactgctccttgcacggagctggcccggggcagggtggtgaggcttctccttcataaatctcactg

SEQ ID NO: 170738 - DNA, 402 bp, Homo sapiens
actggacttctgttgtgtgtagtgcatgtttcgtacatgccatttctgaggaactctttgtctcagtacagctttgcctcagctcagtctgtttcctcgagagaaattagaggtgtgctacttggtttctaacaatctccatacaaaggccttaaagacattttagtataagaaacataacatttctttctggcccacacctaatatagcttctgttgttaatactacttctctgctgccaccagccatcagcagtgatgagcagccatactaagcattttatattcattgtgttgaatactcaaaagaacccttcaccccttaaaattcagcgtggcttaattaatattgctaatttctctcggaccacaaaactagtgtttgaatgcgcacatcagccta

SEQ ID NO: 170739 - DNA, 437 bp, Homo sapiens
caggtgacctagacgatcctttggtccgagagaaattagaggtgtgctacttggtttctaacaatctccatacaaaggccttaaagacattttagtataagaaacataacatttctttctggcccacacctaatatagcttctgttgttaatactacttctctgctgccaccagccatcagcagtgatgagcagccatactaagcattttatattcattgtgttgaatactcaaaagaacccttcaccccttaaaattcagcgtggcttaattaatattgctaattttctctcggaccaatgcattggtccgagagaaattagtccagagaggtcctaagtatcaaagcagattttgtaaagaaaaaaggcaacacgtcagtgagaaaagcagcacaagatccggactcggggacccttttccctctttccgaaaca

SEQ ID NO: 170740 - DNA, 482 bp, Homo sapiens
tcataagcacaaacttccactgacagtccaaaaaatgtgtccctaagtttgctatcccacgcttcatgaagactgtgttacccattttcctctaatttctctcggaccaatgcattggtcgagagaaattagaggtgtgctacttggtttctaacaatctccatacaaaggccttaaagacattttagtataagaaacataacatttctttctggcccacacctaatatagcttctgttgttaatactacttctctgctgccaccagccatcagcagtgatgagcagccatactaagcattttatattcattgtgttgaatactcaaaagaacccttcaccccttaaaattcagcgtggcttaattaatattgctaattttctctcggaccaatgcattggtccgagagaaattagcatgactctgaagtttgtgctccctgtccctgtggtaagttgccatgtgcctttctaccctggcca

SEQ ID NO: 170741 - DNA, 436 bp, Homo sapiens
ttttttgtatttttagtagagatggggtttcaccatgttggccaggctggtctcgaagtcgtgaccactcctgaagtgctaggattacaggtgtgagccactgcgcccagctagggtgcaagttttattggtttcatcaaaaagtatcaggggccagacatggcggctcatgcctgtaatcctagtgctttgggaggcaaaggcagaaggatcgcttgagcccaggagttcaagaccagcctgggcaacgtagggagactccatccctacaaaaaatttttaaagtagctgggagtggtggtgcaccactcccaagtcacagctacttgggaggctgaggtgggagtatcacttgagcccaggagttcaaggctacagggagctgtgattgtactgctgcattccagcctgggtaacagagcaagaccctgtctct

SEQ ID NO: 170742 - DNA, 515 bp, Homo sapiens
catcatgggtcggggttcagtctgggatttgaggtcctgagatcaggctgagttcagtcccctattaatctataagatcaccataggcaaccatttctctttctatccccagtggccagctggcacacagttgatgctcaatttataattgttgaataataaatgaacaaatgctgcatgaacaaatgcattgacagacaggtggatggatcagcctgtgaccagcaacatcagtggctaagaaaattcctccctccattgcccctctcctccctactgtgggaagctaattagttcttgaggaatctgaccctgccctcccctcccttgccctcattagcactggccatggcatgctgagtctgtctccagggacagtctttccaggcatcttgccagcgaggctctgaattcatggactctcagagctggaagaattctgacagaggaggtatttcatcaccaccctgttttataggtgggaaacagagatccagagagtagcccagggtaga

SEQ ID NO: 170743 - DNA, 751 bp, Homo sapiens
taggggcagcagagaccgagagaggcaggcagacccataggggctcctccacaaagatgtatttgaaattgagggcttggttggcctgggagaaccatactttggcctgctctgagttacacaagaaatgtgaacaccctcgaaatagcccagccctcatggctgagggggtgttttcagagattttcagcagggaggactccttttattgttctcactctcgcctcatgacttgtgttgaaggatttttgtctgctagacaaattgaattcattaaatgactaattaactttgctggcttgtgttttattagttgggcctacagacctggtaatccgaagctgctgatggcagaagataaccgctgcttccacatggagatgatttaattgcatcccaagcagagaaatgtgatgttacggtgaatctgagcagccttgttatttattttacccaatggagtttattgagtatgtgtgaacaaagcacagcccctgccctccaggagagttgagtcttggaggagatacagacaaggaaacagccaatcacaatacagcattacataccaggcaagcacagggttccggggtcacagccttgggaggtgggctagatgttctccttctgtccctccagacgcactctgcacctgcacccaccctgctgcatgccccaggctcactcgaaggactgtgccaaccgccctcctctgccctgtctcttccagttgagtttttgccagtgggat

SEQ ID NO: 170744 - DNA, 355 bp, Homo sapiens
tcaacagctgtgctctggttatccactgctgtgtaacagccaagacaaagttgatgaaaacaaaagccccggtcaattccatgtgaatgtctgaatgtaactttacagtctatgtatttaaaaccatgtttatttcttgttcctcaaaaccagctctcccctgtgttggggaacagctccaccaccgcatcatggtgaccttgcatgtatccacttaggcagagtcttggcagaacgcctcatggtcttcctggatgtgggaggctgggaagcctgtgtacatagccattgtgaggagatcttctgttcacctccttatctctcctgggaagctgtcatgagacagtttctcata

SEQ ID NO: 170745 - DNA, 337 bp, Homo sapiens
tgctgggattacaaatgtgagcccagctgatatctaaaaaaaattttgtttttgagacagtcttcctctgttacccaggctggagtgctgtggtgccgtctcagctcactgcaaccttcacctcccgagtccaagcaattctcgtgcgtcagcgtcccaagtggctgggattacaggcgtgaaccactgcatccagccaggagttgttttttttttttgctattggtggtgagcaggaggtggcaagtgatggtttgtgtgaaggtgtatttcttattaaactgaccctgagctttatgcaagtcacctctggcctgtctgccttggagagaggcct

SEQ ID NO: 170746 - DNA, 443 bp, Homo sapiens
caaaccataacaaggaccttatataaggataaaaggatcaatcccccaggaagacataaccatcctaaatgtatgcacactgaacaatcaaactgccctttctttttctcgagtaacgctggagccgtacttcagtgaattcaggttattctagcaaatctcaccactgcgctagggatctccaagaccacctccacttgcagagatccagtagaaggactcacaggacttagcatttaattgtacgcatggctaagatttatgacagtgacacagtaaagatacccaggatcatgatggaaaaagaggcagagtctggtggaacccttgtgaggcttcctgtgtgctctcccctcccccatgagggatcatacaaagttcactcctcccccagcaatgaaatgcagcaacatgtgtttgaggtttcttcccagggaagcccg

SEQ ID NO: 170747 - DNA, 388 bp, Homo sapiens
ggtaaaacctgatcaccctggcctgcctgcagcaagaattcagttagctaagtttagtaaaaatttccctaccctcttagaaattttcaggagcccccacactccgctccttggctataagttcccacttttctttgttgtatttggagttggcccactctctcccctctactgcaaaatccattgcgataattcctacatctatcgtaatagtcctgatacagtctaccttaccagtttaacaagtgtcagaattaagtttttctttcaccagctccctaagtcttcctggacccactgctcccacccctcactcagggtgtgtaaattacttggtctggggctgtggctgacctcccctaacaagccccagaaaaagaccctgtct

SEQ ID NO: 170748 - DNA, 228 bp, Homo sapiens
gggggagagagtccaggacagagtttcaaggagtaaaacagtaaagtcaagcaggatgaagcacaaataatgtcaattgcttttgatgatctggaaggtaagactggagccaagtggcagggtcagggaatgggagagagcaagtgcagtttacatttccagagagtttggctgagaagtgagaagaacagacactgagagggtatggaggggttcatggtcaagaaa

SEQ ID NO: 170749 - DNA, 464 bp, Homo sapiens
aggcacaataaagacagaacctgggaagaaaagcccaatgggagatagaagtgaaaagtgatattaacgtggcactggtaaaattggaaacaattgtacttagcctgttttcttgacataacgtatgtgaaaatttgaaactatgaagtgcttcgcaaatgtaaagtattaatgacattgccagtaggtcccctacagtgaagggatgccggagagtgctggagagactgtagttcctgagttaagcagaccaattctaagggaagagtgcagtggtagagattcctagtgggaaaagttagatgtgtacattgagaacaccaagtttatctgaactgcgagagcgaaaggctcgatcaagaccgtatctggaaagaaaagcccaatgggagatagaagtgaaaagtgatattaacgtggcactggtaaaattggaaacaattgtacttagcctgttttcttga

SEQ ID NO: 170750 - DNA, 375 bp, Homo sapiens
actatggatgtccagttatcgcccaacaccatttgttgaaaaaatgatcttttctccattgaattgactttgtgtctttgtcaaaaatcaattgaccgtatatgagtgggcctatttctgaactctccattctagctcgttgatctttttgtctcttcaccatacacagccagttgttcttgattactaacatagctttatagtaattctctctaaatcaggtagcacgagtcttccaactttgctttttcaaaattgttttagctattctagttcttttgctttttcatgtaagttgtagaatcatcttgttgattcttttaaagaatatttgcagggcttttaatgggaagtgtgttggaagatttgacttct

SEQ ID NO: 170751 - DNA, 316 bp, Homo sapiens
cagatagaccctcagtgaatgaagagaaactggcttgttacatcaggatataacaattaatatgaacatttgagattattgtgtcctttttaataaaattaggtgctattaaaacaaaatctggaaaattagggctctttctgcatgtgacagaaaacccaacctaagttaagccaagaagaaagcctgatggtttaataactgaaaagtctgggccaggtgcagtagctcacacctgtatcacacctgtaatcccagtactttgggaggtcaaggcaggaggatcgcttgagcccaggagttcaagatcagcctg

SEQ ID NO: 170752 - DNA, 425 bp, Homo sapiens
taaaatgctgatctggtatggccgcccttcatgatgtcatccaggacccaggctgtgttccagctagtttctctccattctagttgtttttctggctggctaggtccagggtgtttcaagaccatgccaacattccatttagcaggaagtggggaagaaagtcagggaggaaactccagatgggcagacactagcagtagtacccgctactttgctcacttgcccagagcgtaggtacctgagctgcttttaactgttcctggggctgggggatggagtgcttattttgagcagccctagtgggagcttctactatgagagtaaaaagagagtggaagtcaggaggtaatgggcagcctctgccctagggctggctttactaagccctggtggcttcataaccaggtgataaagcaggccacttc

SEQ ID NO: 170753 - DNA, 582 bp, Homo sapiens
atgtatttcctcacttgatctttggcatttgggagggagacaatgtagatgtttcatttccattatacacatgactaaaataaagctctgaggagttaaatgacgagcccacgtcacaccactgaatcttgaaggggtggctgttggaccaagatcttctgactctgaatccagtattctttccactaccccatatccagccagaagcaataagaaaaatatttgggaaaactaacactgaaggagccagcatgtctctttcttgttctctcaacctccaaaacaattcaccagaaatctctggcaagtttcataaatgtctgagtcacctttggtgcacagttgattctgaaaaaaactacacacacatatgcacacacacacacacacattgatatatgcataaaatgtattatcatcccagtattgaaaaatctttatcatgttccatgttcttctcaatgcagtatgtgcctataacctagttcggtaactatttgctgaatgaatacattaatgtttatctcccttatggctacatcttcttttacatctcagaatcattcttctatttcagtctgc

SEQ ID NO: 170754 - DNA, 380 bp, Homo sapiens
ttcaatccataggaataccccaaacctgctgagctaatctttactgcacagagggtatcctcagcatcgcccctgttagtacaggcaaactttgttccttcagatgacttattggctggtgtgatggcttccacctgtaatcccagcactttgagaggttgaggcgggaggattgcttgaggataggagtccaagaccagcctgagcaacatagcaagaccctgtctctacaaaagaaaaaaaagtgacttgtcataccggattaagtaaccgttgttctcaaatataacacttcagataagtctttggttgcataatagatttttttcaattatattgtagtaggaaaggggacatattcttattgaacctttataaat

SEQ ID NO: 170755 - DNA, 725 bp, Homo sapiens
tgttcctcctacctcggcctcccaaagtactgggattataggtgtgaaccaccatacccaggctcaaaaagtgaatttaaaaataagtaactgctagatagtattaaaatattatcatttggaacaagtgaaaaatattttcacgtagccaggctgagttccagaatgaatttagtttaattgctttgcttaattttttttgagacagagtctcactctgttgcccaggctggagtgcagtggcgcgatcttggctcactgcaacctctgcctcctgaattccagcgattctcttgcctcagcctcctgagtatctaggatcacagacgcctgccactatgtctggctaatttttgtatgtttttcagagacaaggtttcgccatgttgcctaggctggtctctaacccctgagctccggtgattcacccgcctcagcttcccaaagtgctgggattacagacatgagccactgtgccggcctgttttgcttaatattgattgcttttagtttcagctttcaatcacaaaagacaatcatgcagtagataattaagtgtaatatggattactttgaaacttagcaatgagagtctttttttttctttttatacaaaattcctctaaaatgggaatatttttcacataaaataaagggaaacttagaaaatgtgtctaagtataatggaagcattcaaatgtttgttttaagctttctaatacatt

SEQ ID NO: 170756 - DNA, 119 bp, Homo sapiens
aggccatgatggactagggtgggccctttattcagtacagctggggtccttataaaagatactcagacagacgcagcaggaggagtccacatgacgatggaggcagagcctggagtgac

SEQ ID NO: 170757 - DNA, 248 bp, Homo sapiens
tgtttcccaacacatcagtgtgtttcttcgtttctcaaaatttagcaacaaacatttactgaacacttcagaagaagacagtccctgccccgaaggacctagttgtgtacccagatgatagtagcccaagcagacaagagctgcattagaggtttgttcaggttataggggtaggaagagatctgtaatcctatctggtgagggcggttgtgaaggctgagatgtcagtggggtgtaaggggaacaga

SEQ ID NO: 170758 - DNA, 226 bp, Homo sapiens
tctaacatgagattttgggcaggacaaatatccaaactatttcaaggggtggagccagtgcctaggctgaacctataccgcatcctcaggaccaacagcccagggtaagagtccagctggtacttacctgtccccattctcaacatgcattctctatttctttcttcatgtctttctttcctcttttcaattaagactttaatttgtttgtttgtttgttttcact

SEQ ID NO: 170759 - DNA, 494 bp, Homo sapiens
actgtagatagatcatccagggtgcagggttgcccagaatgcagggtgggggatggatttcaggaaagcaacagaggaagtggggaggaggtggctgcagctgcccacgtgagcgattatggtgtcttgggaccagatagtggctgtggaaatggagagaaatggccactaggttggtgtcaaacaaacgacacttgcccagtcccacaaatgctttgtggtctctaggagccatggtcctctctggtcttggctcggtcagtggggagggtcactggcttggccttgcagggctggggtggctcaccagccccagacttgagggcatgaagcgcctgctccttgctggcatctggctttcttagcttgcccgcctggcctgggcctcattaacaccagctggggctcatccccagagtgaccccagctcctggcagcctgggtgtgacatcctgctcttggggctttagaggagtctgggggggggagtcgtg

SEQ ID NO: 170760 - DNA, 732 bp, Homo sapiens
gacacagtagaaacaatgacagattctttcacaggaaaatatcataagaatattcacattttaagaattaagcagtggagtgcataattagtaaaatttgaaaaagaaaaactagaggtaagaagacctattaggagatgattaaagtccagaggggaggtcttaaaaagggcagcttctcttcaaaggcctgagattagaagtgcagtctcagtctctttttgagggtataataacagcttcaaaaggcatcctagttgcttcctaaattccctaaggaattctaagcatttttctaaacactcaaaatcacttaggaagaattattctttctaaatatgggaaaataaattgcaaagtgggaaaaaaataactggttagtgtatatagatttttaatccacctttatttttaaaagttattcacttgctggagtttttgtttagtggcaccatactgtaacattttactttacagggctgcattttttatgatctgaagatttttgaaaggattttgtatcctttattacatgatacattctatctcccttattaatctgttgtcccttgaagtaagataatcgatgtatatttttccaccttctacattgttgaaagtgatgactttagttaatactatagcaattcaatgaaacctaacagcatgaaatcttccaaaattctcatgaaaggtactgacaataccttgcaataaatgaatgaaaactta

SEQ ID NO: 170761 - DNA, 418 bp, Homo sapiens
cggatacctgacagttatacctatactcagacacagccacagccctatgctgtgcatggccactattcatcggatgatctcaagacaccttccgagcgtcagctcactccccttccaccctcagctccaccctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcagatgataatctcaagacaccttccgagcgtcagctcactccccttccacccctcagcggatgataatctcaagacaccttccgagcgtcagctcact

SEQ ID NO: 170762 - DNA, 249 bp, Homo sapiens
caggaaaagatctgcagacctgacatttagaagttccctccatcatgctgcagtgacagtcacccagtgataagctctcccacacacacagagcttccaaatatctgttgctaactgacatctgaaaaacgaacagagatcccactagaacaaagaaagccctaacgtgaaagacaaagacacgaccatcctaaccaatccaacaagcagattaaaaaagcagagaaaacaaagtatggatcagaagaa

SEQ ID NO: 170763 - DNA, 346 bp, Homo sapiens
gctgcttctcatgtcgccccctaagtgcagactagttctcaccctcagcgctctaaccactgcctctagaagtaaaataagtgtcctcttgcagaatacttctacttccttctcctcaaacccctccagcttagaatctcataccatttgattatattgatcactctcccaatgtttagtcactttccctcattctttgcagtctttacaacctgacttaactgccattattttgatgtctcatttaaattacttaccttctttgacatttgacctcgtcatttccaatgtacttgctatcttcagtatctagctattcaatctcatgatctcagctcaaaccacg

SEQ ID NO: 170764 - DNA, 376 bp, Homo sapiens
tgtcagctggctttaagttttgtttgtatctaacagaagtacccatctgatatgaccccagttgagtttcccatagcttgcagtttcagggggttacagctgttctaaaggcctcgtaggtattgcctgtccaggaatgtttcagggctggtttttgttttaattttgcttttatatccaccagccccaccacatcaagaaatacacagatttagtgccagaggttccttccatccaaacctgggtttccttcctccttttggtgaagaaggaaaaagaaaaaacaagacaatcgctcgcccagccaagtcagcattgcgttcatttccctaagccccatttcctcaggagggcttcctccccttacagagttgcc

SEQ ID NO: 170765 - DNA, 322 bp, Homo sapiens
gaaaaagctgcagttcagaagacggctgaaaatttaaacggatttcagaatatcaaaacctcttgcagattttttttaactaaaatcacataaatacatcaagaaaaccttgttgctttaaacataggtgaatggattctggttttgtatcactgtattaatactcaatttttgataaaacctgtgaataattcccttttaactataggcaacttgattaaacacaaattttttccataagattcatcttatataaaaagaaaattgtctgacaaatatatccaggcaaaatgtatgcttgcaattctgaagacctcactat

SEQ ID NO: 170766 - DNA, 348 bp, Homo sapiens
tggcctcaggggaaggtatcctgaggtcctagtgggtgactggtgagtcacacaaaagagaagtaagtcctgctcctctggagctttcaggctgcttatggtacagtttgggagatgcatgtttaaaattcaaatccaaatcaacctactccgaaatgctgggaatacatcaaggaacaagagtgaaatgacccctcccctccattcatatgtgaagaattcccagaaacaatgcagagggcaaaaggaattggcactgatggtggtacatggatgtgtggaagctaccagctctggagaagggaattgtttaggtaaaaacagattcctggagatggagagttctga

SEQ ID NO: 170767 - DNA, 826 bp, Homo sapiens
gacatttcaactagcctctgtcattcctctttcttcctcttcaatccatccctatcctattgttctgtttttctctcccacgaagtgctctgatcatgtcatttcctctgactaaagctctcaatggatctttgtaccaatttgggttcttaattgcaaacaacagaaacagactctggttcacttagtagaagaggaatttactgggatgacatcagggaactcaaagaattgacaggaagcctcaagaatcaggctcaggaagcaagcaggagccaagagaagctaggcagctagaactttagctaaatcctgtcccaagtgcagcctgattaaggggcttgggggctgcttcccacatggctaccaccaccctgagcacttgctgctgccacctctgggatgaattataaacagtcctcttcctccttgggtcacttgttgaagatttagagtcctgactgggagcattgatttggctgtgatcttcctgctaggggccaggtgagcaagtatctgacttctcactaagactcacattagggaggctccaccaacatatgaagggggctcagatgctgggcagctaaagactccagtgtgtatccatatgcaggttcctgagcattgaagccctccaccatatgccacaaacgatcatctccagttttttctcacttccacaccatgttccactgaagcatgactgtgtgcagttccctgagcagtcctttcctgcctcagcccctgtaatagctgggccccaaaggtggtccgccttgaatcatgcttcacacctgtgtattgtcccctccccttgaaaggg

SEQ ID NO: 170768 - DNA, 464 bp, Homo sapiens
agccccagctgagaaattatgaaggcgactatagacacatcaaaatctattaccagaaaagttgccttaccaggaaaccgtaatttatagtgtatttttttaaggtgggaaggacacatgggtatggtgtattttaaaaggatttaaaagcactaaagtataggcacacctcattttactgcattttgcttgattgtgcttcacagatgatattgcattttttacaaattgaagatttgtggcaactgtgttaagtgtgtagacatcatttttctaacagcatgtgctcacttcgtgtctctgtgtcatactatggtaattgtcaccagctttcaaacttttgcattattattttatctgtggtcagtgatctttgacgttactattgtaatcgtttgggggcaccctcaagctatgcccatgtaaaacagcaaacttaataaatgttttgcgttctgactgct

SEQ ID NO: 170769 - DNA, 439 bp, Homo sapiens
tgggagctgcaggggcagaggcagggagctgtcaggcattcagccagcaagacgcactcagtacccacttggggttcagaatccccctccctcatcttcagatgggccagatgtccccaaagccagcggcccctttctgtttcaccctgtctacagaataaacccccagtcactgggggtgggggaagagtaaggggagaggggaaacgagatttggaggtctagctgctgctgaaacagccctcagttcgtctttattttgccttctgcaaaactggcctggtgttgccagctccttttgaggactttgctaccggttctcagcatccctcaattgctggcttaggattcatgggtttttaggggtggggtgggattagcatgtccagctgctttccagtttccaaagttctgtccctatcatattgcctctgattta

SEQ ID NO: 170770 - DNA, 360 bp, Homo sapiens
aaaattataaaagttatttttaagatactcaagatgtttagtaaacctaagtaagagaaaacgtattttaaaactttaacagctagttctattgtgccttttttatataaaaattatcatttttagcgcaaaaagtagaacccttttattacaatctagtgagggacacaaaataaaacctgagtggtattgtgcaagtagtgtataagttctaacttaaaatatttacttattaaaaaaatgagaacaatgatatattactcttttgataatatatccctgtgccattgctgctgtaacaaattactgcaaacttcgtgtctgtaaacaacacagatttattatattacagttctggag

SEQ ID NO: 170771 - DNA, 563 bp, Homo sapiens
gagtttatgaaatatttgaatcctattccaagtttaaaacctttgacatacagagtaacaaacccatcacactcacaagggtgataactgatctcccagtagtcaatatgttatttctgcagtcttgatttaattttctggagtttctatgttatttctggagtcttgatttaattttctcaattctacttacccaagaagtgtttctattttcaagtactagatcaagtcctaattcctccagaaaatcatctttgattttaagtgtcttccaaactttaatggcaattattatctgtatcattcatttatctttcaacctataaaaattattctaagtttccgacttcataggcactaagtctcttggaggcaaggtttgtgtattacaacaatttccatttccagtgcctagcataaaggaaagcacatttataatgacagccaacacatactgattaatattgaaatcattttattattttaaaaggtaactacatacttttttatgcaatcccaaatattatgaagtgataccattaaatattggtttcctgaggccc

SEQ ID NO: 170772 - DNA, 257 bp, Homo sapiens
catgcaccttgatgcttgagtgggttttgtatgaggtgtaacagcaaaccggggtaactttattcatgactttccttagattggatgtctttgaagcaagaaagggagatctcctggaattacttaagagaacaagcatatttgttttgtgagcttgactgatggccggtagagcagttgagtgaaatctctaaactgattagggctttcgttcaaataatcttctaccgttttcattaatttattccttaatgcta

SEQ ID NO: 170773 - DNA, 500 bp, Homo sapiens
tgcccgcatgctgattgaaaggttacgaagaaaacacaggaagagaaatccaggctacaattgttatttgcaagttagtgactggtcctggaacctgacactcccttcatgggtcagcatgcccagagtttttgtggttcatttaccccagaaggacttagtaccaaacatttcacagatttccgttataaaggtctttacaaacacagacccatgcaaaaggcccaactatcaccttcaacaacaatgcaatggccttccatggccttacagtagggccaagtcagcaaggacctaaacagcctccagtgtgactttgtcacagttcgcgcacctggttgttaatggccttcacctgacataaagcaaattgcctgtcacggatcatctgagcaaaagaagtcaaggaaattcaagtaaaaggaggaaaaatgtatgcatatgtaaatgcttactccaaagtcacctcatctaaagctcttgctcagaaagcaagtcag

SEQ ID NO: 170774 - DNA, 347 bp, Homo sapiens
gacaatgataacatgtgactgtatgtggctgtcttcaaaacagcaatgatttaggcacaactgtggatctcagattgttccgtgagtttggtctgataagattgtatgcgtttcccaggggtgccataacaaagtgccacaccctgggcggcttccgccaccgaaatgtattttctcacagctctgaggtcgaaagtccaagatcaaggtgtcagcagggctggttccttttgaggctgtgagggaggatctgttctaggctctctctcccccagcttctgggggctgctgcagtctttggtgttccttggcttatagaagcatcatcccaatctctgcttttgcgt

SEQ ID NO: 170775 - DNA, 467 bp, Homo sapiens
agcatggatgaccaagtgtcatcatatgctcagcattataaacatgtgcatgacagttagcacatactgagtgcccatgagtgtgcatgtgggtaatgagtgttttcttgttgttcagcagaggacgaggtcatctcattagtgttgggggaggaagacaaaaaggaggctctttctggaaagatgggggttcttttggaaatctggatgtagggagaacagacagagactttctggactggggattgagtggataaagtctcagggtcaagaagagggaacatggggagttcagatagagtgtaggtgggctgggcacatgctgggcccccagaagatgtgggacagccattgatgacagtgtctccacttgggtgtcacctgtatcagtttcctagggttgttgtaagaaattgccacaaaggtggtggctttgaacagtaaaactggattctctcccagttttg

SEQ ID NO: 170776 - DNA, 353 bp, Homo sapiens
cactataccatagcctctgtttagaaaggtaagcatttatagctattaagagaagtgttagtacagtgcttcattcatttaatattaatcacaaatattaagcatatttattcatcattgagtacggagaggtgaataagcagacatgatctatatcctcatgaagctgacagttcaatggggaaggcaacagtaaacaaatataaaaataaccacacagtttgataaagtcttttaaaatattacgtgttgctttgaaaaaaattaggaaaggaaacatactttggacagagactatttttttaatgaagtgatgtataaactgaggttaatcgaaaggtgtggctggtgta

SEQ ID NO: 170777 - DNA, 354 bp, Homo sapiens
aagacacaatctaccaaaactcacacaagaaatggacaatcagcatagtcctatattgttaaagaaactgaatcaataattaataactttccaaaacagaaagcaccaggcccagatggattgactggtggattcttttaaacatttaaggaagaagttacagtcagccctctgtatctgtgggttctacatctgtggattcaaccaaccacggatcaaaaatatttgaaaaaaaaagaaaaataacaatacaactataaaaatagcatatataaaaatccaggatagtagctatttacataacatttacattgtcttaggtataagtaatctagagatgatttacaatataca

SEQ ID NO: 170778 - DNA, 132 bp, Homo sapiens
caggggtgctcaggggagcccacgtttacagctgttggggcactgatgctctcccccattgcaccctagggagccctggagtcccagggaggtgggtgcttcaggctaccccttcttcccccatccaggcac

SEQ ID NO: 170779 - DNA, 333 bp, Homo sapiens
gccttgataggaaaagacagaagacactggctggctaccagtcttttggttgcacagaaggaaggcctgggcaagaaaaatgcttttttttggactggttccatcaatgctttgtccctgaagtcaggaagtacccttgccagtaagggactgccttttaaaattcttttcatactggacaatgcccctggtcaaccataactccatgcaacaatgaaggcatcaaagtagtctacatgtccccaaacgagacatctcttaattcagcctctagatctgggggtcataaggacctttaaggctcattatacactgtagcctataaaaaggatt

SEQ ID NO: 170780 - DNA, 295 bp, Homo sapiens
gatactctacagagggtgtaatagatgtgttggggaatcacagaaaagagcaaaaacagtttatgccaaacagattatatagtggagtccaggtgattaagtacacactcatgacataactgaaaggtaattattggggtctctagatcagttttttgggggcagggcacagaatcttgttctgacacccaggctggagtgcagtggtgcgatctcagctcactgcaatctctgcttcccaggttcaagcgattctcctgcctcagcctcccgagtagctgggattaaaggcagg

SEQ ID NO: 170781 - DNA, 192 bp, Homo sapiens
tcagcaaggcccagacctccaacacacaccaattccccattcatcttctcaaataagtgtggctcttctccccttagcccagaacatccccaggccaggagggacacagtattccccatgttgcttctaacctttttcatctgtactttcccccttcactcacctgtcactttctcctcagtcacttactct

SEQ ID NO: 170782 - DNA, 973 bp, Homo sapiens
catttttcctggacttgttctgcagagcgctcagatttgaaagccatttctagcctttgaggattaccactgtcctcagccaaactgcagggactcctaagtagatcagagctcctggaactttctcatcttttcagcatctcaaccctgtggaatcttttaactcccaagtgctaccaggatatttgcgatgtactctggaatccctctggaaggagctgtcctcacagaatgaaggattagaggagttaataaataagcaaacccaacctttctcctggggaattgtgatcctctctagaagctaggctgtggacctgaatttgcaggagaagccaggagtcatctgtgatgctctgctgatagcatagaacagccctggcagggccaggactactgcacttgcactgcccttactttgaagcagaagctggtgaacatggggggctacactggggaggtgtgtgtcagggccaaggtcctctgcctgagtcctgagagcagcgcagaggctttggaggctgcagtgtctccgatggattaccctgcgtcctatagttttgcaggcacccagcacattggaagccctgctgcagtccctcgtgattgtcttgctcggcttcaggtctctcttgagtgacctgtgcagctatgaggttttaaatctgctcacagcccagcagtatgagatattctccagaagcttccacaagaacagagaattgtttgtccatggcttacctggcttaggaaagaccatcatggccatgaagatcatggagaagatcaggaatgtgtttcactgtgaggcacacagaattctctacatttgtgaaagtcagtttctgaggaatttcatcagaaccctggatcttgctttccaagtgcctgtcccgccggcgtcgggtctgagcggctccctgtgctcggatggtttgtgggcaaccgctcctttcccccaccgccgcagtcc

SEQ ID NO: 170783 - DNA, 500 bp, Homo sapiens
taggcacacacaacttcacccagctaatttttatttatttatttattttttgtagagatggggtcttgctgtgttgcccatgctggtctaaagcaatcctcccacctcaccctcccaaagtgctgggattacaggcgtgagccactgcgcagccagatttgggtatttttaaaagatagctataaatgaacgtggccggagttcttctttagaaaatgaaccttgaggcctcaagaaactatagtaattagtgggtctgaggcccaccaagatccaatgaattgaagtgaactgctcagagttttatacccacagagagagcccgacctattcgtctcttcttgttcttgccagtgcttgctctctgtccatccatacctcagaatgactgacttatctcgacggccaaaaacaccactctcaaaatgccctagtagattaaagaggtacagttatggagatgtctattgaccttttcttaaattttgtgagagaaacaa

SEQ ID NO: 170784 - DNA, 445 bp, Homo sapiens
cacagagtcttgctctatcgcccaggatggagtgtcatggcacaatgtcagctcacggcaacccccacctcctgggttcaagtgattttcatgcctcagcttcccaagtagctagggttacaggcatgcaccaccacgcccagctaatttttctatttttaatagagacggggtctcactctgttgctcaggctggtctcgaactcctgacctcaagtgatccacccacctcagcctcccaaagggctgggattacaggcccgagccacgacacccagccccttaatttttaatttctctactattcttaactacttgaatatttacattgtttataattggaaaaaacatgttttccttggaagaaaaagtataaaacaaagagatattttaaaattagaggaaaatagctttcatccctgaaactaaactgttcgtttcagca

SEQ ID NO: 170785 - DNA, 469 bp, Homo sapiens
aggatctagagatggatgattctggataatctgggtggacccaatgtaatcacaaggggccttactgaagggaagcaggagtgtcagaaacaaaaggaggtgtgacaactgtgtcagaagtctgagtgacgcaaggccatgagccgaggaatgcagacaccctctagaaactggaaaaggcaaggaaataaattctctcctggagcctccagaaagaatgcacccctgttgacccattgtaaactcttgacctccataattatgagacaagtttgtgttgttttcagtcactaagtttgtggtaagactgcaaattatgaaacaactacaggaaaacattggggaatgtctccaggacattgttctgggcaaatatttcttgagtaatacctgacaagcacaggcaaccaaagcaaaaatgaacaaatgggatcacatcaagttaaaaagcttctatagcaaaggaaac

SEQ ID NO: 170786 - DNA, 346 bp, Homo sapiens
tatagagatgaatttaattattcaagaacacgtagctgattactgaagcagctgtaacttgagcaaggtctaggtgactttagaatcataactgttaaaccactttacatcaccttttctgtattatggtctgtctgtgaagcaagaccaaaacacatgggcagtgaatgtgtcaatacctcattcctcttgctgcttcattgcttagagttatctttgctctctcaccaattcttagcttccaactagttttaaaattttactcattctaccaatccttccaacccattccattctgttcccactgttgctgacccaattaagtactcaccacatttacctagac

SEQ ID NO: 170787 - DNA, 269 bp, Homo sapiens
agaaaaagggagtgccaaaagctgcaaataggttatataataaggtgaggagggagaatggaccagtcgatttagcaatatggaagttattggtgaacttgaaagacaagtttggtggaaaaagcagagtggaagcttgatccaagtggatttaacagaaaaaggaaagataaaaaattattttgaaaagccgttttaaagaggttgctgtaccaaggagaaaaacaataaattggttgctaaaagataagtggggtctaataaattct

SEQ ID NO: 170788 - DNA, 427 bp, Homo sapiens
aagaaagctatccggttccatgactaggttgtgttctgtggcacaattgcctttaagaaaaagagattatctttgatgggcctggcctaatcaggtgaggccttaaaaggaacttgtctcttcctgaagagatttgaagtatgggagagactcaacccaacagagattctccactgatagatttaaagatggaggaagccatggaaaatggcaactagtatcagaaagccagtaagaaaacaaggacctcagtcctccaactataaggaactgaattctatcaataccctgaatgagtttggacatggattcttctccaaagccttcaggtgagaactcagcctgactgctaccttgaatgtgacaccctgagcagagaacccaactgagctgtgctggacttctgatctactgaaccgagagctaa

SEQ ID NO: 170789 - DNA, 308 bp, Homo sapiens
gtgtgctgaaatggaatgatctccatgatattgtgaaaaagtaaattataaaacaggagacagagtatgctgccagttggagtggggggccttgggtgcagaggaagagctcatgcatacactgcttctgtgtgcttagaatacctctggaggaatgggaaagaagctgctgacagtggttgtcttcttcagaagggagctggctggctagggctggagtggaaaggaaacttactttttaccatatacccttctgtactctttgaatgttttagtcatatgtgtgtgctgtttgaatagtgccccca

SEQ ID NO: 170790 - DNA, 544 bp, Homo sapiens
ggtcactggccaaagagcactgtgggttctcggaagcacctgctcttccatcagctgtaaaccggaatgataaccagctcctaggctttggtttctgaatgtacgctgcgaacgatgcactgccttggcctcatggcaggggctggggaggcccgctctaccctgtaccccgacccgggcccaaagctgagcttgaagggccccctgcttggcttctcgttggacctggagctcacccatgaagccaggactcacgatgtggcgatgccacttgcgcatctatccccacgggtacacagagaggccactcgcccccaacccctctcctggaatgcaccatatccagccttgtgagtggatgggtgcctggactccctgggcccctgagtttggaggtggaggctttggcttcacgtcttcctgaaggacacctgttctcggctcagctccctccatggatttgggtggaaagggaacccggactggagtcagaagccctggtggggtccactggctagctgttgaggctgggccagtcacttgc

SEQ ID NO: 170791 - DNA, 313 bp, Homo sapiens
gttctcagacagatgactatatccttccctgggtacttgcagggtaagcacatcccctcgaaatagcagcagctctaaacatgaaattcttcctggaggattttcttactcttgagttctattctaccaaattttttgagcacttactgtcaggcattcagaatgtgagcaatgacaataatttacctacacttttgcacttacagtatgctgggcccagttgattctcaaaacagttctgggaattagctataaaaatgcccccatcttacagatgaggaagctcaggctcagaaaggcaaaaaaaaaacca

SEQ ID NO: 170792 - DNA, 103 bp, Homo sapiens
caccccaaacaaaactcattatggttctctcttgccttcagtatgtcatagttccctcttgcccatagcataatttttacatttttcaactctctggttacaa

SEQ ID NO: 170793 - DNA, 308 bp, Homo sapiens
caagatcctaaacagaaatggccacagtgggtttacacctgctaaagcagaaagccaagcacccaccacaggtgaagccattctggggaaacaaagagtgggtctgggagactcgcaagagaatccgaccagcggcattagaagaatgtcttgatcgtgactatcttcactgatgagctgagcattttccagaactctctgccacagaattcagctcccatatgccctggggctccccagtaccccaagaaaacctgtactacagtgcccaccacatactccagtaatttacttgtgtgtttgtctcc

SEQ ID NO: 170794 - DNA, 374 bp, Homo sapiens
tgagacagggtcttgctctgtcaccaaggctgaagtgcagtgttgttgcaatcatggctcactgcagcctcaaactcccaggctcaaatgatcctctagcctcacccttctgagtagctgggactacaggcacataccaccacgcctggctaacttttgtattttttgtagagatggcatttcaccatgttgcccaggctggtctcaagtgatcctcctgcctcggcctcccaaagtacaggggttacaggcatgaaccatcacacctggccctctttatccttcataattttccttgctctgaagctgactccatctgaaactaatacagctttattttttctttcatagagatgggggggtctcattatatt

SEQ ID NO: 170795 - DNA, 293 bp, Homo sapiens
gcgactctgtggatcccctcccaaggatgacgacatttggatgtttgaaggttgactgttagaagaaaagggtacaggtagagagtgccattatagattgattaacaagtttatcttgatcttgattttctgctttctaatcttctaatccataattataagccttgtaagtgtatttacttctttattttggaaacttctagaaaaatagatgttacatttgtgacgtttaaatatatggaatttgatgcctgacatattccttctgcctagttgagattatggcccaattc

SEQ ID NO: 170796 - DNA, 851 bp, Homo sapiens
ctgggatttttaagaaattgcctaggagagagttagttgaacttaaggtggtgtctaattagagcaaagtgccttccattttaacttcaatgaacttgccacgttggtctgatgataacccaagagtaaggagtcttggattctgatcccagctcagcttctagagacttggtggttttcaaattgttcttgagggactccttcaactgaagggctccctagttgccaagagtggttggttctgagtcgaggtggctttgatttgtcagctttggtcagagaattcaggcagggggcaggaagtccgtgttctgtagttgttttgttattttaccctttttataccttccattcaggagaagtttattagatgaatccgtgtccagaaatagagaattagttgccttcatcctttatattaatttcccttgaagtataaacagccaaagaagaaaagtacttgtgggagaaagggggttcagatcctcaaatttgaaaatagttttcaacttcaggaacgtgaaaggtgactgttaaccaaagtctgagtctcaggagctacttcatgtggtatgcttttacctgatgttatgttttagatatggctcattcattcggcacatgtgctgggtgcctactgtttgctggacactgcggagcctggtggatgctgggggaagcagatgggtctggtcctggcctccaggagcttactagttaaatgtgggagtcattgctaatcatttacactgtgtgaggagctctcattgcgggtgggagactgattgcctgcagtaatggggagaggatatgcctggttccctcctctcactccttgcttggacttttgt

SEQ ID NO: 170797 - DNA, 316 bp, Homo sapiens
gctcacccatgagcgctttaaccttgtacatgctcaatatccttatgaaatgcaatatcttatgatcctttaaataacaaatgaccttattcccttttatggggtcattaaggcctctaacagtccaggtttaaatcccagctactactgtgcatcttaatttactattcatatgtgaatctctctctggctcccaattactatacaacagcaaccggctcatcagattatccccatcggaatgtgtctgttaaagacatacagtttacatctgagggccctaattaaagtcacactactcgatacaccttgaaca

SEQ ID NO: 170798 - DNA, 691 bp, Homo sapiens
tgaattacatggaggacaagctccagctgactttccgtaaactcgcattaggattctaataggagacgacaggagcaggtggggataatgagctggcggaaggggctgcctatcacactgctcggtggcccctctttcacccccactttgcctcaggcattttctactcagctgtgaccttacttatggtgatgccaatccagtggtcaggagcgaggcgcccagcctgtgtctgaatcctcctactgaccctggggatccgtgcgacttgatcttagatattggtggtgaagcgccgctctccttgacagcatccaggaaaggtaattacctttgccaaaatgcaagtggaagttcaaagcctcagccttgaagagtgtccctggagacttccaggcccccaatgtgaatgtgaagccctcctgcccagtggggcaaggcgccggattgaccttcgcctgagtgggagggcagtcgctgtttgggtccacgttaggggcggtccaggtcaatttaacttgtcatatgccacgggaagacataagaagccaaacccacaccaaaacatgaaccgggggatggaatttattgctcctgtatcagctcccaccaaatctggtgccccgtggcattttctttctcaaggtcccacggatgcccagagagcagtcagaatcaggccaggcaccag

SEQ ID NO: 170799 - DNA, 754 bp, Homo sapiens
gagtcaaactccctctaaaaaaaaaaaaaaaaaaagggccaggtggcacatgccggtggtcccagcttcttggcttggaggctgaggtaggaggatcgcctgagcatgggaggcagaggttgcagtgagccaagatcgcaccattgcactccagcctggatgatagagtgagactgtacctctaaataaccaaaaccttgattacagccatggggtgggggtgggggtcaggggcgtctgactatggctggggaactcatttggtttttctcctctcttatttttttgggtagagacagggtccctttgttgcccaggctggtctccaactcctgggctcaagcaatcctcctgcctcggcttcctaaagtgttgggattacaggcttgagccaccgtgcctggtctgttttttttttttttttggcaatagagtcttgctcgcccagggtggagtgcagtggtgtgatctcggctcactgcaacctccaccttcagggtgtcaggcctctgggcccaagctaagccatcatatctcctgtgacctgcacttatacatccagatggcctgaagcaactgaagatccacaaaataagtgaaaagagccttaactgatgacattccaccattgtgatttgtttctgccccaccctagctgatcaatgtactttgcaatctcccccacccttaagaaggttctttgtcattctccccacccttgagaatgtactttgtgagatccatcccctgcccg

SEQ ID NO: 170800 - DNA, 816 bp, Homo sapiens
atctgaccagggacatacaaaaggattatcgaggaaagcttctgttgtaaaggggaaacctttaaagaaaatcagaattttattaaaacaaaaataagctcacattatactgttgttctgcagcttgctgctttcacttcataatgtgtctcagagatcttttcacgtcagtacaagtggacctctcgctttttttattatctgtgtattagtatttcatatatggatgtaccataatttatgtagcattttaagttgtttccaacttggcactattaaataattgctgttgtgaacatccttgtatgtatctacaaggtgggagatgcttttgcacatgtaaaactgtttctgatgcttgataacctagaagtagaataattttgtcagagattatgaacattttacattttgttggacatttcaaactgccatccagaatggttatactgatataatcacatgaattgagttaattcatttcctgtactatcatcagaaaatgttatttctttttatttttgtcaattctatggccaaaaagtaccttcttttaaatttgcaattcttcatgttagtgaagatgagcatttttatcatatgcttataggccatttctatttcttaggtgaactgctcattcttatcctttgtcactttttactaggttgccttccttactgatttgtaggagttctttaaatgttatggaccccttgtctataacatatgtgcaggtattttctttcaggcttttaattctacaggtttcaaattttgctatggttaaatctttcgttcttttccttgatgctt

SEQ ID NO: 170801 - DNA, 426 bp, Homo sapiens
caggaccttccaggtcgccccctcggtccccgcacccccaggccgcccgctcaccctcgtcgagtctcgctaatccctcctgatcgcgacccccgcaagagggagaaacgggtgtttccaacccctttcatgggggagaggaagccgcggggagcccaggaacagcgaccgcagcaagatctgcacccggagcctcaggaacagccccagaggccaaaactgcaccctgcgaaagagcagaaaacaggaccaggaacagcagaaacctccctgcaatcatctttccattagtcaatgctgatttcctctcccgaaaccaggaattcacttcccaccccagataacctaatataatctatatatataaatatataatatataatgttcttaaattattcctgatttttttttaaccaagctgccaag

SEQ ID NO: 170802 - DNA, 814 bp, Homo sapiens
gctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctc

SEQ ID NO: 170803 - DNA, 696 bp, Homo sapiens
  misc_feature (661)..(661): n is a, c, g, or t
  misc_feature (668)..(668): n is a, c, g, or t
gctgtttctttcagaagctgggctgggatgagaattttgggcaacctccttcgacgtgggggaggtcccatttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgtttttttggtcccccccgcccccacccgcccccatcccaccattagttcccccttgattcccccttgcccccccttgttccccctgcccttcttttttccccnaaattcnccttttccttttattgccttggaacttt

SEQ ID NO: 170804 - DNA, 201 bp, Homo sapiens
actaacctactgcacccacagccgccctcatctcagatgatggcagctctgcctccagctgctctgctcccagccctcagagtcatcctcagctcccctctcactctgcccagtcctctagcaaggtctgtcaggtcatctttaaaacatacccagaatcggccaggtgcggtggctcacacctgtaatcccagcactttg

SEQ ID NO: 170805 - DNA, 376 bp, Homo sapiens
  misc_feature (31)..(31): n is a, c, g, or t
ctggtcgttcagaggatcccgaatctcgacnagttgtgcatatgggtgaggcagaagataggcattatgtgaaaagcttggttggtaggtgttatgggttaaattgtgtctccccccaacccaaaaaaaaagatatgttgaagtctaacccctgtccctcaaaaggttcacctttttgaaaatagggccattgcaaatagaattagttaacttcaaatgaggtcatactggacaagagtgtgcctcaatccaatatgactggtgtccttacaagaacacatccatatctcttcctaggttctcgtggttgactaaaaatcttcagtgttccttggcttgcagttgcacaacttgtcgagattctgtgccttcataa

SEQ ID NO: 170806 - DNA, 720 bp, Homo sapiens
gataattactctgccaaacatgagtaaaagttatctggtacataaacattctatcagaggtgaataaatagtgacatttcctccccctgcataagtaagcaaaagcacagaacatatccagacttatttccatatactcatcattaaccaaccaggtgaccagtctaaaaagtgactcaaaatatttgtgtgcatatgggtgaggcagaagataggcattatgtgaaaagcttggttggtaggtgttatgggttaaattgtgtctccccccaacccaaaaaaaaagatatgttgaagtctaacccctgtccctcaaaaggttcacctttttgaaaatagggccattgcaaatagaattagttaacttcaaatgaggtcatactggacaagagtgtgcctcaatccaatatgactggtgtccttacaagaacacatccatatctcttcctaggttctcgtggttgactaaaaatcttcagtgttccttggcttgcagttgcacaacttgtcgagattctgtgccttcataatcacattatactctccttgcgtgtctgtctttacatggatgtcttcttgtaaggacaccaatcatattggattgaggaacactcagtccaaatatcgtaactaaatataggatgtcaaatttaattcaacattatatatgggttatatccaacaaagagaatcatttttctttttttctttgagatgagg

SEQ ID NO: 170807 - DNA, 243 bp, Homo sapiens
gaggcacatttatgtattcagtttgacaatctttttcttgtaattgatgtacttattccatttaactttaataaaattatttatacatttggtttactatccgttatcttagttttgacttctatttcaacaatttatattatgtacctgtattagtccattttcatactgctatgaagaaatactcaagactgggtaatttataaagaaaatgagttaatgaactcacagttccacatggcc

SEQ ID NO: 170808 - DNA, 438 bp, Homo sapiens
caacagggtcttgctctgtcgcacaggctggagtgcagtggcatgatctcggctcactgcaacctgcgattcccgggtggcaagtaattctcctgcctcagccacccaagcagcctgtagtccacaggcgtgcgccaccatgcccagctaattattgtaattttagtagagatggggtttcaccatgttgtccatggttccatggctggtctcgaactcctgacctcaggtgatccacctcagcctcccaaagtgctgggattacaggcgtgagccattccgcctggccagcaggggctgttttgtttcctgctttcattccagggctggcacatgggaggcactcagcagataatgtatctgagttcatgaggcccctggaggtttgcttgactccaaagaccccaggaccaccagggtgtgagaccatggccagga

SEQ ID NO: 170809 - DNA, 194 bp, Homo sapiens
aggttcagggttggaggaagagtaggacaaactatgttcttaaccagggtccctgtttttaccaagcaataaatagacttatctgtttattgtgcaatccacagtggttagacttatctcaacctttcatttcctcttccctataacatgcacactatacaaacctaagcgtgaatttaatccctgaaagatca

SEQ ID NO: 170810 - DNA, 103 bp, Homo sapiens
gcccttttgccgttccattcctctctcttttcctctcctccagcttccaggcttctctctctccaccattaattccctgtgcactttctctttcccatcctgt

SEQ ID NO: 170811 - DNA, 540 bp, Homo sapiens
ttaaataagaaagggattttatcacgtggacagcaaagtgtgttcctttaaatgcaagggcagttcatctaggcaacagagctggtactggactgatgctggcaaccattctccctatctcttgccatctaattaaaacttctctcttgacatctactttatttctctgtctccaacttcttggcttctttatttctatggcagaatattgctgctacacagcatccagatttatagttctaccatctgaatcacaactccatatttctttggtgagaatctgaccgagtaatgttaggtgagttttgtgatagtatagagcagagcccctgagcacacactcaaactaaactgcctgggtccaatcctacctcacttgcaattagctctatgactttgggcagattacttaatctcaaacctcatttttctcatctgtaaaattggagtctgcaagagaaagtagtccggactgaaatcggccagaagtccctctcatgttatatctaaagtaaacctatctttaactgccaagctgtg

SEQ ID NO: 170812 - DNA, 121 bp, Homo sapiens
aaagaaactgtactctatgtcctctccccactccaggtaggcactcccccttaaacagcctcatggccacggaaggaaaatgcagctcctttctgctttaacccagttcttctcacaattc

SEQ ID NO: 170813 - DNA, 608 bp, Homo sapiens
cccaagaaagtgaaaggacaactgagagaataggagaaaatatctgaaaaataatctatctgataaggaacttcttctcagtataaagaacgtttaaaactcaataaggaagagagaatcccattgaaaaataggcaaaggatctgaacagacatttctccaaagaggacagacaaatggccaataagcacaggaaaagatactcaatgtaatatcaggcaaaagcaagcaaagtccacactacgataccacttcctaatcagagaataaaaactgtgctcaaaaagacagtaacaagtgttgacaagaacgtggacaaagtggaactctcctgtgccctgccggtgggaatgtcaaaatagtgcagccactttggaaaatagtccagcaattcctccaaaagttaaatagtatttaaccatgtgacccaggtcagggtcctaatatccatcagctgacaaaaacaaaacaaagcactagcaacggggcaaagaaggacgcactgacacactaccacatggacgcacctcgaaagactcatgctcctgaaacagccagacacaaaaggccacgtgtcgtatgactcatttaatctcaaatgtctagag

SEQ ID NO: 170814 - DNA, 536 bp, Homo sapiens
cctaattttgccttattgtcagtcactacttaccgcagcttggggccctcccaggaggctaaattattatcaaaggattagggagatgtagccttgcagctctgacatttctgattacttgtctatgccagaacactaattagctgtgactaattaagaaaaatgttcctgccatagaaaactatttaaaagaactgagaagtagaaaagcaattcaaaagctgagcagtgctcagatttgctgatgctctttagatttccaccagagccttaactcacctttaattgtgctcagaattaaaaaaagaaattccacatgcaaactgaccagaggattttgcttgaataggaaaaagaaaatgttgatcacctaagctctcttaccaatggtaaaactgtctttgatgaatggaaggtgacacaactttcattttcgtggagaaatttttctaaacaccaattgcataatgtatatttgcattcatccacctgagccagtaacaaaggcttaagtcactcaagaaattagaatattc

SEQ ID NO: 170815 - DNA, 396 bp, Homo sapiens
aacttaggggggcaaagagggcacaggtaactggaggatgacaaagagttctttgggaaaatgccactgagtttgagggattaactagaccacgagtggggagctcccggatggaaaggatagcgcgtgtcgaagctgggaggcagggcccctaccttctgcatcagcctgttgggggcaccggagacagccaggatggctcaaacacagcgcgcagagtgcggctgcagggttgctgggtcagactgtgcaagacccccttggccactgtaaagtttggatctcagtttcagccactggaggatttaagcaaggaggtgacctgatctcctttacattctgaaaagcttgctgtagttccatcgtggagcagggaccggggaaagcagtccctca

SEQ ID NO: 170816 - DNA, 345 bp, Homo sapiens
ccgtgctttttaatattaatattaatagtaatcagaaataaaaatggttgtgcgtcattttttactttatataaatggaagttgtacgttaactgtttggtccatgtccttctcacctttatcctgtgcacatgtagacatcacagtataccctaagggctgaaaggcaagcttcacaacagatgcaacccattttgtatgttgaggttctagctatcagtatatatcactgttattctccatccaactagggagacaaacttgagagataaatggaaattaaaagtttgtccgtgagccactgcacccggccatgcaaactcgcgttttaaacagaagaaactt

SEQ ID NO: 170817 - DNA, 341 bp, Homo sapiens
cggcctgatttccctcacttgatgtgtttctttgctgctaccagaaagggaaatcatgggagtgaagcctgccaggaccctcagggtaagctggcagcaggctctgcagctgcacttagttggggtctgctcagaccagtcaggaggaattcaggaggctttcaaagtcccaaggacatcctggctctgaaaggttttcttttgttaaaaaatgcactttgtgctgtgtgtggtagctcgtatgtgttaccccagctattcaggaagctagggcagaaggattgcttgaggctaggaattcaagactggcctggatgacagagtgaaaccctcatctctta

SEQ ID NO: 170818 - DNA, 373 bp, Homo sapiens
tccccctgcaaagtgggacaactcctagattaaagattgctagaaaatacaatgactaagtgtagtgtgattcattactgaatcttgaattaaaaagaatgtaaaagaattttttaaaaaatcttaaagtataaagggcattactgaatatgaaaagatgatgtgagatcatatcattgtctgcacacatatgaaagaaagataaagcaaatacgggcaaatgttaacaaccgatgaatgcagggaagggtatgtgagtgttcactgtgctagtccttcagcatttctgtaggtctgaactttctccaaaataaaaagtatctatggtgaggaaacggtgcaggaaggatagaaagaggagattatcaccaaa

SEQ ID NO: 170819 - DNA, 753 bp, Homo sapiens
tatgtcaaaaggtcagactgaacacatgcatctcactgggctcagaaatccactgaaaccacagaggggagtatttaaaacacataacccacaagtatgaggatggtgacagaggagtcaggagcaatggcattcctaagctagaagtgggtgagagctgtcactaagttagggaaggcaaaatactacgtggcgacttggcgaagaggagagagttcccaccaggctgactccagaaccgcagaaggctgagaaccagcagcccagagacgggagacctatatcaaagctgcctggggaacaactactgaagaagcccttaacgccccagtgctctccccacatggtggagggtgaaagtttttgtttttttttccttctgggactctgcatagtcccagagaaaaggcctaagcacctcatccccaaaaacaacctgaggaggccgttggaaagctccgagttgacaagtctcatccacgcacatgctcggtgcttccaatcggtgatcaagaccactgctcttcatccagagcaggcagcagggattcccaggtatccaaagaaaccaaaacaggcggtgtaatttaggactgactaagtaatggctcggccacttttaagtgtggaagcaaaactgaccccacagatttagaaaactgtaacactgcttattgggagaaactagtgtcaccctggctagttctgctccccaaattcaaaggtaaataaacggttgagcatgtccgatca

SEQ ID NO: 170820 - DNA, 649 bp, Homo sapiens
tcgctcctctacctccctgcaaatcagctggtggaatttgttcctcactgtattggtttctatcttggtcaccttaagacagactattctttgttcacacaacactgacttgcctaccaatggggagcctaataaaattttatgctgttataggacttttctgtgtcatcttcacctcctggtcttgcatcatgttgagggcaattacacatttatttattacacatcctcaaatataaaaccacgaaaactataccaaagacagcagcttttcaatcatccatcaagatataccagtttcaaaagacaatcctgagccacatcctgaaggtcattactcacgcgcgaaagctcatttcaaaggcctccttcatctcttgatattgtcagatagtgtgtgtgccaaagtgctgcttggggatctcaatagctccatgttatctctctctgggcatgattagtgtgaggtgcgggcaccaatttaggctccgtctacacaatgccaaaacagtccaagaagaaatgaaaccatccatcacaccactggtggttttagctacatgatgccaaattgtgttgactcatccgccccctgccccacaactgcattcactgatgatttgagttcactttgagtatctgacaatga

SEQ ID NO: 170821 - DNA, 170 bp, Homo sapiens
ttatttatttataattatccagccgtggtagtgcttgcttgtcctcccagctacttaggaggctgaagtaggaggatcgcttgagcccaggagatcaaggctgcagtgagcatgatcatgccactacgctgcagcacgtagtgctgagtgacagaacaaaaccctgtttc

SEQ ID NO: 170822 - DNA, 228 bp, Homo sapiens
agacatgtgcatttctttgttgtgagtttgtctcttccagaattctgacagctcagagtctttggcaggaccccaccatgtcttcagaggtggagaaaatcagtgaccactgctagggtgggcaagctctccctgacagcttgggagaagcaaacattgccttctatgcacaggcttccttcattgagttagtcacctttatttgaagtcaaatgccatttatctaaa

SEQ ID NO: 170823 - DNA, 657 bp, Homo sapiens
atacttgagaacatttaagttgttgtgatggttaatattgagtgtcaacttgattggattgaaagatgcaaagtatcgctcctgggtgtgtccatgacggtgttgccaaaggagattaacatttgggtcagtggactgggaaaggcagacccaccctcaatctggatgggcacaatctaatcagctgccagcacaaccagaataaaagcaggcagaagaacttggaaagactagactggtttagtcttctggcctacatccttctcccgtactggatgcttcctgccctcgaacattggactccaagttcttcagctttgggactcagactgccttcctttcccctcagcttgcagacggcctattatgggacctcagcttgtgatcgtgagtcagtactccttaataaactcccttttatatatacatctatcctattagttctgtccctctagagaaccctgactaatacaattgtgttacagggtgggctttggccaaaacaaaacaaaacagaacatggagtaggaagacagaatagggtctctgcctgcccacatgggaacaggtttccccttggtcatctactgggcatggtacaaaggccatgtggattccctggcctctgaacagaatgcagtggcactcccacgctgg

SEQ ID NO: 170824 - DNA, 272 bp, Homo sapiens
tagattccattgctctctccactttactggcaggaatgggtagctttaagtatcttcagctctttccagctccagagtctgagccctggataaatatcatctcatactatctaacctctaagttcccttctcattctttaagcttccataaatgcatctttcttcctctatttctattttattccctcacatttcatgggtaaatctttataaacacaccatttcaaacaatgctattttactctttctggctgccccgtgaatctttatag

SEQ ID NO: 170825 - DNA, 774 bp, Homo sapiens
atgcctcagccaccctagtagctggaattataggcatgtgtcaccacacctgtctaatttttgtatttttagtagagatggggttttgccatgctggccaggctggtctcactcctggcctcaagcgatcctcccacctcagcctcccaaagtgctgggattaaaggtgagagccactgcactcagccaatttcctattttttaaaaggctgaatagtattcaattgtgtatatagattacattctaaaaattaatttatccattgatgggcactttggttgtttccatgtcttggctattgtgaataatgctgctgggagcatgaaagaacagacatatctgtgacatactgattccagttcctttgggtatatgcccaagaagtgggatcgttggatcatgtggtaattatatttttagttttttaggaacctccatgctgttttccaaaatgactgtactaatttacaatatcaccaacagtatgcaagtcttcccttttctccacatcaccagcatttcttatcttttgtgtttttgataatagccagtctaacaggtgagaggtgatacctcattgtggttttaatttgcatttctctgatgactagagatcttgagcattttttcacgtatttgttggccattcatatgttttcttttgcaaaatgtctattcgtgtctttttcacattttaaatagggttatttgttttcttattactgagtagtttgagttccttatatattttgaatattagccccttacgtgat

SEQ ID NO: 170826 - DNA, 304 bp, Homo sapiens
cttgatctctttgaccccaggagttcgaggcagtagtgagctatgattgcaccactgcacaccaacctaggtgacagagtgagacctcatctccaaaaaaccaaaccaaaacaaaaaaccttcaagaaagaaaaaaagcttgaccttccctccctcactctttacagacccatggaatctgaagctctggtgttggagccaccaggcattaacaagccttctgggtgattcgtaatacgtttaagtttgaaaaccagggtcagaacttttaaacaagtgcaagtgtccagctaaaatgaattat

SEQ ID NO: 170827 - DNA, 429 bp, Homo sapiens
gcccagacatcggacacatgagtaagggaaccccccgatgacccagcccctagctccaggcttcttcagctgatgctgagtaaagcagaatgagttatcccagccagccaggtctgattcatgagcaagataaaagttggggtttctaaggacactacatttaggatgtttagttatacagcaataactatcattatcttccttcagcttttaatgtttaaaaatgcctgatctctttgtaactgtaaggaagctaaactgactataaaattcatggttataaactctagacattgctgacctgccttctggcacttagtcttactgtgcacgtttttgaggctacccagatcttttccctcaagaacctgactcgttttctgtatctggaagcttatgtaatccttgtttttactctatttttgaaaa

SEQ ID NO: 170828 - DNA, 105 bp, Homo sapiens
gagagaagtgttgagaatgaccctgagaactctggcttgagtaactgtggctggagatgcaatatgctgaaattggggaagctggatgaggaacaggtttgggaa

SEQ ID NO: 170829 - DNA, 408 bp, Homo sapiens
ctgtggagcccgagggtgggaacagagagtcttcttttgctgtaggtggaagcctgtctggctcctttccctctaaggtcagacagcttgagagatgtttccatcctcccatgcatgaccctgaggcagttagctggtcagttactcactgtgctctctgccaactctaatgagccaggaagcctccccgtgcccaggcgtgctgtgatcacagtgttcaatgatggggtgaggctacagcgtccagccaggggctgtgccacaggggccagaagatatctgacctactgtcactgcctcttccactctgttccacctgcactggggcaatgccatctgatgaacagatccatttattaattcaacacgtttgtattgagagcctgctgggtgccgggcactattgtc

SEQ ID NO: 170830 - DNA, 241 bp, Homo sapiens
cacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagagg

SEQ ID NO: 170831 - DNA, 551 bp, Homo sapiens
tagaaaatgaaagcaatgagcaaggatgactcagaagctttactgaaggggaaaaaagcctgagggggggaagaatgcaaaggtttgagggaagatctactatgcacattaccatggctgccatctaatgttcccttatatttaaattgccccactcatggtccccatagcattgctgttattctttgtgcaggaatggctgtggactagagctgaggtaggcactcaactaaggggcaacccatctgcaattagggtagccatgtattagctggcttggcatgatggacattgatgcttcctagtatgtcaatcagaagtctttccagattttagacaggggaatatagaaaagactgactagctaaaagagaatagcagaggcacaaaaaacagccagtctctgttcctttgctttctgcttccaatctatgtgcctcattccaataaattctcttttgccaaaaggaggcatagtagactgattttctttttttctttttttttttttcttttgagcttcctagggtggccgggaatcctctaaagtc

SEQ ID NO: 170832 - DNA, 158 bp, Homo sapiens
tgatttttaagagtatttagatagtagaaaattattaattctctttattagctcaatactttgttcagccagcatttgcagagcaaaatctgcgtggatttatttagtgaaaattatcttttaaaaccacaaagatttaaccatagtacataaaattt

SEQ ID NO: 170833 - DNA, 650 bp, Homo sapiens
cccaacacaagacctgcccagaagggacctagaacctgggccttcattcctccatcccgggcacttctgctgcaggtttcctgactttccctcctaccacaacctctgccatctgcagccttctctcctaaatagaaattgacacctccacctctgactgtggagtcacctccacctccaactctgatgaagcttagaagtagtggctctttcattgctgatggtgagtggtgtcagggtaagagtgagaatgactcatttcagtgaatgaagagcagtaacaccctcccaccattcaattagttttattgtgctggaggcaggaggcacggttgtctttaagacccacctgtatgtattggtagagaagctcaattaaagaagaaaaaggcccacctgaatgatgttcactgttcattgcaaaaggttataatatcctgattaaattgtggtttataatatcctgataagggacatacaaagaaactgtgagaacacagagaatcgcttactcccatcttggggatgttcagggtttagaatgggtcttgggtgaaagggcgtttgtttaagctgagccatgatagatgagtaggagttcagcaaaaaggtgggagagtgttgggtatctagaacgtgtccagggtgac

SEQ ID NO: 170834 - DNA, 154 bp, Homo sapiens
accaggaggtgtagacacctagtcgcccttcccggctgtctcccatacgccggtgcacaccacgcgttcccaagatgcacatccctttattaccgtgcgtcacctcagtctcccacttgctttggtagagtctagaaactaagaatttgacccc

SEQ ID NO: 170835 - DNA, 533 bp, Homo sapiens
tggctactacacctaagactctccataaaggtcagagcgatttacactcccacccacaggtatcagagttcctgtttccccacacctcagtgtgtttgttttcttagtgcatttaagttagaaaagaaatggggagggatacagaataaagcgttatctagaactgtctcccgggcatcattccacctgagtgcttagaaagtgcctagcaaatgtggcctgaccttttgatgggacacaactgggcaagtgacagggctcactagaggtagtgacacacccctggccaccccaacacacctttcttatttaattcgttctcagcttagcaccacagaccaaccccaactctgactgacctgctcagggtggtaaccggaaagttaaacaactttggttttcctgaagatcgacaaatcattctccagtctcacaaagttccctgcacaaatgaaccggctttgaaagccactagcgtacttgataagcaggtcccaaaagatccagaaaacacttcggggtttttcactgac

SEQ ID NO: 170836 - DNA, 672 bp, Homo sapiens
ttccaagtgaggctgctcatgcatctgtggccttcatcctggtcaaagtattttggaaaactaaatgctctttctgtccaaagtcatctggccacggaaatgcttttccttctattttgagacaaaataactagagtagaaaaatagaagatcttgggtaggcagagtatttttttaaactttttattgaagtacaacatgtgtatacagagatatgtacgtatcataagtatataactcaatgaattttcacaaaccaatactcttgtaatgagcacccagatttttaaaaaagaacattatcaatccccctagaattccctttacattcctttccagtgattacaagaaaagtactttcctgactacgaataacacaggttagctctgtcagttttttggcttatttcagtggaatcatgtagcatatgtactcttttgtgtatctggctgtgagatttattcctcttcttattggttttttcttttttcctaaaagagactgcatcttgctctgtcagccaggctggagtgcagtggaatatcaaagctcactgtaacctcacactcctgggctcaagtgatcctcctgcctcagcctcctgaatagttgcaattataggcacgtgccactgaacctagcttattcttattgttgaaatgtagttgtga

SEQ ID NO: 170837 - DNA, 337 bp, Homo sapiens
ctagccaaactatctctctgttgtctttccactttatccatctattttttactttttttggaaacacaataacaatagtgtagaagtcttttcacattgcctgactctcctgtttgtgtcccataaggttccatgtactctgtccagaactcagcttattatgtcaaaggattctgtctggactggtcagtcagagatataagttctcattacctcagtgtgtgtgtttgtatctgtatttaatgatgtttgtgcttggcttaggctggggattttgaaatctttgcagagtttcccaatttgttgggcagttttagaaatgatagtatcagtagga

SEQ ID NO: 170838 - DNA, 377 bp, Homo sapiens
ccagaggctcacagttggatgagaaggcagacctataaacaattattatgcaagaagctctgaaacaaaggaacccatgacatttcttagcgtcattgagaaaagaaaagttaccagagtggtggatgggtggcaggtgaggcagctgaggcttggaggatgaaaacagctcttcagctgaacaggaaaccaaaagataaaggagacagtagtcacaatggaaacaaggcacagaaactgaaatcaaaatttcctcatgaaagggtaagccttatctttgcctagattattgtagggctatctatacagcctctggggtccctaagttcagtgtccctccatagtgatgccaactcacatatgtatagcccccacct

SEQ ID NO: 170839 - DNA, 327 bp, Homo sapiens
tgctgggattacaggcgtgagccaccacacccggctgaacctttctttttttactcattctagaattctagaatgaatggagtgcttactctgtatcaggttctgccatgtactagggataattggggacaacaaaacctgcctggcccctgcctgcatggagcatatagtctagatggaaagaaaaaaaagtaaacaaaactgataatgagtagaaagtgatatgaggatagaggtggctttaagaacacaggaagaggaatctacactagtctggacatcaagggtcagggaagggctcccagggaaagtgatgggataacagct

SEQ ID NO: 170840 - DNA, 755 bp, Homo sapiens
tctgcataacttgtttgatgactaagggagacccatagggccatttcttacagcccacagccaagccctctgtgaagaggaaaaggcaactcttccagcaaggaagtcctcaccccttttcaaaaactttcctagacaaacttgtaggctgttaatgactctagttatgacctcccagcccttactcaggagaaaccactttgtaatgtgggttttcaaccttggctgcacgttgcaatcacctggggatcccccgcaaccgcctgacaaagattctgatgttattggtctgaggtgctgcctgagaattggtgtttccaaagctcctctggtgttttgtgtttttctagcacaagaaaagttgtgagtcactgtagtgcaatacagttcgatcacaattgccacaattgtgtagggtccatcagaaccacctgaagggcttcatagaccacagctggctaggagctacccctaggcttctgattcagcaagtgagaggcagagcccaaggctgtatatttctaacaagttccaggtgctgctgctgctggtccagagaccactgcattagaggccagagttctcaactattgactgcacattagaaccatctggacaatatttaagacatactgatgcctatacaccaacccagactaactgaatcaaaatctctggtaatggggctccagagatgttttttaatgctcccaggggattctactgtagagcaagttgagaaccacttgtaagca

SEQ ID NO: 170841 - DNA, 279 bp, Homo sapiens
tgtccaaagctagtcccaagctgtggggagatgggaaagaggctgccctgaggaagtggtgcatgagctgtgatcagctgcgtacacaaaggccctgaggcaaaaaaaaggtggatggtcagtgagtgagactgagcatggcaagagtggtggctacaaggaggagggatggcctgggatgaggctggggagacagtaggctgtgaacgctgggatagtgatagggagtttggattctactcaagaacaggggttggcattgggtactacgctttggca

SEQ ID NO: 170842 - DNA, 676 bp, Homo sapiens
acagacacgtttccacttctaccacagtagaagagagagacggatggcacctgtcactatggccatgggcctcccaccgccttccctcacagtgggtctgtcacctaaacactctaccctcctggaagctacaccacagccatcgctaccacaagcagagcacaaagaatgggctatacctctacagggcagtgcagaatgagaaataggaagaaaaaggcaaatgaggttcagatatagacagcccctgcaatccaagcacccaagtctgatccgtcttgcctacaaatgtcccctctttggtcccctctttgacataagaaagaggaagtatgagggctctcccaggctacaccgtgaatgtggaagaggaagaccctatttccttcaagggcggcgagcggaaggaactcaggccctgtgcacttcactgtgtctctccacaccccggcagattaatcaccagggtgttgtctagcaggaaaggtatttccctcttccctttgatctctccctctccctgcccctctctgccaattgctccttccccacccatcaggtattactgtttgtggacaagtagttgttttcataattacctgattgttatgagggacaggatcgttatgagggactttgaacctgatgactctaaatcttgacagagattgatgtg

SEQ ID NO: 170843 - DNA, 146 bp, Homo sapiens
taacttatgaatcctttcacagagaaaataggtctgaaagcctttaaactgtaactccagactaaacaaaattatctcattttgatattcagaaaaacggaaggcatggcagttagacgatgcgctgatgaagggctgctccacag

SEQ ID NO: 170844 - DNA, 604 bp, Homo sapiens
catgattcacgactgagtctgaaagcagctgtttttaagcacatgttgactgaacagtggctgagagctaagcacttgtcatgactgatcttactggattttcctaataacccatgatgtgagtattattatttccattattattatttttaaatctaacagggaatctaaaccttggcttgggtaacttactcagagtttcacagccaggtcatggccaaagcagaatttgaacttggtttggctttagaacctgggcttttaatcgtacttgatacctactctgaaggcagcagatattgggaatcaagtcagaaggagactgggattcacagccaggatatccattccctgaagatgctgggtaacaagagactaaggcaggaagtgtggatggggagcaaggtcagaacacgaggagtgtctaagagcatctcctacctgggttctgtactgaacatacaagtagaacttcagggacagtaactttgaaggttaggaagagaaacagaaagggaatctagaatgtgtcacaccattccccccttgcttggctgtgaggccttctgaatatctgaagcaaataggttaattaaaacaaaag

SEQ ID NO: 170845 - DNA, 281 bp, Homo sapiens
aagccaagatctgagagtccagaccctcctgtgtgcaactgaaagccaacttttcaaatgagcagtactatttagactgctcccatagtatgcaaccaggaattacgtatgaggaaatggtaaattaagaggcatttaggaatggttatgattaagtattttcctcacaaagaaagaatgcaaagtagagaaagctccttgtttctagaactagggaaactttattccacgccagtacacatacattcctatgtttttaagggtaaacgtattaatctttt

SEQ ID NO: 170846 - DNA, 519 bp, Homo sapiens
gccatttctttctgacaggaatcattccgccacaagcgaacgagcctgggctggccttgtggaagcctagccgaggcctcagaatatggatgagatcatctgagaccatccaccccaggaagccagcaaagtggctagaacccgccataccaccgcagaatcacgattgctgttctgagtcactacatttcaggtgacttgttgagcagcaaacgagctgacgaacctaaagtcagaagatgctagcggaagaaacaggacccagaactccattggaaaatggggtatacagacttcgaggatgccagacaaaaagatcatttgaaatattgttgtcactaagccttctttgatcaagacaccatgagctcatgacaaacgcctcaatttccttcttctgtaaataaattaatacctggtgagatgtaaaagcccacttgaacggaaaacaacatgtttgatgaaattctgagagaagatacaacccaaggtatgaaaaattcagaacaaattatacta

SEQ ID NO: 170847 - DNA, 313 bp, Homo sapiens
ttgagtagtttgttgcttggagccttggtcaggagacatttcttctctgattctcagcattattctagcctgtctttcctgaagaaaggagaggctcaaggaaggtaaagtcagagaaggctcttctcaggggatttatagggtgtgctcccagctctgtgaagtatggtggagggcaaagagaggaagccttgtacatgggaagacccgcattccagatgaggttctacttttactgaggggcctccgtcctgctgagcctcaccttcctcttctgcttaaaaaaagtgcttaaaaatactgaccatgcctt

SEQ ID NO: 170848 - DNA, 1038 bp, Homo sapiens
gaactcttaacttccttgtcttgtcttccttacttgtttacgttacctgtccgtccattcaaccagtatgacaaggtccagggctgagcagctgagcaaacaagcaagcaaagaagcaaaatgaaaccctcactttttagaagggggtagagaggcaatgcaatgtatatacttcaacgtagtgtcatattttttgttcctgatcagggtcatttgaaggattgagttatcttgggctagagatactttgttttctctccaatctcaaccaaaaatgtgacatccttgaggctggagagggtatctgttcatctgtgtatccgcaggtcttagcagtgtgggtattcagtgaatgcatgtggaatgaacaaaggaatgaagtgaatgtgagaaacagagtaaggtacccccttctgtaactggggttgtttgtgtttataacttcttaaaaattttgcattaatcagggccactccacttatgaatgaaattgggtgtaattgaggtatagaacgtgggaacataggtgtatgtgtgataagagaccaggactggaggaggggctagagccaagggaagttgcaaaaggcccaaagtcgaaaatagcaggaaccaaatagaaagagcaccctttttcccaatgccacttccctcccatgacttgaatttcctgcaatttctcttcctccctccttcgtcctaattctctatctttggttattcaggagggccagcaccctgtggccccagaagataatgtggcaacgacttaggacacggagagagagcgtaggcagcagtgtgtcatttcccctcaacacccttggtagaatcatcatgtctgtcacattcacaagttcttcttcttctttttttttttttttttagcgttagcagtttccagcatctgcataaaatgatgtataaaatagagtctctgcctgtccttagagaagttactatctagggggagtgaaaggtcaactacagaaaagtgtagagaatgctaagaaagggctgaagggtggggtgtttgaa

SEQ ID NO: 170849 - DNA, 390 bp, Homo sapiens
acttctagtaccacatgtgaagagatactgcagtaaagaagttttaaattaagggctcagaaaaaatacattgccttagtctgttttgtgctgctgtaacagaatactggcgactgagtaatttatgaaaaggccagatacggttctggatgctgagaagtccaaggtcgaggggccacatctggtgagggccttcttgccgtgtcattaccatggctgaaggcaagagagcatgcacaatgagaggcagggaaggaaggaaacagaattcatccttttatcaagaacccactcttgtgataactaacctagtcccatgataaggacattaattcatttataagggcagagcactcaggacctaatcatctcttaaaggttccacctctc

SEQ ID NO: 170850 - DNA, 564 bp, Homo sapiens
agaattcttagttcaaagtgcttttcaaatcatctcctcatttatttctctatcacttcttctaggaagatatttcatcctgatggtatacattgatatgtataccttgatatgcagcctgggaagaataagcagcatgacctggggtcacagatgctctgcgatgggatgagtgggaacacagctgaccctggggtcacaaggacctcagtgatgggatgagtgggaacacagcctgcacttcagacccagatccaagtgtctttatctgagtagaaaaagcagaatccaagacccgggctttgggcatttccagcttccccagatggggaaaagccagtgccaggtggccacgctggggacattcatgacctcagcagcatggaccgtggtcttcagtgaggcctgcttgagagacggcttccgttgcagtgttgtgggcaggtggggcggtggtgactggtaggggggcagttgtgaaatgtacctggaaagataggcgtttatgggttcaaaactgtcttgtcaggagggaaccaagtgtgggtcagaacaaggccacgg

SEQ ID NO: 170851 - DNA, 662 bp, Homo sapiens
cgagagaaaagagctacaaagagaaagaaccctggagatgtgcagagtccccctgagtataccatacgtgctattcagcacgtacacgtgactaagctttcagagcagaaaaagaaccatctgaaaggaatagaggatttgtagaaaccattccaggaacagtgcttgatcccaacaaccagactggagaaacccataatttgtgtggatattagtttcctgaggccacaaacttggtggctaaaaccagtagaaaattacttgctcatacttgtagaagccagaagtccacaatcagttttactgaggcaaaatcaatgtgctagcagggtcttgctccctccagaggctctaaaagataattacttattgcccctttgtttctaggagctgctggtattccttgacattgggccacatcactggaatctctgcctttatggctgcattacctcctcttctgggtgtcaaatctacctctctttcttaaaaagacacttgtaattggattataacccattcagtagtccagaataatttccccagagcaagatacttaatcacatctgcatagactccttttccttgccaggtaatatttgttggtccagagattaggacctgatatccttggatggtccgttatcagccactactccaga

SEQ ID NO: 170852 - DNA, 441 bp, Homo sapiens
atccaaacctgggtaaatctgcattgtgtatagcagtggttccctatcaagggcaatcagatgtccccccagtaggcatttgtctatgtccatagacatttttggttgtcacaattggaggtgggttggggtctgccatgagtatctggtggataaaagttagggatactgctaaaggtcctataatgcacagggcagcctgtacaacaaggaattaggcccaaaatattaattgtgctgagatgaaaaaacatttttatacagacaatattgttactccacagctttctgttttcagatgttaagagtcctgcaaagttcctaactggtagtataaagcttaatatgtgctattaaaaattgcatgaaccaatatggctttttttttttttttttttttgaggcggagcctgggcaacaagagcaaatctccatctcact

SEQ ID NO: 170853 - DNA, 555 bp, Homo sapiens
atccaaacctgggtaaatctgcattgtgtatagcagtggttccctatcaagggcaatcagatgtccccccagtaggcatttgtctatgtccatagacatttttggttgtcacaattggaggtgggttggggtctgccatgagtatctggtggataaaagttagggatactgctaaaggtcctataatgcacagggcagcctgtacaacaaggaattaggcccaaaatattaattgtgctgagatgaaaaaacatttttatacagacaatattgttactccacagctttctgttttcagatgttaagagtcctgcaaagttcctaactggtagtataaagcttaatatgtgctattaaaaattgcatgaaccaatatggctttttttttttttttttttttgaggcggagtcttgctttgttgcccaggctggagtacagtggcacgtgatctcggctcactgcaacctctgcctccccggttcaagcgattctcctgcctcagcctccagagtagctgagattcaggcgtgccccaccatgcctggctaattttt

SEQ ID NO: 170854 - DNA, 548 bp, Homo sapiens
ttcctcggacaggtctacctggcctgcgtcctgttccaagtattattttgcagattatacttcgtaaaacctcaacttttttcgccttcttcctaaacacgaaccttcccggagtaaattcacgccgtaaacacacccagggctttgttttacacacagatttctccccctggtcccgagagaggttgcttttccttctgaatccaccgaggccaactcctgccatctggggtcgcggcttcctccgccgccgccgccgctgccgccgtgcggattcgcccgggttccgggtggcccgcgccggcccgcggctcgcaccccttcctgtctccgtctgcccacggcgggcggcgggcgcgcggcgcccagacaaaagctcgggccgtcgggcccacgggccccgggagcgctccagccccgaagccgagggtcctggcacaactttgcgaacgcagaggcaggaggtgccggcgcccgcggggtccgggtgctcccggggcagccggcacgcgcgtgggccgcgggcgagggcgccgggggagggcgcg

SEQ ID NO: 170855 - DNA, 535 bp, Homo sapiens
aaccgctcccacttggttgcggtggttcggggcagggagacgacgcagcgcgagcggaaagggcggttacccaacggccttagctctcatggcgtcctccgtggtgttacctaaaaataaagttatttgtgattagaaggtaatcgcctcctggtcatgcttccgctggtcaccagtgtctgcggggcgaccccatccttgtggccagagagggcctgtggctgcgctcaaggcgggagcggtccttagcggggccctgcgggaacgcccaggccgcgctcctttcccttgctcgcctggccttgaagtgaagggggaggtttaacaatgcagtgggaaccccaaagtttgtctcggccgtgctgctcacattccaaacaatgcaaaaggttgaggaaaacctcagcagttgaaaccgtgatgcatttcagcaaagaagtagctcctgtcctcgtaaaatcagtgaagttctcacggacgacctcattgagtgagttgtgaagcttgttgccttaatcagaatgatcagccagca

SEQ ID NO: 170856 - DNA, 520 bp, Homo sapiens
tcatagcaagcagtggagaattaattaagaaggtaaaagtgatcacatttctatgaaaaattccacagcaataaagaccagtgcagaaaacaaaacaaaacaaaacaaaacaaaacaaaacaaaacaaaacaaaaacactgagccagaatctgtgcaatgttagtcgagttgcctctgtggggaatattgaagcttttctgtgcccttggttggggtccaagtatgctttctccagcctcctgcagttgtagcttgcagatggtacaaaggttgggttgggagccttattgcaatccttgggaagccagttggaaaggagctcttcatcctgggcatcatggtcactgagacttaaacactgggccattagagggggggggtgtttattttttaagagttaagatgtttttttcttgtggtcaactaaagtgctccgtaacccaaatttcagcccagagtacatgaggcattttatgagtgtgagtagatcggctaggttaaaaagaaaaaaacaagcaa

SEQ ID NO: 170857 - DNA, 310 bp, Homo sapiens
agagggaagaggaggagaacattccaggcagaggctctgaggggagaaagagcttggagtgttggagggagaaaggagtgagggaagtggaatggagacaggaggtggggagacataaaatgcctggccaggggtaggcgtcaggtcatgcaaggctggacgggccatgggaaggaattctgatgcgaaaggctatgccaagtcagaggcttttgaaccagaaggctctatgatctgattttctttttcaaatcctcaccctggctattgtgagcttggacaacctacctagtacaagtggggagaacag

SEQ ID NO: 170858 - DNA, 403 bp, Homo sapiens
ttttcaccattgtccctctctggaaccatcgaaaaacttcctaactggatcccttgactcatacatttgccctttgagtttgcccacagactaattttccaactagcatacgagtaaaccctctgaaatgttaattcagatcacatctctcctgtatgaaagcttctaaagttttcccttaacactgaaacgaaggggaaattataatttgacatgaacatgaagaccttttcaataaagaatgctaagaacaactaacttaacattattctgaatgtttcagaaaaaatttggtgaagaaatggaaagagttaaacttgtaaaacaggaagtaatagaattacttgcagatgattgtgacatgagtctgcttggggaaaataaaagaaaaacaagaattact

SEQ ID NO: 170859 - DNA, 225 bp, Homo sapiens
ctctgagaagtactgcagttggggaaaaaaaataactctcatgttcactttaattccatacttccccagttttttgtgtatagtctctcttcccccaaaacactttttttttttttgagacggagtcttgctctgtcacccagcctggagtgcagtggtgcaatctcggctcactgcagtctctgcccgctgggatccagcgactctcctgcctcagcctcctgg

SEQ ID NO: 170860 - DNA, 735 bp, Homo sapiens
gctggaggcaccagagaccccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagacca

SEQ ID NO: 170861 - DNA, 872 bp, Homo sapiens
gctggaggcaccagagaccccaagccacgagctgaccgacgcaccgaggagctctctgtccgcggtcccgcaggttggcggcactggagtgggccgggcaggctctgcctccgccgcagagagcgcccggactgcgtggggctggggaagcatcccgggaacggcgggcggtgagcattccgggaaccatctctgggctgtctggggcggtggagcaagtctggaggcgggacgtggggcgagtatgggagccgccacctcgagacgtcttcccgccgtccccggctccaggagaccccacggacgcaagctgtggagctgagtcgggttcagacaagccctgctgaaatacagggagaatttagaatccccaacactaaccctgtggtgatttgctgtaaactctgtcagcgcttgcactttggtcaagaaaactcaggccttctctcagctccttggcctactgccgtggccttggtgcccccctcctctggtggtcagctcagggcttcctctgcccatgcagtccccagctgccactgctgagggcctcagtggccccctctttggggcctacacgttccccaccttcaagtttcagcctcgccatgatagcatggactggagacgcattagcaccctggatgtagaccgcgtggcccgggaactggatgtggccactctgcaggagaatattgctggcatcaccttctgcaacttggaccgggaggtgtgcagccgctgtgggcagcctgtggacccggcactgctcaaggtgctgcgcctggcgcagctcatcattgagtacctgctgcactgccaggattgcctgagtgccagtgttgcccagctggaggcacggctgcagacca

SEQ ID NO: 170862 - DNA, 853 bp, Homo sapiens
gaatttgctctctgcctcactgcctgagctggaacatttgtcttctgtcctcagactgggctttaccccatctactcccaggatactcagaccttcagactctggctgaattataacactgactttcctgggtctccagcttgcaaatggcaggctatggaacttctcagcccacaatcacccttcagggtagaccgaggagagcacctccccttcctggtgaagggagcccgatacacgctggtgccggctggccaagaaggaggtggacaaacctggcgaccgctccctggcaccacctcaccagaggacagctcacacctccacaggggtcagaagaaaggagctgccctggggatggctgtgtatccctacaactgccaggcacatgccccttgaacacccgatgctacgtgtcccaaaggaaactggtctccacccacccccggcccgtcctcgtcctgggtaccccaccttagtaaatggcgccaccatctgcccggtcactcagcgagaaactcaactcctggcagcagatgacgggcactctggttaaatgactctctccagcctccaagttcaacctgcagggaagccctggaaatcctgtctccctctgccctgcctctccttcagctccgaaccccaccccactcagtacatggcccccaacaggctttcaaatgtctgccttccccaaaccaatctgtggttttaaaagaagtaaggtcaggtacagtagctcatgcctgtaatcccagcactttgggaggccgaggcaggcggatcacctgaggtcaggagtttgagaccagtctggccaacatggcgaaaccccgtctctactaaaaat

SEQ ID NO: 170863 - DNA, 410 bp, Homo sapiens
acacacacacgatctacttacaaacacctaaagagatggtggagaaaacacattgtatgaatcttaagctctctattcctctacacataaaaatgactttcagggaaagccttgcccaccagagttttcagtcactttcttcatgtcaccactgttaataaaaataaaagtgttattggtttaggattccatttcgtgtaagcttcgtctgcagcagttgggggcctttatgcgtgagaatgatgctttttaatgaatgttctgtgggcattttaaatgaaacaatagagattctgggcagtttgatcttgcattttccactgatatttgccttcacctctcagccccctgccaagtccctttccatgccacctcctgcctgctcatgacatccccgctcctctcagatc

SEQ ID NO: 170864 - DNA, 517 bp, Homo sapiens
ctaaaagtatggggctgtccccaaactacctggatttgaattccagctccaccaggtacctgatgtgatctctcagtccctcaatttccccattcataaaatgaagatgataatattgcgtaccacataaggttactggggagattaagtaaattctataggtaaagtgcttagaatactgtccactatttgataactaaaaatgttatctacttcaaaattaaattgaatttggtttaggaatttctcaactttcattgaattaattaaacatatctccccacacccccaactccatgttgatcctcgtcagcaagctgtggggaagcacaggtggagagggaccacagcagacctctgccgccgggcagggagagtgcaagcagcatgtcccaagtgcctgctctgtgcagcctcattacttgtcactatcctggccactctttgaggaaggcattgccattcccattttaaagatgaagctgtcaggaggaggaacatgtccaagtcacacagt

SEQ ID NO: 170865 - DNA, 960 bp, Homo sapiens
  misc_feature (838)..(840): n is a, c, g, or t
  misc_feature (887)..(887): n is a, c, g, or t
  misc_feature (927)..(928): n is a, c, g, or t
  misc_feature (931)..(931): n is a, c, g, or t
  misc_feature (933)..(933): n is a, c, g, or t
agtacgtccaagaccatactactattgagtttcccccactggccttggaattaataaaaactgtatttcttcaatcacattggactttatgtggtgggttactgcatgagccactgcacctggcctgaatctgtgaatttctttttcctttccccttccttttatatgacactgaaccgttagtttcacatgaacattgagaagtcttttttgtttacttaattttattttattttatttttacctcctgcgtgcatgaaatggatggcaaggaaagctttgcttgggcctcttcctgaaatccaagatggcaaatgcaagactgtaaggaatgtgatcgtcatttccaaaggatagagaccgcaaggggcagaacttagcactcatgcatcttttctagactctggctttggtctttgtagtttttgggtaacagcccttctgatagtcattgcctctttttcttaggaatgcctggtgatgtgtatacaatcatctaatcaaagaaggctttttttagagatcctggtgttttttaaatgttaccgttctgttttctagtcggctccaaccagcatgccttggtagctcttggatacatattgggacttaatgatttccatgctttttcaatctgttgctttgggactagtccaagaccatactactattgagtttcccccactggcctttggaattaataaaaactgtatttcttcaatcacattggactttatgtgtggttacttcatagtattgattaaaatcatttcattgtgtgtcatataaagattcatttatgagccactgcacctggcctgaatctgtgaatttcttnnncctttccccttccttttatatgacactgaaccgttagtttcacatgnacattgagaagtctttttgtttactaattttattttattnnatntntacctcctgcgtgcatgaaatggatgg

SEQ ID NO: 170866 - DNA, 772 bp, Homo sapiens
  misc_feature (650)..(652): n is a, c, g, or t
  misc_feature (699)..(699): n is a, c, g, or t
  misc_feature (739)..(740): n is a, c, g, or t
  misc_feature (743)..(743): n is a, c, g, or t
  misc_feature (745)..(745): n is a, c, g, or t
aggacgatggagaagtctgtcgtgactgctgaaatcccaggcgattttatttttacctcctgcgtgcatgaaatggatggcaaggaaagctttgcttgggcctcttcctgaaatccaagatggcaaatgcaagactgtaaggaatgtgatcgtcatttccaaaggatagagaccgcaaggggcagaacttagcactcatgcatcttttctagactctggctttggtctttgtagtttttgggtaacagcccttctgatagtcattgcctctttttcttaggaatgcctggtgatgtgtatacaatcatctaatcaaagaaggctttttttagagatcctggtgttttttaaatgttaccgttctgttttctagtcggctccaaccagcatgccttggtagctcttggatacatattgggacttaatgatttccatgctttttcaatctgttgctttgggactagtccaagaccatactactattgagtttcccccactggcctttggaattaataaaaactgtatttcttcaatcacattggactttatgtgtggttacttcatagtattgattaaaatcatttcattgtgtgtcatataaagattcatttatgagccactgcacctggcctgaatctgtgaatttcttnnncctttccccttccttttatatgacactgaaccgttagtttcacatgnacattgagaagtctttttgtttactaattttattttattnnatntntacctcctgcgtgcatgaaatggatgg

SEQ ID NO: 170867 - DNA, 498 bp, Homo sapiens
tgtcaaacaggaggatggctgtcgggggctggggtctgtgtttctctttcatccgtgttgtgatctgcctgagataggaactgctaaggtgcccacgaattcccaagagacatagtctcatcctcagaggtcacctgtagcaccttcaagaccccatgtatatttcatttcccctagaaggctcccaagccttctggaatattctgcggcaaaatcggtcgcagctagtgcactttgctcatcatatgtatctgtgacaggaactgagtcttaaatctccctgtctggcacatgggtgcgtgagtgatgtgaggtcaccgtctaacgcagcgtgtaattaggtgctgggcccagctgtgtccatccctggctggttccgtctgtaatgcaaagtatagtgttgggcatatggaggcagccggtatacatgcattgattgactgttgatactttccggatgtaaacggctgtaggcggggctttggcttaggttcccca

SEQ ID NO: 170868 - DNA, 418 bp, Homo sapiens
ctacagtgttaggttaaacacagatatgaaaatggtcatactgtgaaaggctgtgggtattaaaaccctatagtaaatttcaacactgttccaatgtcaaataagctcaccactgctctaaatgcagattacaaaactcactgaagactgtgataaggtgactcgtatctgtgagggagtggaggagaactgtttaattttgcaatatgcttaaacaaacttgcacagtgaatcactggttttcaacacaccaactttttatctagaaaagaactcccggccggatgtggtggctcacgcctgtaatcccagcactttgggaggccgaggtgggctcctcgggtcaggagctcaagaccagcctggccaacatggagaaaccctgtctgtactaaaaatacaaaaaattatctaggta

SEQ ID NO: 170869 - DNA, 393 bp, Homo sapiens
cccactcctgccaaagggcagcatccacatgtctcccaccaacacagattcggcagagccagcactgaagcagccttcctcccaagcaccttcgcctcagtccctgctttgccttggaatctaccatcagccccacctgtgctcccaacctcagtgcctccggtgccctcctcctctcaccatcctttcagcagccccaagtcagggatgattcgctcttgcttggaggacccacccttcctcccctgcccactgttcgtgctgtcaccaggaagatctcctgacccagctctgaccaagtcacgctcacaaatgccctctggcagcactgcatccattaaaggcagtccacactttttatgcttgcgcttgtgcttcccacctcctccatca

SEQ ID NO: 170870 - DNA, 432 bp, Homo sapiens
ggtttcaccgtgtttgccaggctggtctcgaactcctgacctcaggtgatccacccgcctcagcctcccaaagtgctggcattacaggcgtgagccaccacgcccagcctccccttactattttgtaagaggcttttgagaaacaatccaagcccttactaccttagttcctcctagagttgactgcacctctcggttaatgttgaagtttgtgtggctcgtcatctctgcctaactatgcaattcattcactgttgtattgggtttttctgtttctttgtctatttgttttaggaaaaaatagcccaaagctcactgtgtaattagcatttagaagctgaagatccccaactgctccagcctctgccgctgccatgctttgagtccacgcccaccagccttgctctcttcaataaaccacaagcatctcac

SEQ ID NO: 170871 - DNA, 259 bp, Homo sapiens
tcccttttttatttaacacctgcagacactgaagcacccaggggctaggtaacaccgaaggcaacacagctgtcaagtgattgactgggagccagggtggggtggggtgcctccagattgaatgtcgataacgacgtggtagctcccctgcgtagttacacacgagtgtacgccaggtatgtctgggacctagaattgccactgcaactggtatccacacagctgcttcagaactaataagctcgctcacgtgggcaga

SEQ ID NO: 170872 - DNA, 367 bp, Homo sapiens
  misc_feature (341)..(342): n is a, c, g, or t
atccacctgccttggccttccaaagtgctggggttacaagcgtgagccaccatgcctggctgctccctgcaaatgttctgaggcacaaaaatcatgtgcaaaaagaatatcaagggcagacatgaattaaattgacataataatggctgctaccatttaacgagagtaggaagggaatgacaccagaagaggacagacttcatggccctgtggagtgggtttttttgtttgtttgtttgtttgtttttgagacagagttttactgtgttgcccaggctggtctcgaactcctgggctcgagcaatctaccctcctccacctcctaaatttctggaagtctnngcaccaaccgcagttgaaagacgca

SEQ ID NO: 170873 - DNA, 695 bp, Homo sapiens
agatttgcagagatatgctcaagcgtgacttaagtgacttaaggctcatgtgttgcctccctatgtcaagcttttcacccagtgagctctttgagaacaggggctgcattttaggacatctcccccagtgtcttcgtagaaccaggcaagacacacggccttgttggaagtgccaaacatctattcttcatcagcagaatggatgagcccctgaaaggcatgagttgagctgcgcagtctgaactcagggaagtcctcgcagcgggctcccaattcctgcctctcaagaagcaagctgagccttaaagatggctgaaaatgtgaacagtctcagggccacgcagacccacctgagcagttgctctctgatgtctcaccgagccatccaccatcccagcgaagaaagggcctgcaagcagaccagaaaatgccccattcagtcatgctgcttagtcatggcccaaacctgcagcgtttaattctgctcactgtgactttattgcaatggcacacacatttacatcactttatgtgcgataacagtagagaagttagttaggtttttctgttttttgtttttttaagataatgagaaaagtctgtaatattcagccaaaatgtatccttgtggctggtgtagatttttggcgaaatgacactgtacataatcagaagaaggcaaacatgcatattat

SEQ ID NO: 170874 - DNA, 415 bp, Homo sapiens
gaccacaagtgcaaagacacagacatgaaatcgcacaatatttttagtgagccatagacgctatttgtgtttgaatttttcctcagtgatgttcttagcatcctttctgtaagtgctcttttattgtggggcttgggcatttgaatgaaaaatctgctgaattccattcatgagtgctgcaaaataacatttttaaattgttacttttttctgatgtaaacatttatgccagaacatcatatttttaaacaaaaagaaatgtgtatatttagcacacaaatgctctgagctcatgttaaaaagaaatctcctttggggatccagaagtgcctccttgaggaaaagacatttgtgctgagctgtgaaagagggctgggcattgtcctgggggaagaggatgtcaggaaatgggaag

SEQ ID NO: 170875 - DNA, 341 bp, Homo sapiens
aatctctgtggttgcacagaattcaaattgcagcaaaaatcattcagggctaaacactggaaaaatctcttaattctaaggtacatgacacaatggactcaaaaacagttgctgagtccctttcactggagaaatttaaagaaagggtatagaaaagttttgaccaattccacccaatcctgcatccccaattccaatctcaaggaccagtttccatctgatctctctccacctacagatggtggtcctgaatctccaaatcaacaaaccaaaaactgaatccatcatcttctcacacctggtttttccttccaactccctcatttctgtgacctgcccca

SEQ ID NO: 170876 - DNA, 409 bp, Homo sapiens
gaggtttaattgactcacagttttgcttggctggggagacctcaggaaacttacaatcatggtggaaggggcagcaggcacgtcttacatggcagcaggtgagagagaggggatgtgtgggggaaccaccacttataaaaccatcagatctcatgagaactcactcactatcacaagaaaagcatgggggaaacagcctccatgatccaatcacctctcacccggtccctcccctgacatgtggggattacaattcagattacaattcaagatgagattggggtggggacacagccaaatcatatcacattccaatcccttgctatgtcttcagacctaattctactcattgctcttatattaatctccattactgctgtacttcttgcaggatatgagcatagcatat

SEQ ID NO: 170877 - DNA, 459 bp, Homo sapiens
gagaccccggcgggggagcctaataatggcaggtaacagtcagcacttgccacgcgcgaggcatgttctcagtgtgtgtcttgtgtcatttctgtgatgcttgcacatcgtcagggggtacctaccactggaacctcctcttttaacaaatgaggaaactgaggcacacagcggttaagggacttacgctaggtcacacagcagtagagctgggctggggcagggggcagctcctcaagtggaacctggagagcccacggggcaaatggcggaggctggaggggctggcaagggagggactgcaaagggcctcacaggggctagacgagggccctgggcaccagtgattatggtgcccccccatgtggattgaagattaaacctcgaagcaagtgtataatgcccccaaaaatcacatttagaagtcatcacttcaataaaaatttctatattaaataa

SEQ ID NO: 170878 - DNA, 365 bp, Homo sapiens
tctttcaaatcgatgacctgacagcatgcagcagtggagaagggccacattagtcatcttacctaatgcttacatgaatggtgacattacagaacttcacctctgtcactctttcttattcgccccctttgtatccttggaggaatttttaaacactctctgagtttttaatgtttttcacttaaatgtattctctttcgcttggcaagatacgttcttcttaatcttcatctcttctttctcttctttttatgcatcttaagtatgaaagttagtaggtgcccagtggtgaagtggctggcctcactgtcgggtcatgtgccttttgcgtaatagatactcaaaaaatatgtgactgaaattaa

SEQ ID NO: 170879 - DNA, 509 bp, Homo sapiens
ggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacacctacctcctgctttggtggaagagggtggagatcttcaaaatcaacacacagagttggaaaccagaaaggaggccatggctgttaaggtgactttatgccccatcaaacagacgccggcttgcggaaaaaaaactcagcctttaaa

SEQ ID NO: 170880 - DNA, 313 bp, Homo sapiens
ctgagttgttactcactggcctagggcccttgactgactgtagggcaagcttccagagctctgttacccaggctggtcttgaattcctgaccttaagtgatccatctgtatcagcctcccaaagtgctgggattataggcatgagccactgcgcctggcctccatccagcctgggcaacagagcaagatactgtctcagaaaaagagtaattaaaaaaagactctcttagaaaaatttttttctttcctgcgtttattttttgcctccatttcatggtgatgggaataataaattttttttcttaaataaaaa

SEQ ID NO: 170881 - DNA, 372 bp, Homo sapiens
aactggtctggacacatggcaggcttttaaaaattttatcatattgcaaaatcaacaacagtgtatagatacggtttatatttttgtcttcccatatcattttcttttgcaaactgtccccaggaactacccccaaggaaatttttaattaaggaagcttactttccattagtgtttgcatatgacctgaactgaccaatcagaacaccctatcaccctaggaacagttactggtccaagggtgaatgtcatgtggagcccaagtagagccaagcatagtcattttgagtggcttcctgtagatattcagtatccttctgaaattgtgagttgtgctgcactatataagcctagagctaccaggaccatcct

SEQ ID NO: 170882 - DNA, 475 bp, Homo sapiens
catatttatacccacttttaactgcgtgcagatcaaggggtggtttatgtggacatttctagggaagcggcagtaacttttgggtcatcaggccattgccatggaaaggggtggtaactcccaggtgttgccatggtgatggtaaactggcatgatgcgttggtgggcgtgtcttatggaaggctgcttcctccctgaccctgttttatctagtcctcaatttggtcttgtgtctgagccccacttctggagtcaagttctgcctcttatctccatttctccaactaagatctacaaatggcccatagcacacaaaaagatgctcaacatcattagcctttagggaaatgtaaatccaaaccacaagaaggcaccacttcacacccacaaagatggctacatccaaaagacagacaggccagcacggtggctcatgcttgtaatcccagcactttcaatacagtcagcaccacca

SEQ ID NO: 170883 - DNA, 287 bp, Homo sapiens
agtgtagcctaagagttaagagcatgggcgcttccctgagctggaatcccaattctgccagttcccagctgtgtgacgccgggcagcttatttcacctcactgctctcagcatcctccagtcacagtgctggcctcatggggttgcagtggggactaagtgaagatgcagagaagcacttggggacagtgtgtgtctagaatgtactgtgtacatggtagtcatcactgtaccacatcctcatctgcatcatgatatttttaaagtgtgatactctcgaacccgggc

SEQ ID NO: 170884 - DNA, 119 bp, Homo sapiens
caaatttcttttgggaaaaaaattaagttacaattatagcaccacagcaatggctacagttatagctaatgtaccaccaccaaccaatttgtaaagcagtgccatacaccttatttgtt

SEQ ID NO: 170885 - DNA, 266 bp, Homo sapiens
tgctgggattacaggtgtgagccaccatgcctggcccagcaactactcttaactttacactagttttcttcttatagctgcttactcttatacttaaaaatctgtagtctgcatatttccgagaaaccagtcgaaaccaaaaccacttttcccagcctcaaagatattaaatagaggagctctgattttaacccatctgttctcaatattgaatgctcttttgggaagagttgatgcataggatatgaaattgaacagctatttag

SEQ ID NO: 170886 - DNA, 374 bp, Homo sapiens
ctaatggaaccatctgggatcagcagattttaagtccctgaaggctggaaaagacttatacttggctttataattccccacaaagtcaggcccagcaccttgcacttaagtgtttattgaataaaagagtgacttgtgtggaagttattcattctgctttagctgtttttgtcattcattcccttttaactcttgtagtttgttgtgactttaactttcttacgctttttttgtggagctgctcgataaatatttgacataggtattatgtcattttatggctcatccagtgtcacacaagtagtaaatggtagagccaaaactcaaaatcaatgtcagtggattctgaaggtaggtgctttctggtacgctag

SEQ ID NO: 170887 - DNA, 599 bp, Homo sapiens
tgaaatagtcatttgtgaattcagacagttgtgttagcataatatttctggctctaggccttaaaaatactaacttaaaatgcagaaaccttatagcagttcacctgatgaagatgtgaacaccaaactgattatgaaacaagagtaggttctttaatgaatgtgctctgtgtttaatacattctttctcccttgccctgaatataaaagtcaggcttaatgctcaagttacacacaggtacaaaatttctatttttaatatagttttttcactatccatagtccacatactaatagtcattaagaatcaaaactatcgggccgggcgcgatggctcacgtccgtaatcccagcactttgggaggctgaggcgggcggatcatgaggtcaggagatcgagaccatcctggccaacacggtgaaagcccatctctactaaaaatacaaaaaattggctgggcgtggtgacgggtgcctgtagtcccagctactcaggaggctaaggcaggagaacagcgtgaacttgggaggtggagcttgcagtgagccgagatcacgccactgcactccagcctgggcgacagagtgagactccatct

SEQ ID NO: 170888 - DNA, 547 bp, Homo sapiens
tgggaactgtactttaagcaggacatagaaaacctgagactcatccagagtaggatttccaggtttcagtgtttcgtagagcaagtgaaatttgaagtcagaagactttaattcaagttttgcccctgctgtttagcacttatgtgaccttagacaattagtctctgtgagacgcagcttccttatctgtacaatgggggtaataatatcaatatctaacaggattttgaggattgaaaataaataattaactttatcaaatgtaaagtgctgtataatttttaatttactgatgagtctggaaaacatgtgagatgagccaaaaagtgaaggaaccagatatattttaaggaataaagatttctggacacatgtgataattatctttgaaaattttaaggtctgatatgtggaaaaattaagtttgctttgtttgttcctgatggcactgtgaccaatgtgtggatgtgtcatgagggagcatattggctcaacataagaaaggattttataatttcaaataaaagggagcaccacgagttataga

SEQ ID NO: 170889 - DNA, 382 bp, Homo sapiens
ttagggtgctactgcttatcagtttcacttctagctctgtgccttatttttctagttactgtcaaagttagtgtcttctgttatgtaaaaatgttcgtaatttattagtaaaaactacattgttcagcacccagcagatggtgggtgctaaagtggaatgaaaagagttaccaaacaaggaatacaaaataattcctatcttggtatcatttaaagtgaatctatgctagaaagattccataaagaaaaaaaaatgaatctatatacctacatatacagggaatctgaagtaatttttaaaagcaatgtcagaatggttttcttttcttatggccaagtaggcttttactggacctgaccttcctgcatataactcggacaa

SEQ ID NO: 170890 - DNA, 563 bp, Homo sapiens
gagccactgcggctggccaagatgctttatattcttttaaaaccattgttgtgtctatctgttaactgcacaaatatttaccaaatgcttaccaagagccaaggactagacttggcactgggtagaaactagtaaggcatggtccttcttctacatagaatcttagcattttagagatgagttcccagacatggtccagaaggtcacagttcacaccattaggcaaggcagtatttgaaataaaagtcatgtctaatactaaatccagtatgttctctccttcaggattttactctcattgctgccccttggtttgctatgctcttccccagacagctgcacagctcatttaatttagatctcatttaatttagatctctcaattaatttagatctctgttaaaaaaaaaaaaaagccctaggcagcaaggtctaacatatcatcctcaaattaaagagaaagccctttggtgttatttttctttatagcacttaccaactcccagtagaatgtaaactccagtagggcacatatctttgcctcttttatttactgctctatt

SEQ ID NO: 170891 - DNA, 253 bp, Homo sapiens
cttatgaggtcctgccttgtccttaacaacctctaggatgcaaactgccctaggaaaagcatcgaactgtctgcatgcctgcgaagcaacatcaatgatttggggttctggaaccaggtcatagccagcaagtgtgttcaattctttatgcaattcccaggcatctatctctggcttgttgaagcatgtcacccagcatgcatcaaactcctcatctgcctcatgtgaaccacggaagcagcagcaaactgac

SEQ ID NO: 170892 - DNA, 490 bp, Homo sapiens
tggctgctccggcccttccgcctccagctcggccatggggtcgcgcagctcccacgccgcggtcattcccgacggggacagtattcggcgagagaccggcttctcccaagccagcctgctccgcctgcaccaccggttccgggcactggacaggaataagaagggctacctgagccgcatggatctccagcagataggggcgctcgccgtgaaccccctgggagaccgaattatagaaagcttcttccccgatgggagccagcgagtggatttcccaggctttgtcagggtcttggctcattttcgccctgtagaagatgaggacacagaaacccaagaccccaagaaacctgaacctctcaacagcagaaggaacaaacttcactatgcatttcagctctatgacctggatcgcgatgggaagatctccaggcatgagaaggctggggggttctctccctctgaatggtttgggggtacccggtgggaa

SEQ ID NO: 170893 - DNA, 241 bp, Homo sapiens
cgctcacaaaaacaaatgcgacactgtgtaatcgggaggagtaattctcagcattaggtagtcctgtgttttgaagacctacttgatgtcaagtattgttgatcttcacaaaggaatatcattctcgttcctatcatgcagctcatatgccaccattttggtggcttttaccatttgccaggccttgccaggtcgggcttgtccgctcggaatataatgcagccacacacataactttaaa

SEQ ID NO: 170894 - DNA, 296 bp, Homo sapiens
atctttactctgtcctacctctcattttcaatcctgtttaaaagacgtttaagtgtccaaactttaacctcttgaagctagtcctctccccactttccatctttaaatgggcatatatacaataaaggctctgtccatctccatctcttatatataacaatactgtgacttaaaaaccaactcagtattggaaattttctaaagttctgtcctagagttctttcctgacctctagctccatacttctgattgcctaataaatatgacatggatgttcagtggaacttcccatctat

SEQ ID NO: 170895 - DNA, 238 bp, Homo sapiens
ctcgcaggctcagagagattgtgtagccagcatcggttcacatcattagcaggcagcgaagttgggatttgaatactgtgggcacctttcatgtggcacactcctccccactctgagtcctcctctttcttccctgggaatgagtagcttgcttcctaacaagctccagggctccagtgtccccatggatcctcccacagtgctcttttgcacatggacccctccactcccagttcag

SEQ ID NO: 170896 - DNA, 545 bp, Homo sapiens
ccctcagcagcatattaatacaggtgacacagcagcttggatgaacgcaggtctccccctgaggccccttaaaggcatgttcagatgattttcattatgcagagtgacttcagtgatcaatcgtttggtttttaatttgatgttcttaaccagatttggatgccgtgcacagaatgtaatggatcaaagtggcaatgaatagtggtaatagggacatgcattccatcttttttttgaaagacaaaataattgctcaatggcttgttctgccccaaacctggatacctatttggtcagaaaagtaaagaagaatgtatttctcaaatatcagccttaaggttcatttatcctgggcatctggacagccccctggctgaaataaggctgggaaagaacaatcactttgtttgtaggaaacttggaaggtcaggggactgctgtttgaaggtggtggagggtgatagagtcaactcaacactgtgatcatatgactgggttgtaatgtgactatggggaaaccacccaacctctctggtccatggttt

SEQ ID NO: 170897 - DNA, 194 bp, Homo sapiens
tgggttagtgggctcagcgtcagactttacactggtcttctctgtgccaaccaccctcaggtggagggagctttccaaatctgtcatggagtttggggtactgctcatcgtgataacaatttttatgggctcatgtagactcagtgggtctccgggttgagaagtatcgatgagagtaacagctacctcactat

SEQ ID NO: 170898 - DNA, 573 bp, Homo sapiens
aactccaacaaaataatttttttttagagacacagtctccctctgttgcccaggctacagtgcagtggcacaatcacgagctcactgcaacctcagcctcctgggctcatgcaagcttccagcctgacgctcctgagtacctggcactactatgcctggctaatttttttttgtattgttttgtagagacagggttttgccatgttgcccaggctggtctcaaactcctaagctcaaacaatccacccaccttggcctcccaagtagctgggattaaaggcgtgcaccaccatgcctggctaatttttgtatttttagtagagacggggttccaccatgatggccaggctggtctggaacccctgacctcatgtgatctgtctgccttggcctcccaaactgctgggattacaggcatgagccaccacgcccgagcgctttattctttgttgttgttgtttgtttttaagagacagggccttgccctgttgcccaggctgaagtgcagcagtgcgatcgtagcttgctgtagccttgaactcctgggctcaaacgatcctcctgtatcagcct

SEQ ID NO: 170899 - DNA, 149 bp, Homo sapiens
  misc_feature (34)..(34): n is a, c, g, or t
ctgcggtgattctagaggaatccccctcccaagngatgcagaaatttggtacgcagagaaaggggaaataaatataaataaggacttcacaaaaatgaaagaagcggtgaattcctagagggtaaatatacagaataccaaatcagttc

SEQ ID NO: 170900 - DNA, 456 bp, Homo sapiens
  misc_feature (48)..(48): n is a, c, g, or t
aggccggaccagatattgctatgcaaggaggctatcataatcagactntttcataactgtaagactttgttggcagccgtggtggctcaccctgtaatcccagtactttgggaggccaaggtgggtggatcacctgaggtcaggagttcaataccagcctgacggatatggtgaaacctcatccccattaaagacacaaaaattagccgggcatggtggtgggcgcctgtagtcccagctactcaagaggctaagacaggagaatcgcttgaacctgggaggcagaggcaattgagtttactggtttttatgtataccaatttgatttgggtttaatttccatttaagccttaaatttggctccaagtaatttttctctaagaatcttctctctccataacatgcttagcacagtgtctagcagttgtaggtactgtaagtcatagaaaatatctg

SEQ ID NO: 170901 - DNA, 384 bp, Homo sapiens
ggctcctctaagcagctctcactgatggactctgccatgagaaaagaccctcacactaacttcaacccttcagggccccacagtacctatctttgtgtagttgaggctttttggagcattctttaatgtacagaaatgagttgcaattttgtatgtgcgcctgataattacgaggccacacttgatgttcaggcataaagaaaaggagatagcagcttcctaactttaataattaaaccatatcagagcagtgttccatggtccagcaatgtgttttctctaacgttcagttgtcccccatcttaacacaaatgtgaaatgtagttatctgcctccaaaccatggtgagccctacagtgcaactggcaaaaatgatcacgacag

SEQ ID NO: 170902 - DNA, 216 bp, Homo sapiens
agccaaagggccttggaggccaggaccatggctcatgctcatctatacagagtatacagaagtgcttagtaagtgcttctctgaatggctgttgggaggggagacctggcgtcagcgccaaaactcccgacagccattgccacactccctgctgctccatcctcagggactgggctcagtaccacaaagggtgaggctgggggaacatgtcagcac

SEQ ID NO: 170903 - DNA, 461 bp, Homo sapiens
ttacatagttttttaaaaatagagatggggtcttgctttgctgccctgactggtcttgaattcctggcttcaagcagtccttccaccttgccctcccaaagtgctgggattacaggtgtgagccactgtgcctaaccttcattataatttatttaaccagtttcctgttgatggactttggggtttccggtttttgataatacaacccgtgctgccctagccagccctctgcatcgatcttgagtgttgagtgagtgttttcacttaggttgctagatgagaaattgctgaggtaaagggactgcttagaattttgatagatgtcaaaagttcataccatttatcctggtcctctagagtgagtgtgcctattaccttatacaaagcatttctattcccagcttccatctgattagcgaaaaatagcatcttattttcatttgccattttttgctggtgac

SEQ ID NO: 170904 - DNA, 358 bp, Homo sapiens
ggcatcagccagaaggcgaggctgtgaaggtggggcagtgggactgccagccttccctcgtaacccccataacccacagtcccatcgtgggaatgctgcttctccacatgtctcctctgtgtgccagggcttatcttctgtccctagtggacagaactggtatcttattagctgtctctggacaacaaatgggaagatgattgggaaattttagtttttaactacttctggctactagaaaatgaaatgctatcattaaaaatgagatatcctcaagccttatttatttattatttgtttatttgagacagggtctcacttcactccagcctgggcaaaagagcaagactttgtccca

SEQ ID NO: 170905 - DNA, 197 bp, Homo sapiens
ggagtcacaaaccaagcatcacgtcaaaccacttggagagcggttttaaatgcatattcttgggtaccgggtttactgaattagaatctttggagccagaaacatattttatagcctcccacccagatggtccttttctaacccagggtttggagaacaggtaaagcggctcaaaagaattgtctggagtctcggcg

SEQ ID NO: 170906 - DNA, 161 bp, Homo sapiens
tggaaggtggaaggccgggatagaagctggagaacagggaggaggctggtgccagggtgagaggtgatgggggcttgggacagagggacagcaatggggaaagagagaagtgatggattccttggatattttgcaggtagaaatgacatgattagccagac

SEQ ID NO: 170907 - DNA, 248 bp, Homo sapiens
gtgaagttaaaactaactctgtattaataatattccgggaagtgctcccctctgtcaacgttttgctcatgtcccaagtgtccccacggcattgccacgcaacacaagagaggatgcacattccctccatttaggcagcagttcaacagaactaacgggagagagtaagtcaatctttcaaaagtccaaaaatcctcaatccccattctcaattcagaccaggttcacagtctccttccccaccagag

SEQ ID NO: 170908 - DNA, 403 bp, Homo sapiens
tgctaaagtttttttgacgatgaggtgtgatgaggctgtgttattcctgagggaatgaatcagcattgtcactttgtacaggaaagtatcccagggttgttccgggccccagggcattatcaaaattacagccttagttagtttggtttggctagggatcatgtaagagaattatcttcccagcatgcagtaaaggaatccttctaataacttgtaaacttgtgatatgtagcttcgtgaaatattttatcaaaatttgtgcttatttttagtttgcagtaaaccttttttaaaatttgactttttatattttatggatggcttgagcatccatgtgtcaagccagcacattctcagctcttgcctcagagctggagctgccatcctgtccaaagcctgcagc

SEQ ID NO: 170909 - DNA, 176 bp, Homo sapiens
cccaatacgtagtagcaaacacgtagaggtactgctttggtggccttggattaacatcaagaaaacttctcttgatttttcaagtagagatcttgttctcttccctttctttctctgaaaccagcagtctctctttctctgctgaggcatgtggagctggagttggggtaacataa

SEQ ID NO: 170910 - DNA, 332 bp, Homo sapiens
gaagccctctatcactatttccattgaataatacattgaaaatcttagccagaataacaagaagagggaaaaattaaatatataagcatttaaaaagagaacataaaactctagcattagcaattgctaaattatctacatagcacaaaaacattttcagacaaattattaaaattcagataatttagtaatttttagatatattaatatacaaaagtccattgcaaatctagttattcatccataagcgtgagaaaatttttatttaaaaaaaaaaagataccactatggtagcaactaaagatataaggtaatgagaaaaacatcctaca

SEQ ID NO: 170911 - DNA, 386 bp, Homo sapiens
gtcccagctactcagaaagctgaggcaggagaatggcatgaacccaggaggcagaggttgcagtgagctgagatcgcgccactgcactccagcctagacgacagagtgagactccatctcagaaaaaaaaaaaaagagctgaaatttcactgtctataacaagaagattataggtaaaactgagaaattcagtagtggtaacctaagcatatgtttggaggaaagaaagtatatacccaaaagaaatagctaaaagactgtaaggaattacctttgtggggtaggaatccgtgctggcaaaatgacctaggcttttggtttatttggatttctaaacgatataaatatatgacaataacaactttaaatttattaaaatgtctagg

SEQ ID NO: 170912 - DNA, 285 bp, Homo sapiens
atccagtgggaaggctaggcccatgtctgcccagtttcacaggcagcggggagagcatcaggagccgggctaaagagaagggcagccccaaggcgccaccaaggccgagcggggacgaaacggccccctggagccaggaacaccaagtctgcagagtgaatccggaacagctcaccacctaccaagcaaaacgaaaaaccacccccaggaaaacacaaggaaattcagtcactagaacgcattccctacagcgtcagctttttaccccagaattgtcagacaaca

SEQ ID NO: 170913 - DNA, 189 bp, Homo sapiens
taaactggcagcagggttagacattactttcaaagcttgaggtagaccgagtcagcatgctagacaggcttctctctctaaccaaaactgtaatcttcaggaccagcaaactcagcccaaggcagctaatccccccaaccccatcctccgcgccccgtgcggctgatcggcagccctgattcgccaatt

SEQ ID NO: 170914 - DNA, 449 bp, Homo sapiens
gttgttatttccaataaaatcatgctggaacacaaattacagcaccttagcaaaaaaaaaaaaaaaaaattatgagctaaacaatacaaggaagtaggagctcggagatctggagaaattaattgaggtttgttcaccacctatgattctctggtactacaatgtttagtagaatcatttattattctacattctcatcaattttagcttactttatactaactaaaatctggcagccctaatggctaaagaaaatagatacatttgaaataaaaaacattacctactcttgcctaatataaatttaaatgaaaacagcctgaaccaggattctttctttcagaacaagccacccctccctttccaacaccccaccctaaaatagaaaaacacatacacatcacaaccacacagcattattttctaaaaggaggtaactcgggctctgt

SEQ ID NO: 170915 - DNA, 514 bp, Homo sapiens
atgctgatggattaaagtctctatgccctgttcagagctctggtcagattgttgctcttttataatatagtatccagtgttggcaaatcttcagtttttcaagagatattaggcatctagagttcttaatgggaaatttcttatttctataataattatgagcaactggttaaaatttcaaccatagtgcagaccaatagtaagtatttttagtttgcaggtttacttactgtaacttaccatgcttctcactcctagatttatgtcttcagatctgaatttcctgctgggttttaggcttatcccattgtgttctatatgtaggagttctgtgtcccacaggcatctcaaagaccatgaccctgaacctcttaatttgtattaggaagtgatttcatttataggatacctgtgagtttgaatcattatttcaccacctactagctcaccaaaaaagttactttatttctttaaagttctgtttgctcatatgtgaaatgggagtaatatttac

SEQ ID NO: 170916 - DNA, 388 bp, Homo sapiens
ttttgtctgtcttggaattaacaattgcctcaaagaaaaaaaagaacaaacaaaaaacaaaagtaacccagttgcctcattattttgtttatttgcttaattcttctcttcccactaacttagccacagagttagcagtatgatcaatcataccaagttattccttaggtccattttaatactgggtacatccttcctggaacactcacttctcttgctctgctccggacttctcttttataagcctgctacacaggtgtcatcctgggatttctcttgatcactttttgaggaatcccttctatgttgattcctttgtttcttggatctcctttttctaaaacgatgcatttttttttttataatagagatagggtctccctctgtc

SEQ ID NO: 170917 - DNA, 193 bp, Homo sapiens
agcagagtgtccaggcaggtcctggcaggtgtggtggaagattggcagtggccactggatgaggtgcatgtcctgatgcctcaggcagtcctggacagacggtcatttggctccttctttttggcataggttggccacttgtcaagtgtggccaggccttcaggctgggctgctcggtcataagctaagaggc

SEQ ID NO: 170918 - DNA, 440 bp, Homo sapiens
acttaatgcatgtgaagctcttagaatagtgcctgggaggcagtaagttcaatagatctgttcgctgtttttatcttctttgagtcactcagcaaccctaaggcttggtagggcagaggttattcccatttaacatgggaaaaaacaagatcacaccatggttaagtcataaagctgagaccagagctcaggtccgttggcccttagtcctgtgcttattctgtgacaccatacttccttccttatattatcaccttagagaagggagaaggtaaaagggcaagcagaaatgaggaaaagagaggagaaatacatctataaggctgggtgcagtggctcactcctgtaatcccagcattttgggaggccgaggcaggtagatcacctgagctcaggagttcgagactagcctgggcaacatggtgaaaccctgcctctaa

SEQ ID NO: 170919 - DNA, 322 bp, Homo sapiens
taatccaggtgagagaatgaatttagatggcggcagctgaaatagagaaaaatggatggaagatatttaagaggaaaaattggtaggatttatgatggatttgatgtgggggatgataggagaggaaggttgtcacggtctaggtttctggtatgcacaaatagattctggtctcattaatgaaaaggatgaaggaggtcagcattagtgggggaaatacatgagctgtgtttgagcttgtgctgtggtttgaatgtttgtgtccctccacaattcatgttgaaacttaatccctaatgtaatagtattaagaggcgtgatg

SEQ ID NO: 170920 - DNA, 396 bp, Homo sapiens
caggacctgaatggatgtgagctcatgtggctagtatgaggagagtggggccccattttagcacctttcaaagtcatcccatgtgggaaaatggaagaggtcctctgcaaaggtgagactcaaaggccaaggacctgacttagaccagagactcaaggatgcgacgttttaagccttcttcctgtatccagcgtgatcttggtgaccctctgtatttcattattttcattttcaaaatccttaataaaagcccctttgtgttttaagtgttctcaccacaaaaaatactgtttgggaggtaatgcatatgtgaattagctcaatttagccatttcataatgtttacatattgcaaaacattgtgtagcacacaataaatacatataatttttgtca

SEQ ID NO: 170921 - DNA, 391 bp, Homo sapiens
gttgaacacatagaaagtatttcaaaattgcctggctttagacacaggtgggcagacaggtaccagaagcagtggaaaggaagaaggggagagggatgcactttcagggtgcttggagattgtggcactctattctgattctggaatggagaagaacagggcttgtcactgtagttctgcttctaccactaactggctagaagacctttaccctggggacctcagtttctcatctacacagcggcagatgatctctaagttcttttggctatgaaatcctataattctctgattccttcagtttataaaccctaggaataaaggtcagttgtatatataggggccagtttaaacccaaaagctattttagaacctgtgtctacaccccaga

SEQ ID NO: 170922 - DNA, 128 bp, Homo sapiens
gttgaacacatagaaagtatttcaaaattgcctggctttagacacaggtgggcagacaggtaccagaagcagtggaaaggaagaaggggagagggatccctccctggcacttggctagaggtcaattc

SEQ ID NO: 170923 - DNA, 904 bp, Homo sapiens
ggcatcaaaggctgttgcaggagtgtggaccggccaggtgacgcagaatcagcttggatttttccgtctgctctgccatctgtaactcagtaactcagcagccagggctgttttatcctcccctcaagagaggtgaccagtaaatttagagttgagaaatgtgtcagaagtctttgaaattggtggaaggaaccacgaagtctatcctgaggcaaaactgacagtcagacaaagaccatgacttacgtttttacaaaagaactaaattggccgggcgtggtggctcatgcctgtaatcctagcagtttgggaggctgaggtgggtggatcatgaggtcaggagatcgagaccaacctggctaacacagtgaaatcccgtctctactaaaaaatacaaaaaaaattagccgggcctgatggcgggtgcctgtagtcccagctactcgaaaaaaaaaaaaaacaaacaaaaaaaatggggggggccccgggcccggaaaaagttttcaaaacacacctccggtgggcgcgggggccccagtggttagggggaactgggcacaagggtgccaaggagaacgggccactagacagcgggggggttttcacccaataaaaagccgcggggcacggaggggttgggacgacccagaggggctgacggactacgggccttcagggggcaacggacccgaataaatcccgccgcggtaggagaagaagcaacaaaacacaaccacgcacgacacaacgacaacacacagtcacgagtacaacagcagcacagtcgtacacaaactaagcatagacactcagtcacctcagacgacgcgcgacgcgacgccccagagagccactccaccgggagcgccggaactcaccagacatgacacgcgaaggactcatg

SEQ ID NO: 170924 - DNA, 750 bp, Homo sapiens
gacttgctgagtcttctggccttcatctttctcccatgctggatgcttcctaccctcaaacactggactccaagttcttcagcttttggactcttagacttacaccagtggtttgccaggggctctaaggcctttggccacatactgaaggctgcactgcaggcttccctgcttttgaggtttgggactcggactgcttccttgctcctcagcttgcagatggcctactgtgggacttcaccttgtgatcatgtgagtcaatactccttaataaactcccattcatatatacatctatcttattagtcctgtccctctggagaatcctgattaatacactgtccttcatttttctgttggttcccttcttgcttacacttattttagaagccagtctcttcccatatacttggagaaatagaaacttttcagaaaaggtctgagaaagatattatttctggtctcaaagagttcaccttctagttagagtgagagactggacttgcctagacttctcacatatgtattcttgtcctgagcctcttaggtgggtttgtgtcctgctttctgcaagtacatcgcaacttggtctctgcctcagtcaccccagggaactctgagttcatatgctctgtgtgcacagcaaggacctctgtgtgcacagcagggcctctgtgggcctgactccctgaaacaggggcaacactgccatcctcttcttagtcagctacatgagttcaactacttccc

SEQ ID NO: 170925 - DNA, 604 bp, Homo sapiens
tttctgcttcatagatgactgtctcttcactttagtctctcatggcagagtagggcaagagaactccctggagcctcttttatatgggcactaatcccattcattagagtggagccctcataacctaaccacttcccacatgtcccacctccatataacatcacattgggcattaggtttcaatgcataaattttggaggaatacaaatattcagtctgtagcaaccactgttcatctatggttggtacctttaggtttatatcagcagaaagggcatggaagggaactggaatgtactaaacacctaattcttaccttatggcttcatatctattttatcttcctaagaaaaatcttgtgaaagcagcattattatttccattttgaacattaaaacaaacagagtgcaagaatgcgtgaataatttgtccaagtttacccagatagcacagtggtacagggcatgacttgaatccagatctgtctagctttaaaaaatcattgctttttatttatggcctattactctctgttgacaccaaggctaccacatccacccataagcattctcctcagtcctcaaagaggctaaattctcaaagg

SEQ ID NO: 170926 - DNA, 309 bp, Homo sapiens
tcttggtcatctgtgtccctagcaccaggccacacactcagcaaaacaaaatgatgaggatgtgtctgtgggagagatgttaactcctccccatgaaggaccttctccagatatcctgttttttgttgttgttttttgagacagggtcttggtcgatctcagctcattgcagctttgaccttctgggctgaagcagtcctcccacctcaacctcccaagtacctgggactacaggcacaccacacccagctaagtttttgatttttgtagaagaaaatcactgtgttgcgtaggcttgtctcaaactcc

SEQ ID NO: 170927 - DNA, 621 bp, Homo sapiens
cctgctgcccaaacttgatacagttagttgactcatttaataaatttctgttaccttgctgtttattacctcctgaagagaaattctttattaagactctaatactgaatcctgtcctttttctgtctcagcccatttcttttatggattcactgctttctgtgaggtgctactcttgcaaagtcatggggatgttataaaaatatttgtcttaattcaggttcccacagtggcagattgaattcaagtgcaagtgatttattaaggaaatgctcccaggaagtagtggcaagggaataagaaacaggatagggaagcaggagaagccaaatctgcctgatgctgtggagagctctggaatgtaaattatgcccctgagtttgctctatgttaagacagatgagcaccatgtttgcactccaaataagtaattattggctacaggcttcctcaggagtagagaaacaacataaagtcctaggcacttgtgacttctccatatgagtaagggggctctggtggccagaaattatcccctgaagaaggttgcaggtgcaagtagcagtaaaacacacaggagcttggcagggatgatggacacacaaagttcataaaaaagga

SEQ ID NO: 170928 - DNA, 316 bp, Homo sapiens
agagaagggggaagtgccagctccccgagaagaaagcaggaggatgctgagagactaaagctgaaattttctgcctgcttcctcactcttttcgttggtttcagccgtctgaaaaacccttgtgagaggagcaaaaaggtcaagggaagattgttgccttgctctcagtcttcaaaattttcgatcctccgttttttttgttttgagacgcagtctcgctctgtcgcctaggctggagtgcagcggcgcgatctcggtcactgcaacctccgcctccctggttctagcgattcttctgcctcagcctcctgagtag

SEQ ID NO: 170929 - DNA, 451 bp, Homo sapiens
tgaaaccagggaaactggcacccactggtggtggtatcatgatgaggttggaacaggctgtgtcctagacttcaacaatggccaaaccaccatggcttaaatgacttatcctttaagccaaaaggccagaaagcttctgatgttaaactggatttcatttcaattctaatgcagctttattttctgtaattgtttttcattggagactagttaacaggaaagagaagaaacaaatttatgaacttaaaagtaactgaaactgacattatagaaatcactttttaacagaatttctccactgaaattaagttatggtctctactgtttatgatttagtgaaaatggtggttattgtttactgtaacttctttcaggctctatgacacagatcatatgtagaagctaataaaatcactgctaaatgctaaaattaaagaaaaaaatgatatta

SEQ ID NO: 170930 - DNA, 507 bp, Homo sapiens
tgataattacttgcagggagtttaccacctctgtaaagcacagagcagactggccacatggtaggcgccctagtatgtcaactttgttctctttctctgagttgtggctccactagctatttgtagacaggagatctttgtggcttcaggtaggtgatgggggactgaaagctaagaggaaaagcctcccctgacctgcagcttctctttgagctggcatgcctggaattcttggggctggctgctgggtttgttttccagatgtggaagcaatttaagttctgttttcttaatccccaacagtttgcctccgaagtccacattctcatttgaaaatcaaggccgttggctctgtttgcagggcagagggtaggctagatagcctcttcaaaccctttttgtttaggaaatgggcttactggggcactcagatctgggacccagggcattcttgggacagtcacaccccatccaggacttggttaaaaggtgagttcactttctctg

SEQ ID NO: 170931 - DNA, 656 bp, Homo sapiens
ttatgccatttcaagttatcttttagctcttctaataccttttcaactaattccatcagtagaatcacccaatgggggttttgttttcttgactggaccctgactaatacagtcccaaggaaagcaatctatagcctataccaaagacataaaagagagcaaaccataaaagaggaattgataataatgaagataaagtgaaaatctctaacatatttaatcaacttactagaagcatataatagactagatgatgacaatacagtatataaagagaaatggttcagcatttttcagaattactgaattctatcaattctcaaactcaggaagtccaatgaatcccaagcagaataaataacaatttctaaaaatccacacctaggcacatcctagggaagctgaaaatcacaaaacaattttaaaagcaatcagagagaaaatacaatacccctgtaaatgagctgcaattagcatgataacagactgatcaataggaatagtggaaactaaagacagtgcaacaacatcacaataggccaagagaaaaatactactggcataaaattctgtatacacagcagaataatcttttcagaatgagggtgaaataaagccattttcagacaaaaagaaagaaactgaatctgcacact

SEQ ID NO: 170932 - DNA, 319 bp, Homo sapiens
cgaggtgggaggcggggctggactctggagctgggctcagacaccagaccaaaatgaggactagataaaacagggaaggggcaaaagcagcttttcataagacatgcccaccagtgtgccatgtccgtttactattgtcccaacaacactcaggagttaccgcccctttccgtggcagtgaccccacgacccagaagttcctacccttgtcctagaaatttctgcataaactaccccttaatctacatgtaattaaaagtaaatataaatatgactgcaaaactgccttgagctgccactctcagcacactgcctatgg

SEQ ID NO: 170933 - DNA, 1632 bp, Homo sapiens
catagaatgagtatttacatatgactaatgaacatgaaaaggtagtcttgatcctatggtaaagccattcaggttaaggtgaagaccttttcacttcttatatttctaaaagttaatagtatatccaatgcttgcaagagtgggaggtagtagatgggagggaagtttggcaatacacagtaaaacatatagtgggcctgtcctttagccctgcaggttccaccagtgcaagtgtaccctctagagatgctcacagaaatacagagatcttctcccctgacagagattgaagccttattttgcacagcctggtgtccggggaaggcagagatacaaaaagtcaattctccattcatgccgcctccacacactgtctcctgatgaccactggctcccgcggtcagctggatgatggccaaacgtctcatctcagcatccaagctgcctttttaacccttctggcctcagcggttccctgccccggtcactcggcaaatgtgatgtgagcgatgtgcacatcctcggcctggagagcttttgtgagatctgggtctctcttctgcaaagcctccagagacagtcctgccccagccacatctgctcaccccagccaatctgtgcccaaggcagagctggccaacagatgggtcaggacatgtgggtctaatgggtgggtggacagaggacacatggtgagacggaagaagcaccacagtgtttcagaaaaggaatacttcattcccagtttggggtgaggctggaaaacttctagaaggaggcagcaatttcactgggccttgaagcttggtgaggggaaaggtgtgtcaggcggggaaaatggcataaactaagacacgtaggtggggcagtctagggggtcggcaaggcccctgtcctcaatgggagatggaagacattcctggaagagtgcctgaggcagtgcggtgaacgggtttgaaaacctcgtgaggggctgggctctcatctgtaggagccatggaaagagaaggatatgatcagggccatgaaatctgcaaccagtgtaggggaaggagacaagacaagcctcgaggcagaaggttcaagtcccagtgtggtggtccaggtgggagagcttgcgagctggggatgggggtgggagaggaggaacaggtgtggctaggacacagcagctgctagatgtgagcccaggaggctgtgagaccttccagtgacagggcggtcagaaagaacaggttaggtgggtgggttctgcgttgggttttggatgtacacactcacccactcactcctttctgaatatcagcatcacacatttatctttcccatcctccatccatctatcattcatccatcttccatccatccattctccatctgtccatccatccatatgcatccatccatccatcctccattcagccatcctccatctgtccttcatctatccatccaccctccatccatccgtctatccatcttccatccattcatccatccatcctccatctgtccatcctccatccatccatccatccatccatcttccgtttgtccattcttcatctgtccatccatccatcctccatctgtccatccatccatatccattcatctattcatcctccatcc

SEQ ID NO: 170934 - DNA, 102 bp, Homo sapiens
cctacacttagatgcaggaacaaagaaaggacttcaagttggaaattatatttaaaggggaagcagtgcataaaagtttggaaaatgtgcagcttcgtcatg

SEQ ID NO: 170935 - DNA, 476 bp, Homo sapiens
actacgatggccagtaccaaagatctaatgaacaaatcccctgcatttgggaactgagaatcagatttaacaaatatttgctgagaacctctaatggctcaatctttcaagaatatttccttctttagttctcacagtccttcaagttatatatcatttttgccattttccatttgaagaaaccagctcaaagacgtgaagcaatttgcttcatgtttacaaagctagtaagtagcatagtcaacgtttgaattagatcatctgacttcaaatcagtatccctataccacagctaccactgtagggtctacatacggtgtagatcacagtacaactaaggtggaatttcaccaaccaccaagatgcaaagattgagtgctgtggagacaaaggaagcgatcagttggaatcactctgtagatccactgggacttagaagagaagaggttgaacagcagtggactctgggagggttg

SEQ ID NO: 170936 - DNA, 951 bp, Homo sapiens
caaagcaattctactggaaaacaaaacaaaaaaaaagattagccaagcatggtggtgcacacttgtagtcctagcttcttggaaatcgaaagtggatgaattgattgagccctggaagtcaaggttgcagtgagccgtgattgcacagtgtactccagcctatgtgacagagcaagacactgtgtcaaaaaaaagaaagagagagagagagagagagaaagaaagaaagaaaaagaggaaagaaaaagaaagaattttgaggactgctttcagttttacatctcatgtacatctcatctttactggtttattattgttaattttttttccattggtaattcctctgagttttactttctaaaacatacccaaaatcttaccatttatcactacctccatacaactacgtttgtctaggccctcatcatagttcacctaagtagactctcttagcagccccttattggacttccagcttccattttttcctctatgtagtcttttctttacacagcagatagaaagatcttaaaacatttactcctctgcccaaaaccatcccaaagttaaagctataatccttagtatggcccttagagtcctctgtgactggcctgtgactgcttctctaatcgtatctcctaatactttctgttttttcactgtgctctagccatgggactttcttactgtctccctgaaatgttaaaagcacacccttagttcagaagatttgcatttactgtcttcctcccagactgcactcctttcagatacctgaatgagttgctcctacagttcatccaagactctactaaagtgatttcaccagaggatatccctgacctctcatatctacaattctcttctttccttacttgcaaagcagcctatatgcataactgtagatttttatggtttttttcctcctaatgtttaactgttttctta

SEQ ID NO: 170937 - DNA, 198 bp, Homo sapiens
agccaacataatcatgatcatatgctgatcatacccatgaaatttaacattgaaacaatactattatccagtatacagtctgcaatgaaactttaatcgtccccttgtccttcatggctttttctttttaaatccagaatccaaataaggcattgcgtttggctgtgaagcctctctggcctcctttaatccagaaca

SEQ ID NO: 170938 - DNA, 679 bp, Homo sapiens
ggctgttgcagtgaggtacaagtctgaagtagctcatctttttcgtcagtgttagccacacttgctttcaacttcagtcttaatttgtttccagttctaaaatgctttttaaaaaagtctgaggtagcaaagtagctgctggtacttcagcttgattctgaagaaataaatcttaaaagcgaatcaagccaactcatgaatttaaaatgaaggcaaagtccaattcgccactcccacccatttctcacaccagctgtccaccaatcgtggctgcaacatttctgacacgactaaatgggctgaatcacttgaaaagactcggcttcgctagtactcatgaagaaccgcactttcagccggatggggcagggccacgctcagaaccaccagctaagacccaatcctctcgctagggaaccgtaactaggcaaccagcaccagtcaacagcgcgcgctcgcttcaaaacagcaggttgccgcgggtaccgaaattaactccagagaaccagggtcagcagcgagaggcagaacagagcactaaaacctagtagcatcacaaaaacgaggcattaactgacgggtggtctgaagccggagggcagttttaaagaccacgcgaaaaggggtagacctactcaacgcactttgctgcgggtcacagttattttctcaaaacccc

SEQ ID NO: 170939 - DNA, 354 bp, Homo sapiens
ctgggcagtgccttttgggcaccagcatttaattttcacacttgcatgggagccctggcaggacttcacagttctcagacagccactgcctgcccacacactcctgatcccagtacttgctgagtgattctagggctggtgactctggtactgtgtccacattgcctcctcttgggtgacagagacagaacatgttcaattaagagactcttggcaacagcccatctatatcagcaattgttgatgctcagatcattgtcatgtatctcctttgtcaatgaacaaatattactgcgctactgtacactgggtactgtgctagaggctgaagatgtgatgaactcaacagcaact

SEQ ID NO: 170940 - DNA, 447 bp, Homo sapiens
gagacagagtctccctctgtcacccaggctggagtacagtggcgcaattttgctcactgcaacctccgcctcctgggttcaagcaattctcgtgcctcagcctctcaagcagctggaattacaggcacgtccgccatgcccagctagttttttgtatttttagtagagatggggtttcaccatgttggccaggctggtcttgaactcctgacctcaggtgatccacccgcctcagcttcccaaagtgctgggattacaggcatgagtcaccttgcccagcctgtgagaaagaattattctgtagattcctagtaaataaagagctacaagaacagacagaacaagttgtaaatgggacacagctgctacccagaggagcagggtggagaagcatcctcagaccacatggagaggcagtatcaatacctctgattagataaaggcaga

SEQ ID NO: 170941 - DNA, 222 bp, Homo sapiens
gttttatgatggtaaaacagatttagagactactgctggaaaaaatgtcatggcttgaaaatattatttaatgactcataaattatgaatctgtaatagggagtttttttttttttttttttttttttgagatggagtcttgctcttgtcgcctaggctgtagtgcaatggcacaacctcggctcactgcaacctctgcctcccaggttcaagtgattctcc

SEQ ID NO: 170942 - DNA, 257 bp, Homo sapiens
gttaacaggaattgaagcaaaagataagagcttcttttaagatgtaggtattggaggtagagagagttatacagattagagacatagcaagaaggtttgatttgattgattgtgtagggcaagggaaatggagaaggatgagtcaaggatgatagttctaagtttccgtagggagactggttgaacaaggatgccactcagtaaaggaaataatacatgaagaagagtaatgtgaaggccagggaagacagacaaat

SEQ ID NO: 170943 - DNA, 307 bp, Homo sapiens
gggcatggggaggcttcgctgtggagacaaggccctggacttggagaagaggagctgaactcttcctcctttatcaaatggacatgcccatttataaaatgggtgtgtcatgtgccctgccaatctcaaggtcagaaaagctcagggaggtgaaatttcttcacagccataacatggcattattcagcagctggagtggccgaggggactgaagatggcttctccaccctcctgctgcctctcctgcatctctggtcagcgtgcaccaccttagggcctccgcgcttgctgtccactgtgtttcagg

SEQ ID NO: 170944 - DNA, 449 bp, Homo sapiens
gccagtgaccgcccataatttctgaaaaatggcatctgaaaaatcacaggactaaataataactgaattgttcaatttacattttaagtaaattattcccaaactttgatattaaagatgtttattcatttcaagccagttgggacatactgatcattacacattgcaatttcattcagcaccgcaaagaggaaccacccctgtctatgaaatgtacccttttctctggtgacattggcccatccttatgagcataataaaatcgcagaatcaaagcgctgcaagagatcttaaaaccacctaagtctaccactgagagcccaagaatcttggaaggacttcacagctggcctcatgccttcactttatatctcagggcattttctctcatttgtaaagggacttgtccttgatcaaattggtaatgtcagccatgggaggagaaatca

SEQ ID NO: 170945 - DNA, 603 bp, Homo sapiens
ctttagtttcatcatctgtgaaacaaaggggttaggttagaataagaaatttccaaagatctttctacttctcacagtacgtggtgctgtgtcgaggtaacgtcctttacatacctcatgaagttagtgctagttgtaccatccaaaccacacataagttctgtgaatacaaccaaacagctttgttcacatgtatttgcatgtgtttcaacttaccgtgttctctgcataatgattcttcaacagtttgaggtaaagagtgaatatttcagtttaaaaatacagtcaaaagtatagtttcttattctggtggacgtggtttactactacctcctccccctgtgttttagtttgttgctgtgctagttttattgcatattttctctcctaaaaatagatggtctttatctaaagcgtagtttttataaatatttgcatctcaagtaaattttttcctaccacatggatttcatgtggtgagttccatgaaagcaggttgtgttaagagggcattctcctagtacctgtttattcttttccatacctctgccccaaggatcttgtttactgatgtcagaatactggcagtttgagtagtactct

SEQ ID NO: 170946 - DNA, 342 bp, Homo sapiens
aaatcaaaggaatgcaaagtccctgaaaaacagtatcaaccacccacaaaaaccaccttactctaggcttctagtttcttaggtaaatttcccactggttattgttttattccgtgtgtgtgtacacacttccttgattctttgtcttggggcctaatataaaaggttttatggctctccactatgctgcttctgctcctaagagtttcagtggacttcacgtgaacacttaggtttgcaaatcagcatcagttttataaaacaaatatttgtgttttttgttttttgtttttgagacagaatctcacactgacacccaggctggagtgcagtggcaagctc

SEQ ID NO: 170947 - DNA, 192 bp, Homo sapiens
cctctgcctgagacatccttcctctccctttatctgggtttagagtatttttttgattatatctggtaaagcaaaactccctttgataatctatatatgaaatggtgttctgttgttaagaaaagttatttgttatactaacccacaaaaatatcaatgtttttctttcaactccacttttatgacccccat

SEQ ID NO: 170948 - DNA, 762 bp, Homo sapiens
gaacaagcaatatgaaaaagagaggcaaagacttgttactggaatagaagaactacgtactaagctgatacaaatagaagctgaaaattctgatttgaaggttaacatggctcacagaactagtcagtttcagctgattcaagaggagctgctagagaaagcttcaaactccagcaaactggaaagtgaaatgacaaagaaatgttctcaacttttaactcttgagaaacagctggaagaaaagatagttgcttattcctctattgctgcaaaaaatgcagaactagaacaggagcttatgcttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtatattgtttacagaaagagctaaagataaaaaatcacagtcttcaagagacttctgagcaaaacgttattctacagcatactcttcagcaacagcagcaaatgttacaacaagagacaattagaaatgg

SEQ ID NO: 170949 - DNA, 1285 bp, Homo sapiens
gagcaacagagaaaaaattttttttccaagaaaagaaagatttataaaaatattgaacaaagcctcagagatatatggggaaggacctggaagatctgatattcttgtcttcagagtcaaaggagagaatgagattagtgcaggaaaatatttgaaggaataatgtctgaaaacttcacaaatttgatgaaggaaataaatttacaaatttaaaaaaatcaaagagaactacttctagacacatcaaaatccttgccaaaaactaaaacaaaaaactttgaaagcacccagagataaatgacactgcatataagggaacaaatgttaaaattactgcagatttctcatcaaaaactatggacataagaagatggaacaacattttttaaatgctgaaagagaaaaaaactgtcattctattttatatccaacaaaaatactctctaggaatgaaggtaaaataaagacattcttagatgaaggaccgcatagagaatttgtcaccagcagacttgttctaaaagagaatgctaaagaaagttcctcatggaaaaaaaatacctgagagaaacttgggacctcaggaataaaggaagaacaacaaaaacagtaaatatttgcttgaagctcaactagagaaaaaggaccaacaatttaaagaacaagaaaagactatgtccatgttgcaacaagatataatatgcaaacaacatcatcttgaatcactagatagactcttgacggaaagcaaaggggaaatgaaaaaggaaaatatgaagaaagatgaagctttaaaagcattacagaaccaagtatctgaagaaacaatcaaggttaggcaactagattcagcattggaaatttgtaaggaagaacttgtcttgcatttgaatcaattggaaggaaataaggaaaagtttgaaaaacagttaaagaagaaatctgaagaggtaaattaacatttactttatatatagcatatatttcaagtgattttttttaagaagcatgagatgtaggacaaaatatatatatatatatatatttcttttgagacagcgtctccccatgttgcccaggctggagtacagtgtcgcaatcttggctcacttgaacctctgcctcctgggttcaagcaattcttgtgcctcagcctcctgtgtagctaggattacaggtatggtggtgcatacccgtggtcccagctactcaggaagctgagatgggaggatcacttgagcctaggaggtcgaggctgcagtgagctgtgatcacgccactgcac

SEQ ID NO: 170950 - DNA, 412 bp, Homo sapiens
acaccagctgagaggtctgcatttcacctgcaccacccagcctgcaggcaccccaactccaagacactgagttccctccactcagtgagggaggagcccaggtccctgcccccaggccccggcacattcaggggagtgcagcacccgctaccaggaggtctggccaacaggtgcaccaaaggatgagatggcagccgcgagggggtctgcaggcacacaggaatcacgcccaggatgcaggagctcctggggccttccgagacggaagcagcactgaggcctgagggcaggaggggccttcgctgggaagagagttgtgtgtgagacccagagggcactggtggcacaagcaggtggaaccatcaccaacaaggacacccgcggcacacccaggccaggcagcccccacacg

SEQ ID NO: 170951 - DNA, 530 bp, Homo sapiens
gatctgcctgccgcagcttcccaaagtgttgggattacaggtgtgagccatcgctcctgcccagtatttcacatttttgatgccattataaatggtttccaattgtctgtggctagcatatagaaatacaattggtttttgtatactcacctgatattctgccacgttgctaaagtccctcactagttagactagcttgtttgtagaatcggtaggctttttcacaaagataatcatctcatctgagaaaaaagacagttaacttcttcctttcccatccagatgccttttctttctttttcttgcctgattgcattggctagaaccgccagcaccatgttgaatagaagcggtgagagcagacctcttgtcttgccctgatcttacaggaaaagcatcagtctttgactgtaaagtgccatgtttgctgtgggtgttgcagatgccctttatcaggttaaggaagttcccttgtattctcggtttgttgtatgttgttgggttgttttttttttttaatcataaaaggg

SEQ ID NO: 170952 - DNA, 114 bp, Homo sapiens
cgctgcctccccctcttccctcttcccacaccgccctcagccgctccctctcgtacgcccgtctgaagaagaatcgagcgcggaacgcatcgatagctctgccctctgcggccg

SEQ ID NO: 170953 - DNA, 976 bp, Homo sapiens
accctaaagaccaaagtgtcacactagtcaagggagtgactggagttatttctggtagcagtagccactggcatcctagaaacacatggacatttgtagcatgaattgacctattggtagtgcaatagctatacatgatttttattcttggcaaaagaaaatgcttcaaaaaaaaagtgatcaaacctgcacattgatcctgtaatagcaaatggaaggctatttctctgtactagcatttcagctttatgtgggaaagttacccgttctcctgcaagtacaatcaacccttgatgacttaagtattaattattctgggtgtagctcacccaagttttcttcctacatcttttggctaattccaccacacctcagcatcacagtcagatgggaaaaggggcaggtggattctcatgtcatgccttcttgtaccttattttcaagttttgtggtggaggaggtttaattatctgctcaagaatctggtatatatagccaggtgcggtggctcatgcctgtaatcccaggactttgggcaaggcgagaggatcacctgaggtcaggagttcaagacccgcctggcccacatggccaaaccccatctctactaaaaataccaaaattagctgggtttggtggtggacacctgtagtcccagctacttgggaggctgcggcaggagaatcacttgaaccccggaagtggaggttgcagtgagcccagatcgtgcccttgcactcccgcttgggtgaccgagccagactccgtttccaaaaaaaaaaaaaaatcggctatatgtaaaaactattaattatgtaacctcactccaatactgtactgatcaagatctgcccactcctagaggactgacccaatggcagatcccctactataatctttctgacaactcagtgacaggtaaaatcactctaatattcctaaaatatctagacacttgaattagaaatacagaacc

SEQ ID NO: 170954 - DNA, 574 bp, Homo sapiens
tgagatgccaggagctctccaggaagcacctcgtctgtaaaatagtgatggccccctgcaggcctcaggcacataccatgagctcagaccctcacagcacttaggagagtggcctaggctggccgggcacagtgactcacgcctgtcatcccagcactttgggaggctgagtcgggcagatcacaaggtcaggagttcaagaccagcctggccaacatggtgaaacccagtctctactaaaaatacaaaaaaattggccgggtgttgtggcacgtgcctgcagtcccagctagttgggaggctggggcaggagaatcgcttgaaaccaggaggcagaggttgcagtgagccgagattgtgccactgcactccagcctggcgacagactgagaccccgtataaaaataaataaataaataaaagtacaaaaatcggttcaagaaaaaagaccgcttctggaagccatgggcctattgatttgttttcagccggaaggtcggggcatgattaaaacatttccctaaatggaccccctcgggggggggcccgcgcccaaaatccccctttagtgggg

SEQ ID NO: 170955 - DNA, 477 bp, Homo sapiens
tgagatgccaggagctctccaggaagcacctcgtctgtaaaatagtgatggccccctgcaggcctcaggcacataccatgagctcagaccctcacagcacttaggagagtggcctaggctggccgggcacagtgactcacgcctgtcatcccagcactttgggaggctgagtcgggcagatcacaaggtcaggagttcaagaccagcctggccaacatggtgaaacccagtctctactaaaaatacaaaaaaattggccgggtgttgtggcacgtgcctgcagtcccagctagttgggaggctggggcaggagaatcgcttgaaaccaggaggcagaggttgcagtgagccgagattgtgccactgcactccagcctggcgacagactgagaccccgtataaaaatctttaaattccattaagtacaaaatttagatatctgaacttgtatacacctaagtatgtcccacctaagtg

SEQ ID NO: 170956 - DNA, 261 bp, Homo sapiens
catcgcttcgcaaaagtgttatacaatgcaaaaccacatagttataaatgtcaaataagcatagcagggagatttaagaatgccacaaataaaatgtaagcctgacttgtacatgcatgaatttgagcagagaaacatgttactgactactaattcactattatttccaagctacctaagggatcttagttcaaaagcaaatgaaatgtgttaaaaagaggactgtggtggtaggtagatatatttccattatgcatgtgg

SEQ ID NO: 170957 - DNA, 222 bp, Homo sapiens
agtactgagttttctttctgcttattgaaagagctattactccactacactgaagcagaagaaatatgaggatatagaaagattaaggcctattgaggattcctgtgaaacttttcaaagctgtttcagcatacatgctaaagttgttaccacttaactaattttagcaatctggaacactgggattgctgcagtttccgattgccacaacatcatcaattc

SEQ ID NO: 170958 - DNA, 720 bp, Homo sapiens
ccccagcccgcgcgtccggcgctcagcctccgctccagaggcgagcgctgcgcttcgggcgccgcaatctccaggacacggcctcgcggacaccttccgcctcggggaatcggcagcataggcggcgcgaacggccgccgccgcctcggctcctctctcgagtccttcccgtcacctcgctgagagccggtcctggtcgcggggacatctctctccttcctcggaggctcgtgggaccaacggacggacgcagccagcgagggccggactgcgggacgcggccagagcagttgaacatcagatacccagagtgacatcaggttaaaaaaaagcctgcaatttggatcttttcctgactcggaagcaaggaaaatggacaattgataatcaaaggctaaatctcttctgggatccactgaatgccactagagggtctgctcgagagaattcctgattgaatgacaacggcgctaagaacaaaatcaaagttctcctctggactcttccaaaacatttagacatttactggcttccaaaagaaggaactcatggtgatattgaccatttttaaagaaaataaaagcatgaagccgagcatggtagtacacacttggaatcccacatatttggaagactgaggctagaagattgcttgaggccagaagttcgagaccagcctgagcaacatggcaagaccccatctttaaaaaaaaaaaaagt

SEQ ID NO: 170959 - DNA, 587 bp, Homo sapiens
tgagaatagtctgagagggagagattggaaggtcgtttttaagcttgagaatggtaatagacatccaggtggagatgactaggcggcagatgagtctggagttcagggcagctctccatcgatatttctagctcgctttgtctacagtcatgagcagttgaacatcagatacccagagtgacatcaggttaaaaaaaagcctgcaatttggatcttttcctgactcggaagcaaggaaaatggacaattgataatcaaaggctaaatctcttctgggatccactgaatgccactagagggtctgctcgagagaattcctgattgaatgacaacggcgctaagaacaaaatcaaagttctcctctggactcttccaaaacatttagacatttactggcttccaaaagaaggaactcatggtgatattgaccatttttaaagaaaataaaagcatgaagccgagcatggtagtacacacttggaatcccacatatttggaagactgaggctagaagattgcttgaggccagaagttcgagaccagcctgagcaacatggcaagaccccatctttaaaaaaaaaaaaagt

SEQ ID NO: 170960 - DNA, 488 bp, Homo sapiens
gctcaagggtttgactgatgtatccccaacaccagtttgccctcaatgtgagacatggagttaaaggagattattttggagatttaaggtttaataattgccctgctggattttggacttgcatgaggcctgtactcattcaccaaactttgttttggctgatttctccattttggaatggaagcatttacccaatgcctgtactcccattgtatcgtgggagtaactatcttgttttttattttacaggttaattgacaagaaagactaggcttgtctctcattagactggagtttggacttttaagttaatgttggaaagagttaagactttgggtgactgttgaaaaggcatagctttattttgaaatgtaagaaatacatgagatttgggaggggccaggggagaatgatataatttgtatcttagttcttacccaaatctcatatagaactagaattcccagtgttggcgataaggggcctgg

SEQ ID NO: 170961 - DNA, 129 bp, Homo sapiens
cgtattgtcatattttcatggaattcagtgaattgcattttgaggaccagtgccattttgatgctggaggattccaccacctttgtggtgttgtttcctggaagagattctactactgaagtggtgttg

SEQ ID NO: 170962 - DNA, 249 bp, Homo sapiens
aatcagtaggcaaccacacccagtactttgtgctgggaagcttggtcatctgtgagagggtcagagagtatacccatgcgtgcatgccaccgaagggtcagtgagtattcctgtgtgtgcatgtctcagggccggagagagtatgtgtcactgagaggtcagagtgtttgtgtgtgtgtcaaagagggttgcattgtgcccttcactgaggggtcagagggtgcctcgcgtgtgtgtgtgtgtacgtgt

SEQ ID NO: 170963 - DNA, 546 bp, Homo sapiens
atggtctccagaaaatgtcagtgggacttttgttctttgtcaagcaccagaggttatatggttatttttctgctgcaagactttgaggatgttgactttctcagaaactttttaaaaaaataatccaataaggcaggaattcagttttgaaaaattacatataattgtattcataataagaatgtggttatttcataagcagttatgaaagaattattgttcttattcaaaagtgatccagataattgtgatattttctatggtgggctactggtattagcacgacttggatattatttgttgaaggaagtatgaatgaagttggatttgaccaatttcgtgtaaaccttaattgatttaaaactgggaaagaggggggtttcctggccattgctgatctaaggtgctcttatttgtttccaataaacagtaatctttatagaccttaatgcagatttaaaaaaatagttgtgattggctgagagaggcagggcatatatgtagggaaatgatttgccccaagcattccaatgaagtatgacttgt

SEQ ID NO: 170964 - DNA, 481 bp, Homo sapiens
gcctgcctcagactcccaaagtgctgagattacaggtgtgagccaccgcgcccagcatgtgccctttaattcttctaatagcaacatgaggtgctgttgtccccattttcagttgaggaaattgggaaggcaagaactaaaaaaacatctccagatgacacacagctcataacagaataagaactaagatcaggctaattccagaggccatgtacttaacttatgtacgatgttgtcttggtgccattaatttgatattaatttcatttacctgatgattaatgtttgtcagacagaaaaagtgatgcatatgagaagctgtggggccctttctgtgttggctcgtggggggccctgttcttgtcctggtccttaggtcttccgcagtgagtgcttctcaagcagtcttggtggacagaaaccttgttgtatgccagtcaatccgcttctgcatttcttcagaatatttttgcatttcctc

SEQ ID NO: 170965 - DNA, 262 bp, Homo sapiens
cgcgtatagagttcttctgatgcactgtaggagaggttgcttaaaccagagtttatattcacccctccaagtggtctctctagtctgatttagacctttctctccatgatagtgcagggaaatagatcggccatccatctctgttccctgcgtttcttcagaagttttctctgcattagcttctgtcttaacctcaatataagcagtccctttactcttcccatccttgctgactaatccaatctccacagccatttaggta

SEQ ID NO: 170966 - DNA, 210 bp, Homo sapiens
tctcccatcccatcaggtacaaaagttcccctgtatcgctgcaagagaatggcaggaacacccagagttcatggttctatctgccttcctcattagtccatcaactccttggggacagggactgtgtatctccccagaacccatccatgggatttggctcaaacatttgaccaataaaactaagtgtgtgtccaaaaatcttctaggcta

SEQ ID NO: 170967 - DNA, 422 bp, Homo sapiens
atctcaagaataatgaccactacagtaacagcaggtgtgcgtgcgggaccggcaggatccacacagcagggacatcagcaagcaatgggcagggcggtgtggaggagcacgctgtggagagaggagcacgaaattccccttcctaccagttagagtgaggagattcagccttttccggggggaggaagggttagagtgtctgccagcctctcgtggcttctgctgtagtttcgctttcggcattctgcaggggctccccagcccttcccagagccccgggcgggcctgagcgggccactttgcggtggctctgcgcgccagggtgtttcctggtccattagtgattatggccaaggctaggtatagctgtaaggagggtggaggaggggcaggctcgtcctgctggcagtgggacagcctgg

SEQ ID NO: 170968 - DNA, 345 bp, Homo sapiens
gaagctagccaatggtatagacagagatgatgtcattctactgatgatgaagctgaggcacagaagggttaaacaactggcccaaagccacagtaatgatcagtggcagagccaggattcaaattcgggattcaacccgacgccagagcccacattcttaaccatcagtagagtaagtttaagagttaattcacctaaaacacttggcaggtgcacagcacatagcaaacgccacaggcataatagggcttcacatctctttaaagtacatgctcatccctggaggtctccttccctcccttcctcaatattgcttcttcccacgactttcacccaaatcaaagc

SEQ ID NO: 170969 - DNA, 185 bp, Homo sapiens
tagaacattgtgggatgaaccggacacaccctggggactgagaaactatatggagccattgttagagtaagctggtgccaatgcagagaggataaaagagaatgcatgtttttttttttctcctgcctttacaggttatatttcttttaacactttaaactgtcaaataaaattcctcttggaca

SEQ ID NO: 170970 - DNA, 226 bp, Homo sapiens
tgacatctataccaagcacaatattgtaggtatggaactttgaaaaatagcctggaagaagataacatttgtgttagaatttgcctaataaacatatcatgagttatttctaaggatgctaatagcaagaggagacaaaaactaatttcaactcagcaatcaaaagattgtcacagtaatcaaaagattggaaggagaagttgaaacatgacacaagataaataga

SEQ ID NO: 170971 - DNA, 123 bp, Homo sapiens
ttgtcccaggatcccatcaggttcaaagtgtatgtagcctcagttatgccctctctctgtgtttctccacagaggtgacaggtgagatgcaggttcacagcagctctggccaaccctgcaaaa

SEQ ID NO: 170972 - DNA, 394 bp, Homo sapiens
acattggagtcttatatttttccagtggcatggaagtggaaattaaagtttctataaatgtatagcaaataactggaatatctgggtagaaacatcaggagtgcaggatagggaggtggcctgagtttagcctgtgactcactttttgagtcttagcaggttacttcctcctttcagttttctaccataaaaggagctagcagggttgtttacaaagattccaaaaacaaatcacagaactggacaaagaaaaggttgcttgctttgtttttttgttttttgtttttttccataaagcaggtaactgaggtgttgaacaggcattaactgaagataacaggggacatccaataactcatggccttcatagaactttcctaaaatgtcaaactct

SEQ ID NO: 170973 - DNA, 180 bp, Homo sapiens
aggctggaggtgggctctggtggatgctgcacaagtagtgaggctgtattacacatgaggaactctcagctagagaactaatcttaacaaggggggctgctagccaacctgctcaacttttgcctttagggacacattatctttattatcctggacagcaaatcagccttccctctgcct

SEQ ID NO: 170974 - DNA, 494 bp, Homo sapiens
ggtcaacttgctaaaaatcaacactgtggttgcccttataacataacttctttttctctctctgacatattttccttacaacgattaatgagcttttctatttttgtcttttccatgtttaacttgcaaagagaaaaaaacatctaagttgatacatctgagtgtcaggtagggaggatctgctgagcagagagaaaggggttttaagtagagaaataaatttgcagggcagctgctgaaaaagaatcatctaaaccataagacagaagagctctccccagaagggaacaagcagaaaaggagaaaatagggagacaaccactttccaagatacagtcatataggaaaactttctttcatttacccaagtattaatataagacatcagttttccagcctagaacacaagattaataataaatacagatttttttctgtcttcattattacagacattttttttcctgtctcaagctgataaagaaaaatcaaag

SEQ ID NO: 170975 - DNA, 220 bp, Homo sapiens
aagataataagaagacaaggtgcacagtgggagaaaatattaacaaactacaaatctgccaaaagactagcatatataaagtagtctcaaaagcaacagtagaggccaggcaccgtggttcacacctgtaataccttaggaattacaccttggaaaggtgaggcagaaagatggcttgaggccacaaattcaagaccagcctggacaacatagcgagact

SEQ ID NO: 170976 - DNA, 420 bp, Homo sapiens
aagcctggaattgaaaattaaatttttccatatgtctgaatttaaaccattggctctaataatggggaatctattttttctttcagttgaaatattttagatgtttatttttattcacttaattctttacaaaaaatgctttatcccaaagctgagtttctgacctctatgcacttttcaagttagtcttgagtgtggttttcttgtggaagtcagtgtggcactggataacatactgagggcatactatgtgcctcctgagcttcccatcctttttctccccaactactgctttaaaatttctccaactccatcaagctctcctagcctaccctaggccacatattttactacattctcatattattttctacctcccatgtggctgcttgatcacagttcttttttttttcttcttcc

SEQ ID NO: 170977 - DNA, 281 bp, Homo sapiens
cagcatttgaaaataaatcagcatatttctgcttgatggcgtgttagaaccatgcttttattgtcggaagttcacagagctggatgggtctagaaagatgccctctttcatgcctcccaccttagctgcatgaagttaatgtcttaacgtggattccccgggtctgcatgaattctggcaacagtttctgatggatcattatttttatgtgacttatgtaggacctgaagtgggaaagaagtgggtgagactagttcaccatccctcaaatctgactagtt

SEQ ID NO: 170978 - DNA, 171 bp, Homo sapiens
ggaaaaatactattttaagcaggaggcacatgatcagatgtgcattctagcctcagtagcccagatcaagaggacagcagtgcagatgaggaaaagcagggtagattcaagatatgtccaggaccatctggaagggtacagaatttctttttttttttttttttttttgag

SEQ ID NO: 170979 - DNA, 280 bp, Homo sapiens
tccattgctctggtggtatcctccggaggagttacaccagcaggcacatgtgacagagagagagagagagagagagagatggggtctcactctgtcgcccaggctggagtacagtaacacgatcacaactcactgcagactcaacctcccaggctcaggtgatcctcccacctcagccttcctcccatcccagccttcagctgggaacacagacacatgccaccatgcctgacttttttttttttttttttttgtagagatggggtcccactaggttgcc

SEQ ID NO: 170980 - DNA, 173 bp, Homo sapiens
agatattgaatattcccaacacagagaaatgagaaatgtgttactctcccccggggctcagtctacccatgtaaagcaggaccatggccttgggccccgtggcttctgctgtcacaagcttttatcaaactgagctctgacgttagacctctcgcttacaacacacaacttta

SEQ ID NO: 170981 - DNA, 351 bp, Homo sapiens
agaggggccaattgtgcagccaccctgacatccctaaattagctaaattagctgtgagccagatttggggccaattctcacatttaatgagtccttgtttccctcttacagggggcagagatattttgcccctgaggagtgtaaacatgctgccctatttcattcccaacttccagctgcttgccccaaccccaggtaggaaaaacaatccaatgttgatgttcaacatctccataccctttgaaggtttatgtgcaaaagaaaaattaggttaattctataactaagtgaaatatctgaattcaatgaaacagagaaaatccaggattttctcttctctgtacaacatac

SEQ ID NO: 170982 - DNA, 221 bp, Homo sapiens
gctgatgttatcgcccaacacttaattccatgtgatgtctgtttgtaacatgtttagggtctgaggagatatcttactcaaaaatgaaggtatttttcaacaagcattgctattccacaaacattgactgctttatgaaagcctgcagcagctatttcttagaaggtgaattcttttctcagagtgtgtgggggtgttggggataacatcaaagactcctg

SEQ ID NO: 170983 - DNA, 175 bp, Homo sapiens
gatgtgtgctggccttattcctaagggtttactcagctcttggagaacaccacagtgtttcagaagagggcctgtcctttcgaacaagtgaaaaatagcttcacctcctaacagggatctgagacacaacagtgagcacctacatcgaggactgaactgtctgggtttccatatt

SEQ ID NO: 170984 - DNA, 488 bp, Homo sapiens
atttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaattgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaat

SEQ ID NO: 170985 - DNA, 176 bp, Homo sapiens
ccagcccatgggggcagctgtggggcataaaccctgcaaagccacaggtgcagggctgcccaaggccttcagagcccagccctcatgtccctgtgccctggatgtgggacaacgtttcaaaaagggtgattttggaactgtaggattgaatgactggccttctgggtttggagttt

SEQ ID NO: 170986 - DNA, 337 bp, Homo sapiens
agagcctggggccagagggccagacagccacagagctcctggcgtgggcaaggctggccaaggatggcgacgcccaggggcctgggggccctgctcctgctcctcctgctcccgacctcaggtcaggaaaagcccaccgaagggccaagaaacacctgcctggggagcaacaacatgtacgacatcttcaacttgaatgacaaggctttgtgcttcaccaagtgcaggcagtcgggcagcgactcctgcaatgtggaaaacttgcagagatactggctaaactacgaggcccatctgatgaaggaaggtttgacgcagaaggtgaacacgcctttcc

SEQ ID NO: 170987 - DNA, 519 bp, Homo sapiens
cggcacgaggggtgtctcaaataatatgctgtctctctgaacttacttgcagccagtcttgcagataaaatctgaatcaataacagaaaatagtactactgaggttgtggttacagatttgatcaccatatatgtctgttagctttacatagaaaaataatatattcagtaaccgaaaacaataaccctaaccccactcatgatgagagagttggaaaaaatggaggtctgatggaaattgatcgggattgtgaatatactctacatacggctagtggctgtcatattggacagcacaggtctaagcaattctaagtgtaagatcccactcctggctgagatgtgaataagagaaaacttgaagtttcctctaaaagttgtatttgtttgtctggttgtctcaaatgcaatggaaaccacagcatgacttttagcaggccccagaccattgccttgtgtgagttcaatcactgaatcttccttttcaaaagtaaaacattggatctggagcaaaatata

SEQ ID NO: 170988 - DNA, 321 bp, Homo sapiens
tgctgggattacaggtgtgagccaccgtgcccagccaggatttgcatttttcttaagaaatggctgactcctgtaaatggttcacttgagaaataacagaatcctgtaaactgttcaactaagatgaagcatatttgaaaatgtatcaagtaaatcaaacaaaaaagatttgctcagtgtattggccaaacatgctagaatacatggaaggtatctggggggaaatggtgcaactgatgttcacagtttccaggaagcaagtcttcctcttgttactggcagtttaaacttgagcatgttactaagactcttggagcctcc

SEQ ID NO: 170989 - DNA, 479 bp, Homo sapiens
gcacctgattagaccctcctgacccctctcttttttttctgaatttttctcttctttttttttagagacgtagtctcactcactgtgttgcccagaatggtctcgaactcctggcctcaagtgatcctcttgccttggcctcccaaagtgctgggattagaggtgtgagctactgtgcttggccccagttatgtttagagtactatattcatatattgctttctgtaagaaatggaatgaaaaagtaaaaactgagaaaatggcatcaaatgttaggaattgattgctgtgatttgagagcccgtgaaagattaccccaggatttgcttccattgtaatatattgttatttctagatctgggtgtgtgatgtttgtctaagactgatgaaaattcgttatttattcagataaaaacaatccagttaggttgtttttgagcctgctaaatcatttctaaatgaacactctagtgtctgaa

SEQ ID NO: 170990 - DNA, 340 bp, Homo sapiens
ctgcacactggggaaggataaagttacaacgattccaggggcactcagcctttcttgggttccgtatttgtttgcgggtagggaacattcccttcctgcttgggtatcatggatccacagatgccatacctcaagatggtgagttacataccttgtggagaaaaagatgaacatttttgattaagccaaatcagtattctggcaaaataataatgaaacatatgactatacatttagtgtaagcggatcagtaaacaagtatctgtggataacctgctacatgcaaggcactgtcaaacaggttatgagaaacagaagcttaaataagcattgcacttta

SEQ ID NO: 170991 - DNA, 566 bp, Homo sapiens
tttattccctgggaatttctatagataattatgttgtctccaggtacagttttacttcctcctttccagtctgtccatcttttctttttgcttccctaattatactggtgaagatctccagtacagtgcaaccaggggtgcagggaacagacaccctgcctggtctccatgtcagggatgcagtccgtccaccttgtattatatcagctggttttctgcaggtatcatttagctggttgaggaagttctcttctcttcctagcttgctgagaactttaaatcacaaacgagtcttggattgttacaaatggttgtgctgttcgcctacagagatggcctgcaccccctttcattctactgaaacaggtgattttccaaagagaagcaagcatcctgcattcccagatgggctccagcctcacgccatctttcccactggcctctctgtattactcctcctccccctcctgtgcccgaggtcttgccgaggatgacacgtacctcaaagggtgtgtgctggcctccactttcctcacccgtaagtcactccccgagacagaccatgc

SEQ ID NO: 170992 - DNA, 407 bp, Homo sapiens
cgaacagccaccatttgtaacaatccaagactcgtttgtgatttaaagttctcagcaagctaggaagagaagagaacttcctcaaccagctaaatgatacctgcagaaaaccagctgatataatacaaggtggacggactgcatccctgacatggagaccaggcagggtgtctgttccctgcaccccctttcattctactgaaacaggtgattttccaaagagaagcaagcatcctgcattcccagatgggctccagcctcacgccatctttcccactggcctctctgtattactcctcctccccctcctgtgcccgaggtcttgccgaggatgacacgtacctcaaagggtgtgtgctggcctccactttcctcacccgtaagtcactccccgagacagaccatgc

SEQ ID NO: 170993 - DNA, 141 bp, Homo sapiens
agccaggagaagccagtcccagggaccaaaggagagactgttttcctttcccatccccaatctgccccttaaaatgtctctgtattagtccattcttgcactcctataaagaactacctgagactgggtcatttacaagga

SEQ ID NO: 170994 - DNA, 801 bp, Homo sapiens
ctagagttcccatgccaataacctcccattagtacatagcacaagctgaattctgattttctagctgcagaggatgatctgaatgatgatgaggattagctcattcttgagtaggtgtgatcagtggatccctgagaactgcctcctcagccaaccattgttaaattcatccttcccctcatagcaggactgaggctcagctagcagcaccagtttaggaatgctcattgtttacagtcagggtccattctaattgggctggtatatgttcacattgatgttgctcatgtcttcctggttgttaaatatttacatggccctgaattttctttggggtacaagtggtttaggagacacttaagactgatgatgtaaccttacctgcaaggactggtttagtgatagggaagtggcctgagccagtccaaaaccagaagggatcccagagtttggttgggaattccaggacacaaatgtcccttcttgttctggatgttgtgatgtatggttgtgaagtctgcaatcattttgtcaccataaggaaaactagtctgaaggggaggctgacacacagagaatgacagaactgagagtataataaaaaataagtagtccagtacaaatagcacctaaagcccactctacttctaaactttttgagctacataagctaatatattcctttttgtaacttggggctttctgtaacttgaaacagagataatccaactgataacggagggatgtatcataaagaggatgatggtactatgacggtggaggttattgccatggtatctt

SEQ ID NO: 170995 - DNA, 139 bp, Homo sapiens
gtttgttcttatggaatttactctatgtatgtgcagcttaattttcagtcatagtctcaaggggaaccctgtgtagatttcctgagctcttctctgcatagctcttcctctttagcactctgccctgaagagtccatct

SEQ ID NO: 170996 - DNA, 285 bp, Homo sapiens
ttcccagacgacaccggctacccattaacactaactcttcatccctctccccataacctcgactctccccataacccctgaccaccaatctgctttctcttatgaatgtcaccactcaaggcacctctcctataaggggggggggggggtcatacgatatttgtcctttcttctcttatgaatgtcaccactcaaggtgcgtctcctatgggagggggtcatacgatatttgtcctttcttctcttatgaatgtcaccactcaaggtgcgtctcctgcggggggg

SEQ ID NO: 170997 - DNA, 298 bp, Homo sapiens
taaagagtctccaagtactttcaatccatacaatttcatcaactgctaaagtgagcataggctgtcatccacatttcccaagtgaggaggaagaagatcagagcaggtatggtgtggtcccctcgcctagaagcaaaaagctggaattctctctgcccagctctgaagtgggcaagcttaacctctataaacctcagtttccttttctggaagtccagggaagacctagatggtcttttccagctataaaatttccagtgtgatccaaagtcacactgagggctcagtgacagagctg

SEQ ID NO: 170998 - DNA, 383 bp, Homo sapiens
agtgcagagtcaggatcttccagacatgagcactgtgcctgtaagtgtcctgtaatgcaaacccctcctgcctgtgagagtactgtggcattccaccttaccaagatactgactgtgtgtgtccccaaaataaaggccagaaagtcagcttcacctcctgttgcaatgagagggagaccttacaggttaagtaaaacagtggatagcaaaattaaagagtgctgcatatgttccagtaggttttcactgagtacctttaagctgctggcacagttggagaagacgatcttgcctctctttttgcaaggggagaaaatcaggctggaatgatgttttatcctgcctgtttgtgtggacatgggaggcatgtttttaaaactgtt

SEQ ID NO: 170999 - DNA, 393 bp, Homo sapiens
gcgtgaattaatgaggctgcccgagccctggagcccgtctcacggagctgggtgccaggctggccctggacgggaggggttctgaccccctgcacctgccacagggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatgggtgggtgc

SEQ ID NO: 171000 - DNA, 350 bp, Homo sapiens
ggaaacaggaaagtgcggctgattcctccacaccccgaccaccgcgcaggacccaggacccttctgaaaagtgagcattgtattgttctttagacttattttatatgaaagcacatcacgctctaagaagagtcacccaggctttctgttctcaggtggagcctccctacaccatacgcacacggcggctgttccccacgacacagcggggggcaaatgaccaccaggagccagggagtcccagggaaggaccctccctccagtttcagagcgagcatgaccctgcggacacttacatctcaagcttgtggcccccacaccaggaataaatgtctgttgttttcagctgc

SEQ ID NO: 171001 - DNA, 432 bp, Homo sapiens
caggaagacccaacacatgtggattttgttattgactaaaacatgaagctctgcagctcagtgactgagatttcctcagcagctgtctgtgttacaaacgtggagctattgagtcaaaactccaaggatttagggaaaaagggcatgttttccaaaatccttttcctgtcaactaaaatataagtagagaacctgaagcctccaaggacagaaagttttgatttggggaaagagctgggccaggggacctgggcacagatatgtgtcttggagatgctttccacccatgaaaagcctaggggtcatttgagaatgtaaagcctccttctggagggaaaggaaacacgggagtattcttcttcatgtaaagagggatgaacttttgtttacgggaaagaggagatcacaatggtgtacacactccacacccag

SEQ ID NO: 171002 - DNA, 390 bp, Homo sapiens
ctgtgaccccaaggatgcctcctgaaattgctgattcaatttctcctaataaaataggaacaataattagctaataagaaatcaacaattaaagctatgagagaattaagtgagatcatgtaagcaaagtacatgtcacagtgctctgcaaataggcagtgctcagaagtgtcaccttttctctttcttctctgagcctccgtcttctcttcggtaaaatgagaataatattatgcatacctcacaggggttaagcaatgtgaaagtactctgtaaagtataaggctgaaatgtactgggctcagaacctataggtctgttccattctcgacacacgtgatattagcagcacggtacatttaaggacacggcttgattctttaatcacag

SEQ ID NO: 171003 - DNA, 659 bp, Homo sapiens
tattcagttataccaaacactttacctttccccaaatttgccatggtttaccgaattccccttttctggaatttcgtccttgtgacaatcattactctggcaaatattacttgcccttaatgcatctttctttaggaagccttctctgactcacacaaggaattaatcatttctacctttgtctcaccactctatctagtacttatctatttaacatttattacactgtattgtaattattcagcccagctcaggacattcactggatggtgttctgttatttcttaaacacaggtaccctttttattttgggtttcctgaatcgatgttacttattttctgttgcttcctgaccacatgtttgatgtcataagaggtctgcaccctctgaacaatctggcctttgctcttttgctttacctattccgttctggaagcccacttagccaagcctttcatgcttgtctcacacacaccatgcaattaggtggaaagggatgacccagcaacttcaaattagtaaagtagagaaggcagagtaattaggtgagcaatatagctttgagcatatattattcaattcagttttttcagaaaagacatttttggaggatttgtaaggagcttaccaaaataataaagttatgcttcattttcca

SEQ ID NO: 171004 - DNA, 407 bp, Homo sapiens
tcaaatcattaagtcaaccgcctagaggaacttgattccagtttttgtgaaaagcaaacccagagcctagaaaaatgaaggccaaattcattgtacgtatcattaggctagttgccttgttttttttaacccattctgatttcttttgcttctagtatagcggaccagtgtgtattttttggctatagcatgtatgtttcatagagtatttgttaggattaactaatagcaggtagaggaagggttaatattctcatttttccctcctattctatctggagagatcataaaatacattacagttagagtcaacaatcaccacttgaagaaatctcttcaacacaaagcctgataaaatttacatctggtaaatgtctatttaagctactgcgaaacacatatactta

SEQ ID NO: 171005 - DNA, 313 bp, Homo sapiens
tggacggatgggtgatggatggatgggtgatggaaggatgagtagaggatagatggatgatagaggatggattgatggatgaatcatggatgaatagaggatagagactctacatgagtctcaataagtcccatgagcctcagtttccctatctgcaaaacggagatggtaacagtagtacctgcttcgtgaagtttaggtcttgtaagatgctgagcaagggcctggcctagtaggtgataaagagtggaagccacctatattaggttgaatgttggtctttctaaaatatgtccacctggaacctgtgaat

SEQ ID NO: 171006 - DNA, 419 bp, Homo sapiens
tttggtagtataatgttatgttagaaaaatgttacaaaaaagtacaatagggagtaagatttatgcttattaaagaagcatggattaaaaagattgagaaacatttattaaagagtcactgaggttcttgttttagaaggccatgattaatgagttggagaacaagaagcaaatttggtaatcatgtaaattatgagctgctgaccacctagaaatatatttgctgataagagctttcatataatgatcatattttatctttccaacaattagatactgtttacagcttactgatgtgtaaaatgagaaactttttttcctatgtttatcatggttttaaaacatttatcatgtatttaaaatactgtatgcactccaccacagacaggatggagaggaagatgtgacaaaagatgtgg

SEQ ID NO: 171007 - DNA, 164 bp, Homo sapiens
aagaaaatactattcttaacacactcatcacttaacacgctcatcacctataagcaagagctatcagaaatactatttaaaaatacatacatttctaatagctcttgcttataggtgatgagcgtgttaagtgatgagtgtgttaagaatagtattttctgctg

SEQ ID NO: 171008 - DNA, 576 bp, Homo sapiens
gatggaaatcagcccttaggaagcccagatattggacttagcagacaaagactttttaaaaactctataaatcgtgaaggacctcttcaaggagaactacaaaccactgctcaaggaaataagagagtacacaaacaaatggaaacacattccatgctcatggataggaagaatcagtattgtgaaaatggctatactacccaaagtaatttacagattcaatgctattcccaacaagctactgactgtcttcacagaattagaaaaaactaccttaaatttcatatgaaaccaaaaacgagcccatatagccaagacgatactaagcaaaaagaacaaaggtggaggcataacgctacctgacttcaaactacactacaaggctactgtaaccaaaacagcatggtactggtaccaaaacagatatatagcaatggaacagaacagagacctcagaaataacaccacacatctacaaccatctgatcttcgacaaacctgacaaaaacaagcaatggggaaaggattctctatttaatggtgctgggaagactggctagccatatacagaaaact

SEQ ID NO: 171009 - DNA, 742 bp, Homo sapiens
cggctagctcagtcggtagagcatgagactcttaatctcagggtcgtgggttcgagccccacgttgggcgtgagattttgtcggatggattagacttgcaacttggaagaaagtaaactaaataagaaaacgtggaagtgactccgtataccttgcaaatcgggaattgttggtcaggcaaacgcaaaacgctccaccaaccaactggcttcaggatcccctttgtcttgtttcataaaaaaaagaggccgagcgtcgtggttcatgcctataatcctctcactttgaccctaggagtttgagaccagcctaggcaacatggtgagacccccggcccttaaaaaaaaatacaaattttcgccaggcttggtggtgtgcgcctgtagtcccagctattccagagactgaggcaggagaatcacttgaacccgggaggtagaggttacagtaagccgagactgtgccagtgcactccagcctggacaacacagtaagactccgtctcaaaataataataaaaagaaattggccgggcgtggtggctcacgcctgtaatcccagcactttgggaggtcgaggcgggcggatcacgaggtcaagagatcgagaccatcctggctaacatggtgaaaccccgtctctactaaaaaagagaaaaaattagccgggcatggtggtgggcgcctgtagtcccagctactagggaggctgagacaggagaatagcgtgaacccggaaggca

SEQ ID NO: 171010 - DNA, 192 bp, Homo sapiens
cccctgtccccaccccaccaccttccagggtgccaggcagggctggctccaggcctgtccccgactgccattggcaacagtggccctgcagcccccagccctccccacccaggttttcggcccagtgaagaggccactggccaggcctcccaggcaggtgttttatgttcagcaataaaggttctatccgta

SEQ ID NO: 171011 - DNA, 182 bp, Homo sapiens
ccagaagagagctaggagaatgaggagtctttgaatttgttaatgaagaggacactgatgaattctaagggcatatttattagtgtttaagcaaactgcaaagggctgagaagtgagcagaatgtaatggttacaaataagatgatgataacttgagtgataatagtatacagctatttttg

SEQ ID NO: 171012 - DNA, 1959 bp, Homo sapiens
gagggggaagcgaggggcgtgggctgcacctgcgggggtcctcgggggccgccctcggggtgaaccgccctgtcttccctctggtcctcagaggcctcccttgcctcggcgggtgggcgagccgggctcgggaggaagagggggaggtggcattcgggagaggggcggggagggggcgcatttgcagggcgagcgggggctgacgaaggggcggcggggccgtcccgagccgggaggggcgctctggtcttggcccctggggtccctcgatccccgctgcagggaagccgcccgaagcagagggttgcgggagtctctttgctgagggagggagcgggggtcaccagtcaccgagacccccttcccgggctgcacaggcgggagcggggacccgggtggggagaggggtgtgggaggggagtttccgggtcggaaaagggagcgccctactgggttcgtggccgtgcttgcctagaggctgggcccaggtagggaagcgaagtggactcgtggtttttctccgagggacccaggctttgggatcccgggctccggggctctctgccccccttcccattctctttccggaatccaggccttccgtcttcctgcttgctccccacccccctatctgagcgccgcacgaggctccccagcgcccctcttttcccctccaccaaaaaaatcagttctcctgaattctgatttttcacttactaagctagtacagtgccacacacccagggattccaagcctgggcatgtccatgaatagaagagctactgggggaaggagaagactccaggatgtggcccagaccccccggaactgggaagctggggtacactgggcagtgagggttctgtcttccatcccacttgacccagcttgctgtctgttctgcagacattcttttaggggaaccccctgggtggcggggccctaactgagggaaattggtcacctggtgtctggggaggagtgggcgcttagcaggaggcaccctaaaaggaagaaaagttaaagagaaatgtcgaagaccaaatgcctgggtgcctgcagagaggaagataggatttgggcatctgcataccctgtgtggtgttggagatacatactacagaggaggatacccctgggcataggcctggcactggaggatgatatgtttgggagatcattaagatcttatggctatgatggggtggaaaattgaggtagcttctccagggacaaaataccagatttcagcatggtgatggatagagagagggtggaagagaacaggcatttctttggcgtcggttactgtcgtcttgtcactgtgctaggcattttacttacctttagaaagcagaccagaaagcaagaggtcagggaatcatggtaataatagtaataactaacggccgggcgcagtggctcatgccttaatgccagcactttgggaggcctaggtgggtggatcacctgaggtcgggagttcgagaccagggcctggccaacatggtgaaaccacatctctactaaaaatacaaatattagccgggcgtggtggcacgtgactgtaatcccagctactcaggaggctgaggcaggagaatcgctggaacttgggaggcggagattgcactgaacagtgattgcgccactgcactccagcctgggcgacagagagagactctgtctcaaaaataataataataatagctaacatgttatactgcctgcctgtgctagggacttgcatgtatcaaatcatttagtctcacctaacaactgtgcaaggcaggtacaatgtccattttacacataaggaaactgaggcccagagacttacagtagtaattgggccaaggccttgcataactagtagagccaggatttgaacccagctgacagactcagaagctctgacttccccctgctggtggaaacacccagccttgagagcaagg

SEQ ID NO: 171013 - DNA, 632 bp, Homo sapiens
tctcactcatagacaatgattttcatcagacacaatgttctataatgccatctgtcccacatgggtgggatgtgttggaaagatcactctgctggctccaagaatattttttgaacccaagaaaccctcctgtgcttggaagaggcattggaatcttgcctggaacttgttaaattgcagaaggctgaggagagcatgcagaaaaagctggaaatatgttacaatttgccaccaggggtctcggtcagggtgcaggagcagccctgggcagaggtgctgcttaagcacaacaagccttggctagtagaaagcaaagcttaatttcccaccacacaccagtgtctgccgagatggtcaagagaaatttcttctaagtaatcccttgggaatcttcttattccaatgattcagccttgctgaaactgtttggagaacttctctcaataacttccttcagaagctatggacctttcagcaactgctctacagtgcccatgtgtgccgggcggagtgcttgacctgtgtcattcatttcccccagaaactttatgcctctaggaatcatgttcttctttatacagatcaggctataccaggctcaaagatgttatggatttccctggggctccctt

SEQ ID NO: 171014 - DNA, 555 bp, Homo sapiens
tcttgaacccgagaggcggaggttgcagtgagctgagatcatgccactgcactccagcctgagcaacagagtgagattctgtctccaaaaaaaaaaaaaaaaaaaaaaaaaaagaatattactgctaagggctaggtgtcgtagctcgtatgtgtaatcccagcacactttgggaacctgaggcgggtgaatcacctgaggtcggaagtttgagaccagcctggtcaacatggtgaaaccccatctctactaaaaatacaaaaattagctgggtgtggtggtgcacacctgtaatcccagctactcaggagggtgaggcatgagaatcgcttgaacccaggagacacaggttgcagcaagtcgagattacgccgctgcactctagcctgggcaacggagtaagactctgtctccaaaaaaaaaaaaagttactcattgtattgtatttcttgccaatcttattagtcttttataggaagtttgaaagaaaattgattggtggaagtgagaaaaacttgtaccattaaattacaagaaatagccagccgggcacag

SEQ ID NO: 171015 - DNA, 328 bp, Homo sapiens
gagagaactaaggggcaccaccctcgtggggaaagcaagagatgcaaaactccgcaactgctgactctggaatggtgaaaggatttgtgccactcagacgcctcccgggtttgccacagccactcgaaggtgggagcaactgagaccacaggcgttggacaccgtggcaggaaacatagggcaccttctgagaagggaccctgacgtgagagctctgaacaccccatgccccatgcccacccagcacagtttgggaggacaggacccgctgggccagcactctgagatgacagagctggagaccagtgtccctctgcccttccgccca

SEQ ID NO: 171016 - DNA, 959 bp, Homo sapiens
aggatccagcctgtaccccacacaagggagacagcacctcccaggagatccactcagccacaacttcaccttctcctgtttcctccacattaccagagagcatctcttcctctcctcttcctgtgacttcactcctcacgtctggcttggcaaaaactacagatatgttgcacaaaagctcagaacctgtaaccaactcacctgcaaatttgagcagcacctcagttgaaatactggccacctctgaagtcaccacagatacagagaaaactcatccttcttcaaacagaacagtgaccgatgtggggacctccagttctggacatgaatccacttcctttgtcctagctgactcacagacatccaaagtcacatctccaatggttattacctccaccatggaggatacgagtgtctccacatcaactcctggcttttttgagactagcagaattcagacagaaccaacatcctccctgacccttggactgagaaagaccagcagctctgaggggaccagcttagccacagagatgagcactgtcctttctggagtgcccactggtgccactgctgaagtctccaggacagaagtcacctcctctagcagaacatccatctcaggctttgctcagctcacagtgtcaccagagacttccacagaaaccatcaccagactccctacctccagcataatgacagaatcagcagaaatgatgatcaagacacaaacagatcctcctgggtctacaccagagagtactcatactgtggacatatcaacaacacccaactgggtagaaacccactcgactgtgactcagagattttcacactcagagatgaccactcttgtgagcagaagccctggtgatatgttatggcctagtcaatcctctgtggaagaaaccagctctgcctcttccctgctgtctctgcctgccacgacctcaccttct

SEQ ID NO: 171017 - DNA, 144 bp, Homo sapiens
ggaacataaactactgctggaatgtgtcctgctctgagggcaagtggcatgaccccctaccagccttgaggcttaacggctgctggactactcctgcctggtgccctgccatccctgatctgccgctacatcttaccttgagag

SEQ ID NO: 171018 - DNA, 517 bp, Homo sapiens
ccattaacctttattcctactttcagaatagagatttgacattgcccagtgggattttcccatcataagtagtactgagtttgggattccctcccgctattctttttttcttctgcttgaaacaaataaatcttcagtactgactttccttttctttctttttttttccatatcagcaaataattggatatctgaaatttttcttgaagtgcttttttggcatttacaagcattttaaattataatgctgtttttcagagatggaataggatgaaggttaaggttggaaatcgaaggtgatcttccccctttagtgaatgagtaactctcagatcctctccagatgtcaaattctgttttgaaattggatgtaactatttacctatctcacaagaccaagatgaaggcatggtggatccattaaaggtttgtttgtacccttctcctctcacataggatcccagaagctacgggacttcccaagaacagtaggaagctgagccatctagaatcaccc

SEQ ID NO: 171019 - DNA, 458 bp, Homo sapiens
  misc_feature (41)..(41): n is a, c, g, or t
  misc_feature (86)..(86): n is a, c, g, or t
ttcatgactggtatacctgacaacaccggcaatgagatccngtagaggtggtattaaagatggtcactgagattaagaagattccnggtatttctcgaattatgtaataaaaactttaaagcggttactgtgcaaagtgttccaaaaagccacggtgaacactcttgaaataacagaaatagtctcagcaaagaaatagaagacatacagaaaaaccgtggaaagctttagaactggaaaatataagcttgggtaggctccatagtaaaatggagatgccaaaggaaagaatcagtgaacttgaaaacagatcaataaaaattatccactctgaacagagagaaaaatgattcaaaaccaaaagtatcttgtgacctgagaccataacaaaaggtgtaacatttgtgtcgtgagagtcctaaaagaagagaaagagcatggtggggctgaacaacaat

SEQ ID NO: 171020 - DNA, 329 bp, Homo sapiens
tccctactcccctccctgcaacccagctttcagattgtccaccttgctgggtcctcccacaggtgaactccaggctgaacacctggagtctggtgccagctcccccagcgccgctgtgtcacctgctggaggagctctctcctcacttgcccaccccacgccaccacccccatctccttcaccctctccaccacctcaaccatcagcttcatctacagcaccccgtgctgaaacttgtagttggccccaagaccgacaggctgcctgatacgtcatttctctaaggggtggtaatggctgggattatatgctgttgtctctgtgaatgc

SEQ ID NO: 171021 - DNA, 451 bp, Homo sapiens
ctcatcctggccctcctcttcccagtcccaggtgccaagcacctgggggtcagtcccccactgagtggtgtcttcatagaagtggagattccttttctgtttctctttcttgttgttcgtagttgattttagaaatgacacgggggctagagctttccccctgccctctttatcaggaactctttttagctttttctgtaactttttaacaaattgctgatgttatttgcaaaaaacagatgatacagaattgtgtgaagcagaaacttcttctcccaactcagtcacctcttttcagggtgacctcggaggcaaaagtggtatgtattttccattcttttctctatgcttataaatatatttcaagaattcagtccatttattatttatattggtatatctggtaaagcgaaatacagtttcttacttttaataatcatattgttgcaca

SEQ ID NO: 171022 - DNA, 339 bp, Homo sapiens
cagtgaactatttacagctgaagtatgtctgagatttgcttcaaaataatccaaggaggggaaagataactggggatatagacagaacaggactggttgatggttgttagaaacaggtgataagtacttcggggctcattatactactctgtctacttttacttatgtttaaaattatccataatttgtggagaggggaaggtgaactaaacacaaaattacaatattctgaaacaacttattatgctttaacaaatagtgatttagcatttcatgaaatgttttataaaagattttcaattaaccaatgtatcagtagatgatttctagtccagtgca

SEQ ID NO: 171023 - DNA, 602 bp, Homo sapiens
caggtcccggccaggcgaggccatgtggtagaacacccacattttgacaactgttcttacacacacaaactcctcagctgttgagcaacaagcttcccctgccacaaactgcaaccaggagaaaagcggcaacactgcaggccaggccacaaggattcacttttcccagtctggatttacaaatgtttgctcatctgttttttaacccgattcacacagcgtggtgtctcagaggctcaggcatgtgggaacagcattagggatgatgcacgtggcactaggaacaggagtgccagcgagcggaacagccagggacgccaagcaacacccaaggcagagcaggcccgaggccaccaggctgtctctcattcttcaggattctcagagacagtcaggcaacaccttctctctctcctcatctcatacctgccaagaaatcctcttctaacaggccatgattatcacatgttattaatgcctgctgcctaagatcagggaggtctatcgcttctggagacaagtacttggtgtccctgttgtgttttgatttttaaaagaaaaataacaatgaaaccatgttaatccaattcttcttttatctc

SEQ ID NO: 171024 - DNA, 623 bp, Homo sapiens
cggaatggatttgatacatgatggttagagacatgagtaagaatcagttcaagcaaacttagtttcaaattatacctttagcatttgttagctagttcacatggggaaagtctcagctgctctgaaataaatggtttcctcaactgtaaatactgtctacctcagggttgttaggaagattaaatgaaatgatacagtaaagagattatgtacagaaagaatgtgtcaggattccttccctatctcacacccctacccctctcttgccctacacacgcattcttgagcttaatgcacaccacaggaggaatattaaaggaactaatcaggaatagtgaaaaaggactatttagatgtaggttttctctgtgtgtgtgtgggggggggggtataaagtgcctttccccacagcctacccattcacaatactctcatggatagtcactgctgttatctctgaaaattgtcaatgcaataatttattttcaatttctctctaaagcaactaatttaaaccgtaagtgtcatggaatcataccaatctggacacaccctaacactagatgtaaaacaaaatttgcggaatagacatttgggagtctatatgttagcaactcttccag

SEQ ID NO: 171025 - DNA, 217 bp, Homo sapiens
taattctttagcccaaacacaattactgttctccacactgttccattgaacatctaaataagcatcccaaagcttatttcattcaaagaaaagatccagactaaagaataatcccaatgtatgaagtttacattttgtgtaaagtttttttaaaaagggaaaaatctataagtggtaatcaggaaaagacatgagtcattgtagacaggtgttgggg

SEQ ID NO: 171026 - DNA, 561 bp, Homo sapiens
ggctgagggtactctgtagagtgtccttcactctctcctcaagagggaacctctgtctctctattctctatatctttacacctttttaaaaaattacccttaagccagctttcatattcttctcatattgtggttatttggtcaccctattacatataaactccttgaagacaggacaaaggtcttaacctctgattttccttagcttgattcggtgtgaggcatatggtaagtgctcaaccaatattttaaagaaatgaatagaatctcttctttaattcagctatgtttcattattcaagatagctagcattttttccccttaaaacatctctttgggcaggctcggtggctcacgtgtgtaatcccagcactttgggacgccagcgtgggctgattgcgtgagctcagaagtttgataccagcccaagcaacatggtgaaaccccgtctcgatttaaaacaaaaacagaactggagatgcagagttgaaaagccccagttagactttagtgagaagccaaacaagtcaacagactgccagagaaaccatgaggtagaa

SEQ ID NO: 171027 - DNA, 390 bp, Homo sapiens
taaacggtggagctgggattcaaaccctagagacctagcttcaaaggccacattctcaaccttgactccatagctgtcaaccccaaagttgcaaagcagccagtggtggagctaggcccagaatgcaagtctcctctgggcagaaaagtcagagagccagtgaaggtgaataaaccaaggccagaaaagccacaatccaggcctagaaggctagtagctcctaggagctaaggaactaaggcctaattgctaaggagagggctccagggccctctccttcaaagggaaggaaggggctgacagtggggcagcctttgcctgcctgcctccctccctgccaacggggagccctgaccaaccccagctgagttgtcacctccctgtgctaat

SEQ ID NO: 171028 - DNA, 464 bp, Homo sapiens
ccctttcctgatgccaggttcacttggctactttcagatttttaactgagcaaaaacccagcccctcaccagtaagtactttgtaagtactcaccagtacttacaaaggcagtactataacaccttcaagatggggaaaccacggttttaaacagaaacacatattttccctcaacatggatgctttatcatatctctaacatagtaagagtagagagtcacaaaaccatgacctatattttccagactgttagaacagcaattgagaaaaactgtttatccaagaaatatctttaatgaaacaaaaaagaacaaaagcatacaagggaagccctctcttccaccctctttctcatcacagttttgcccttatcagataagacaggtaggggttccagggctgttaagctcatggggtatatcattaggaccagctctgtaactggaactgctcaaagaatgaa

SEQ ID NO: 171029 - DNA, 245 bp, Homo sapiens
taaaagctgcataacagacaacctcaaatctcggcatccatcaatagcatttctttttaacacatgtttgtggattgacgtggatttggctcatctaggctgaccgtagcctgacagtctcagttcacatggctctcctctttctgggaccagcatgagcatattctcattgtgatggcaaaaggtcaagaggacacacccaatggtataaacacctttcaaccctgttggcaccttgtctgctg

SEQ ID NO: 171030 - DNA, 213 bp, Homo sapiens
ttccacagccccacctctcacccaccggccccacctgcctctccaccttggggtctacctgcccttcaccccagccctctcagccctctggcaaaccccacgtctccctccaggtgggttcaaacacccctcactgccggaagctctcctacttccccagagactacatcccaaaaaatgccacctgcaaattgatcaagagcacctaagaag

SEQ ID NO: 171031 - DNA, 312 bp, Homo sapiens
aggaggcctcaggtcccctccacacggacctctccataggtctgcttcagcatcctcatgacatggcagatgatttcctcagagcaaattattgatgagacagagggagagggagagagaggggaggagaaggaagccacagtgtttttattaatatcacctagtctcagaaggcatgaaccagcagtttcactctactcttatttattagtaacaggttgttaagtccagcccatactcaagtggaagggaaattaagatgtaccacttgaagggaggaggatcaaataattcatgaacatatttttaaat

SEQ ID NO: 171032 - DNA, 351 bp, Homo sapiens
ttcccattcagaggacttataactattctagaagagctctcagctcctgcctctgctgctcccatcactgggtctctcaggttataagcctctgccgttcgactttgtggactccttttcccaagctcctctcctctgctcttctctctgatatcacacagatgtgtgcagagatgggcaggctggcgtgggctcctgcgcatgcacacaagctcctctgcaaaacctcccaactgcagctccacctccatggcgtcagggggtgttgagtgtagtctggaggactctccccctctactccagaagacaaagcagctgtccctagggctggggctcaaacacaagcttgtc

SEQ ID NO: 171033 - DNA, 264 bp, Homo sapiens
tctacctctgaagtgttcatgggagagtgaaggtagagagtggtccagagcaggtgggccccagcacaccctgtgtgtcaactgattctgagaatcatcaaatagacaagaatttaagtcttccgtttctgtggtcatgattaaggtgcattttttaaagacttaaaaacttactggctttaggaaggagagtttttataacctcccagcacaaagtgacatactttcattttctgctacttctgtgtagtgttgcttcactgt

SEQ ID NO: 171034 - DNA, 507 bp, Homo sapiens
acatgcttctcgtgtatcacttgttcttccctcctggtcctcctgttcttcctaagtggaggagaggcgtcagtagctgtgagaagaacctcaaggctcctgaagtatccatcagactactctggaagggattcccactgccggccaagtagggctacaggtattttagctcatagcgggtgatgatttgttaaggtcccaagcctcctggtggtcaaaggctgccttggctgctgtctgctgccctgtctctggccacctgactcgtaggcctggggactgaggacatgagctctgttgtttctcttctcagatctgcctagttacacaacttgtatggtttgaaaggagaagactctgggtgccaacttcattgggctgaggagctagggcaaaggtcttatgtgtaatttaataattctagtatcatgagaagaactggtcttcctttaattgttctgcctagcatgcttattaattctcttccatcaataaaattctaaggta

SEQ ID NO: 171035 - DNA, 331 bp, Homo sapiens
gtaacaggaaagctagtagggattctcagctcatttctttgcttattcactttttgtgggaaactgtgcctgaggttaattcagaagatgtttacgttcagctgtatttatgtaccaacatcgtgaacatggtctgcaaatacaggaggatctggatggacatagcagagattaaggtgcatgtgggtgtggcaaatgatgatacatttgcaaatctgcaggctgtaatgcctcactcttcttcactactgacactaaccaagctttatagatttttcgtcctgtatgcacttcaagttgacttgaagtcatgttcacttatgttatctgc

SEQ ID NO: 171036 - DNA, 355 bp, Homo sapiens
gattgtctctggtagccaagtgaaaatgcagcttaaattcagttacaggctatttctgtagtccagatatacacgcattctgttgtttaggtcatggatgaaacttataaagcctgtggaagtgaatacatactaattccttaaatcattttccctgtcaaggagtcttttaaaccatcctttggtagatgttttattgtatgtctcctaaatacctaattataggtaaactcataacttctggaatccagctggacaagtggtagaattactactgttatgagaactgagaagcccaaccagtgtttgcacctgaatgttgagtgatcctgtctgttcaaggatctaagtgcca

SEQ ID NO: 171037 - DNA, 518 bp, Homo sapiens
agtctacatatagataactttatgcatagtccagagtaaatgacaaatacagaattttaagcattaaaatgacattaatagtacgccagacaattcttggaagactagcatgaagatttgtatagatatagatgtagacataaatttcactttttacacgtgggaatacagacaaattgtaggaaatatatacaatataatcataaaatgtgcataggtgcaaaacatcagaatgagaaataactctatccctcactctcatcagtctctaatgtagactctactacattcaggttgattttttcaattgtttattcatactaacataccatgctacctcttacccacaaaccttccttgtgtgttttgaatattgttatcattcgtatgtaaaacgtacccatgttcaggacccagattaactgtcatctttttcctgaagctgtatttgaccttgtaagccctcaccaatatcctctctctttgacttcacattgcagctatgattcgaatctttc

SEQ ID NO: 171038 - DNA, 191 bp, Homo sapiens
agtcaccttcccataatttactgcccttaggagcccaagtccctttcctttgactatcacctctccacaatttattgccctttgttaaaatgatatataagctccttcatttaactacatctttgggttttcacttcttatctttgatgctacgatgcatgtaaaaatattaataaaatttgtgtgctttt

SEQ ID NO: 171039 - DNA, 712 bp, Homo sapiens
cctggatggctgcaaagacttcttttgaagaggaaacacctaacactaccctgttgtttctcctgtcccttatccttctgagtagactgggaccaagtatggcccgccttgtgaatctaaatgtctacatgaggccaaagtctctttggtgggtgttgcagaatcaataaagatttacagaaccccttctgatagtttgaagagaggatttgatacagaaaatgcacctatttcctgcaaagtaggggactatctttcagtgatgtttatccacagtcaagtttgaagctgtgaaacatttaatgaatcactatgtgctgagctgtactacttactacgacagacacatttcagaaagacactccaacatacaggtttaagtacaatataggtcttgggttactaccatggaaatatacatgctgtgttaatcacacaataaaaactcacaatatatatattttatcttgcttctcatcagcaaaaataaaattaatatgaatatataagttccatagagcactacgggaaaatttatatcaaagaaagctttatatttgtgtaatagtctagctttcagccttatatttcgcaaatacataatcccactgcagaaaatttgaaaatatacgtagcataaaggtatattaatctcctgaaatgacaaattttagagagagacatgtcaatattgctctgaatagcttcccga

SEQ ID NO: 171040 - DNA, 402 bp, Homo sapiens
tgcttcttggaatctgtgcatgctcattcctaagcttgtaataccttttccctattctgtatctcagaaagtgtccttctttattcccaatccctgttctctctcagtttggaagtaattgttcttttattgcaaattctcacagcacttagatttttatctcaaactctttaatgtaattaattgttttcatccatataatatagtcatgtgtacctttatgtaccacatcttcctttccacataggaagctccttgagggcagaagcgatgctctttgattcattttgtattcttcaagatggactagaacagcgtagtcaccttgtaaacctatgtggtggatagggtcggggaagaaaggaaaaagagggaaaaggaagagaggaagaaatcaaagaa

SEQ ID NO: 171041 - DNA, 781 bp, Homo sapiens
gaataggtgatagcacagttgaagcttaaaggataagaggacatctgcataaagggataggagaagtgccattcagagagtggaatcataggcacagacaaacaggattacaaatgttctgggaagacagtggagtggtacagaggatactgatgtggggatgggcaaaggtaagaggtttcataactgatgacctccattttcacaatgagtaggtcatctatgagaataagttgagcaggatcaaatgaagacttataacagtgaagaatattactgcaatttgtactgtagcacgaaaattgtccacacattgaaattaggactatattattttattttgggccacagttacttgaaacagattaagtaaaaactcaaaaatgactctaatgtgcatgtgcaattggcatgcaaaattttaaaaccatttcaaactacatcaattcttggtctatctgaaaaataacaagctaaaaaaatcaaacgttaaataactggttccaataaatttaaattactcattaaaaagaaaaagcactacaactttcaaattaagaagttaaattagcaatttagtatctaagtaagactcgttttctgttggtctgaggtttaaatgggaggagaaatcttttggaaaagacacatctcaaaaagcactccaaagcagaatcctttaggaatatcctcatgtcatagtatctagttcaacattatctgaataaagtcaaaacaaataaaaaaattttaaaattaagccaatataataagaattggg

SEQ ID NO: 171042 - DNA, 400 bp, Homo sapiens
gtcatgatgctgtttgttcaacatcaaggaaaggatgcattcagtgaggtcaacagaacactgcttgcttacagcaccacagcacatctcctcttacagaacttactccactggaatacttttctttggttatttcacactcactctgctatcttttttagtacaataatgcactatttctttgcttgtagtgcataatcagtattttaacagctcactgtgaaattctcgaggttccataaattcatctctgccgtatttaatacaactaatgaaaaacgtatatctgaatgtttcaccaataccaactgtaggttagtgtttcaaaatatttacttacttataactaaattgcaataaaagtatgcttaaatttttctgttcaaaaacagtaaaactg

SEQ ID NO: 171043 - DNA, 278 bp, Homo sapiens
tcctggactgctcatcctcaatccagaatttctgctcctgacaaccagccagcaagttattgatgcactttacaagactagcatattcttcctgaactaaactataggaaagtacctgaattcaaactcccatttctatgagccacatggaaattatccaagtgaaaacaggcaagataataggtattcatctagagatcaacctaatttcaaagaatgaagcaggttttctttcataagtcaaagaagtgtgtgtgtgtgtgtgtgtgtgtgtgtgt

SEQ ID NO: 171044 - DNA, 245 bp, Homo sapiens
tgcagtgcatgttatgaagacacgcaatgatccttttcctgtcagcaaatccaggagctcagagattacctgttttctatcttttcagtcaactatgggaatccctgaaagaccttggtttcttgttgacagaagttgagcattgctaccatcaggaacaacccaggtccctcttgatgaccaacctctaaagcctgccagtgcagttgcaacctctacttttcattggcccacttcatcccatc

SEQ ID NO: 171045 - DNA, 403 bp, Homo sapiens
  misc_feature (355)..(355): n is a, c, g, or t
tgtctgtgtgtaattgtacaggatatggttattggtatgaaaagtatgatattcttaactttctgacttgacaattttttggatcttggcataaattgtatttttgtattctgtcttctaaggcaagggttcccaacccagtttccctgttaggaactgggctgcacagcaggagaggagtgccaggtgagggagtgttattttttttttctttttgtactttaagttctagggtacatgtgcacaacatgcaggtttgttacatatgtacacatgtgccatgttggtgtgctgcacccagtaactcgtcatttacattaggtatatctcctaatgctatccctctccccttccnccccaccccacgacaggccctggtgtgtgatgttcccctccctgtgtc

SEQ ID NO: 171046 - DNA, 192 bp, Homo sapiens
tggtctgacaaaggagattttcctcatgtgcaacacggatgaagcgagtgtacctaatatcttcaattgcctagctatcctctcaaaatcaaatctaattacttgaatgaccaccaaaacaaaacatcctgctttacagagagattttaagtgtcaatgatggctaaattggtgatttctgtgaccttcaga

SEQ ID NO: 171047 - DNA, 6943 bp, Homo sapiens
gtgggggaaccctccttgctagcgttgcaaagaagggcccagctccgtcaggaatccagggatggagaactggggagcctgggccccacatgagattcatggcaggacttgtctgaggggccccagtgccagcgacccagccccctgtgcctggcccctctgtgggtctcaggacctgggtctgggctgggtgtttggaggaacctcctcccggctctcagacacctctgttttgtctgctgtggatgacttccagcttggtccccctgtggccctggcaggagtatcaccatgggagagggcaggacaggggctgggcgagcaggcctcccactagaccaggctactcctgctgtggaccagctacttccacctctgcccttggcttgccctcctcagagttctcagcctgagtgggccctggggacactgtcaccagagaccccacccctcatacccccagggacccagacccacccccagaagccatgtgacctcctcggctcagctgtgggaggcatgggctctgtcccacatgctgcggtagccacaaaggtgatccatactgggccaggtgcaccccgaggtgcccccctggaccactgcctccctccctccccctggcaccggctccagtctcctatgtgggggctggggagggggctgttggcagccatgccccagcaagcagggggcttgctgagggctgggccactgaccacctccccggcatcccctcaggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtgagtgtcaccccctgccaccagccatcatggggaggggccacaccagccccttgtcccatgcccccccatgtgtccccagtgctgggtcctgaactcaggcagtgaggcctagggtcccctccccgggcctctgctcctctatctcaagaggggctgctgtgggggcctggctcctgagccaccagtgcccacctctgatctcagggctggctttgggcatctcgggcaggacaggtcctgagtgctccgggccttgccccgccctgtgtcacccatgcctgtctcagactcttgggggccttgcagcctccacccctacagtgctgccatctggcttctcagcagggaccgagtgatgcccctctcccctctactaccccccacccctctacttcctggtgtcacgtggaaggcagctgcccgggtttgcctgtgactccacacccagcatgtctgtcccctgccccaggtcagggtggggcctcggcttccgcaggaagtggtcttggtgccagccctgctgccctggctttgagctggggcccagtgccctctgggtcctgctggctgcagctggccctcggggaacccgcacacacagcaggaggggcctgcccaggcccagtgctgactctctcctgccatgctctcgggcccagaggtgccatccagcccctgccgtctatccacccatctgttcctcgtcccccaggctgcagggctccccacgccactgctgtggccgcctcacctgctccccctgtctctttggtcttgcagtcggcttctctatggccacagcctacttttagaagtgcagctctgttaggagccttgaaggtacccggtgcgcgggacagtgcggcccgccgcccctgcatgcccaggccgcaccccattagcatccatgattcctggtagcatttggagactgtcgctcatgtgacgtggatcatgacatggctccgggggccctggccatccccagccatagtggcatttacgaggcagatccagggttcagctgggtggccgccttctcactggcctctcctcccctcccctccctcagtcctccctcccctccctcagtcctccctcccctccctcagccccttccctggcgggcagcccgctggagcccccactgtgcccctcctatccccctccttctctctcctgcccccatctcggaccctcaggctgttggttctgagttcgcctcccactccctccctgtccttgccaaccatgccagtgcctgggatgagggcacccctgaggccggcgctccgagccagaatcccggatctgcttctaaatggcttcccagccactgtgaccaaatgcgtagatttgggatcttgaatcaggaagctgattcaagtgctggccatctgaacgcatctgcccagaggcgcccctgcaggggggtgacccacctgccgggcctgggccgctctgtgcacgagcacggctcgtcatgggggcgcggtgggtgctgtctcgggggcatctggcatgtgagggcccctctggcctctgcaccctggagatgcggctgcctccctctcagcagctgttctgcccaggcagggacctcctgggcccagctgtccaggaagattggctgtggccaggtgctggtgggctgggagtctgagcccatcttggcagggctcagggggcagcaagccagctgcgggccttgggggctcacatgagtggagggcagggcaagaccagaaaaggctgcctgggggaattcaggaaggcttcctggaagaggtggtacttcctagggcacgagtatcaccatgggagtgggcaggacacgggccgggcaagtgggcctcccgctgcacctggctactcctgctgtggaccagctactcctgcctgagggtggggcacacacaaccagggagtgccacgccagtgtcccctgctagcgccgggggctgcgggcctctgagcaggtgcaggctgtggtgggccaggctggggctcgaggtctctcctccggagggaaagaccttctctccatgcccctcaagggccccacatgccctggacaggtcaggcgagggcagtttctgccggaagggtggggtgggccatgtgtacttagatctgtagcagctactgtcccaggcagagctgccctagggaccctgctcctgaaggccctggtgtgtccacacacccccagcctgaggtggcccagcccctcggaccgagacacgcatggcacgtctgtggcacggtctggagagctggccctgggggagcagctgcagctgggctgggacccctggcaacagctacatgggctccttctcttgcaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccacgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgctgcctccgtagttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacggggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccagggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 171048 - DNA, 407 bp, Homo sapiens
  misc_feature (88)..(88): n is a, c, g, or t
  misc_feature (153)..(153): n is a, c, g, or t
  misc_feature (159)..(159): n is a, c, g, or t
  misc_feature (189)..(189): n is a, c, g, or t
  misc_feature (192)..(192): n is a, c, g, or t
  misc_feature (203)..(203): n is a, c, g, or t
  misc_feature (205)..(205): n is a, c, g, or t
gtggtaaaataatccaggcgtcagtcaaaggcatttaggtgactttaatattgattatattgtaaccaggaatttaagaaaatattantggaattaaagatatatatatattaacgaagaattttgtttgatatgtgtaggttaaagtaatantcaagntgattaagttgttaagtattgtttgtaatnatnaataaataagngnatttgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 171049 - DNA, 261 bp, Homo sapiens
ccaggccctgggagctaaaacattctttcatcaagtgaaaaggagggtgttttttaaaaaaatgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 171050 - DNA, 2807 bp, Homo sapiens
ttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagttaggaactgagagcggcgagtgacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccagggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctttccatttttacctggtttttcaccccaggtgtgtgtggtgtgcatctgtgcgcacctgtcctgagcctgccccgggaggcgcggctgacctggccacggcacaggcgggggtgcttgtgaggcaccagggctgctcaggacggccgtctgggccttgccctgaagcctgtatctgccttgcaccgaccacgccaccctctgcaccatgcctaagcctctgtcaactcccaaacgtggttctgataaacgtgctcaccagcacgcatgggcttcccgttcgctcagcctcctgtgccacttacttaccaggtgcccgtcggagcctgcgcc

SEQ ID NO: 171051 - DNA, 1228 bp, Homo sapiens
ttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagttaggaactgagagcggcgagtgacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccaggcagttttcccggcgttttaggatctgtacatagagaaatatttaaatttttagaagcaaaacttatacaacattaaaatgataccaagtcc

SEQ ID NO: 171052 - DNA, 2474 bp, Homo sapiens
ttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagttaggaactgagagcggcgagtgacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccagggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 171053 - DNA, 2424 bp, Homo sapiens
ttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagttaggaactgagagcggcgagtgacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccagggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 171054 - DNA, 2062 bp, Homo sapiens
ttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccgttaggaactgagagcggcgagtgacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccaggcagttttcccggcgttttaggatctgtacatagagaaatatttaaatttttagaagcaaaacttatacaacattaaaatgataccaagtccctttccatttttacctggtttttcaccccaggtgtgtgtggtgtgcatctgtgcgcacctgtcctgagcctgccccgggaggcgcggctgacctggccacggcacaggcgggggtgcttgtgaggcaccagggctgctcaggacggccgtctgggccttgccctgaagcctgtatctgccttgcaccgaccacgccaccctctgcaccatgcctaagcctctgtcaactcccaaacgtggttctgataaacgtgctcaccagcacgcatgggcttcccgttcgctcagcctcctgtgccacttacttaccaggtgcccgtcggagcctgcgcc

SEQ ID NO: 171055 - DNA, 121 bp, Homo sapiens
tatatctaaaattggtttacatatcaagatgatttatttaaactagaccaacatccacattcatttatgctatggaaatcagctttgattgtcttcgtagccaacttggaaaaaaaaatct

SEQ ID NO: 171056 - DNA, 458 bp, Homo sapiens
atgctagggtacaaaatgcttttttccacagccagtgctatgtcagtgctaagggttactgtgatgtagcaacttgaagatgatgaatgaatacatttgaagaggggatgtttgaaaataattctatagaactgcatttggtattgggactgttgtctaaaccataacctaaactactttatgcagttaggtaatagtctcatctcagataacaaaaggaagaagcagagacagaaggagaaggagaggtctgtgagaatccacagtcaggtggaaagagtgtaggcagaagatgcagggaataccttctccctggaaggtgctgggctggtagctccagaatcccaaggccagagcacaggggtgaaaccccagcaagggagagagaattagaatctgcaagaatctcagaaaaacagatttgaatgtctttttatgtggcaaaaccatgggaactg

SEQ ID NO: 171057 - DNA, 515 bp, Homo sapiens
caggaataaaccaatagcatttttccactcctgcctcctccctcaataacctccaccttcaaggaggtttctggatgcccaagtgacagaaagtcatcagtcccctttttctcggcaggagaactgcccaatcacatggccctacagcctaacaggtgctgtcaaatcgctgaaaaggcaggataagttcttgacaaatcggtggcgtcagaaaatcaattcccaaataccatgtaatttactgacaagcccaccagggcattcatattggacgggaacagatttcttccctgctattgaaacttctaaaactaggcctagtgttagaagtttcaatagcactagttggagaagtccccaggcagctatgaagtaatagagtgtgcttaatcatttgtaattcagacatgctatggaaacttctaagactaggaaacctcttcaaattgtggactctctatgtggaaaggtctgtcctgcacaaattatcagtttgagaagtttcaatagcagcg

SEQ ID NO: 171058 - DNA, 425 bp, Homo sapiens
ctggctttgaactcaggtgtgtctaacggccttgcttctcgttggctcatgtgaggtgcaatgttgatttatctcaggaagctggattttgtggaggaatagaggagtaacatgcagcttttttttttttttggtacaactttaatgagttagatttgtaataatgagcttgtattgcttttgtacctaaacatataaatacacatacacatatacatggacatgtaaatcgacctctgaacctttgagttcctagtaagtctacacacgtggggtgaggaaagccttcttcccttcacccaaccattgagccattcagcaggccagctgtgtcctgccagccacctgctctcctagccaagtctcacacaccagccccctttcctggcttcctctgctaagggtcccaccacctccagacttgg

SEQ ID NO: 171059 - DNA, 724 bp, Homo sapiens
acaccttgccccacacatctcgtcatctgcatcctttgtaatatccttcaaaataaaccaggaaacatgttttccttacttgtgtgagtctgtcaagcaaagtaatggaacccaaagagggggccatggggatcctaggaagcatgggtaaacaacctgtggcgtgggagtggcatcagaaggggcagtcttgtagggatgagccctcattctgtgggacctgacactatctccaggtagagtgttgagactgaaggggagggtgccccactggtgtctgctgtaaaactgattggttgctggtggggagaaatccccgcacatttcttggtgaccagcggtcacagaattcttctgggttgattgttgtgacgcgaaagcaggagaaaaaccgctttttcttcaggagggaaaggtcaaaaaatcctttccaaaatatactgaaagctatgaaacagaattcagaagttccaggactcctccaagttcatctacaaacaagaaaaggaaacgtcaaggagtgcaggctgcagcacggggggggcctcccttgccaggtggtgaggggccgacccacctctcctcctttgggggacacctgaaacagatagcacaatgcctggcacacagcatgtgttacacaccacagccaaacggcaggcgtgggagctatgaaattccaagttgcggccaggcgcggtggctcatgcctgtaatcccagca

SEQ ID NO: 171060 - DNA, 662 bp, Homo sapiens
ccttttaaaggtgcacaagaagatgtttattacatgtatcacatagctcctggaggtattgctttagtttgaggcaggtaagcactttaagaacacagcattctctcacagtctacgaagctgtgaagatgtgtcaggagaggaaattgtccagcttcgcaatggaccattttccttgggcttttggatactgctttttcatttaaatcagtgcctgggtgtgggcttagatttttcaggggcttcataggctacatagttgcagttgcctttagagacataaagaggaacaaaaagctctgtgcttgaataacagtctgttttgaccaggaaaaaaggcacagatggaggaaaaccctgaaggtacagcagggatcccaaggcccaaggcagggagagaatcttctccgcctccttgagtcctcagacctgcaggcttctggtgctcccacttagatgcctcgctgtctttttatttcattccagaaagaattccatatattatatttgacccttccgccaatcctatgaagtcggacagctacctgattttacagatgaggggaagggggctgagcagggctgccagaactgggaaccaggaggccatgatgccagagtaacaactggggaggctgagcccacacgtgcccatttggttt

SEQ ID NO: 171061 - DNA, 374 bp, Homo sapiens
tgtgggtggctcccatctcacctgtatttgtgtccttatcagtgtccaacccagggcctatctgctgaatggatagtgaaataatcactagataaataaatgcatgtagagatgcataaatggattggtgggtgggtggatggatggatggatggatggataaatcgatggagacagacagatggcctcccctttagtccagggcacagagatggcttcatgagtactcatcctcctgagggccccatgcttagaagggcctatgtttggtttaatgctctgcagtcatcattttgaaattgttaataatttttaacaaagagccctgcatttccattttgtgcttgccccacaaattatgtagcttgtcctgc

SEQ ID NO: 171062 - DNA, 246 bp, Homo sapiens
ccattatatcaacaggctaaagaagaaaacccacatgatcatatcaataaatgcagaagaagcatttgacaaaatccaacacccatttataacagaaactctcagagaactaggaatagacttcttcaatttgaataaagaacatctacaaaaaccctacagttaacatcgtacttaattgtgagaaactagatgttttcccaccaagatcagtaacaaggtaaaggatgtcctttctcagaacca

SEQ ID NO: 171063 - DNA, 164 bp, Homo sapiens
ctgtgcacttgggcccccaggcatgcggcttgctccggaaggtcccttacctgtggcactgagcatgtacttcctgcagtgcagttagaaatgcccatccgactctgcttgcaaagtgcagagagggagacacccttacaaatggagattgctggatagagtgg

SEQ ID NO: 171064 - DNA, 462 bp, Homo sapiens
ttcaccatacgtcgaggtcgcgatggacgaagttgtgctgcacacgccgagactccacactctcagagaaacctccatcccttttagctgtcaccctttcagctgtcaccccttaacttccctcatctcctccatctccagccctgggaaaccaagaatctactttgtgcttgtatggatttgcctgttctggacatttcatataaatcgaatcatataatatgtgggggttttttgggtaaccagcttctttcacttagtataatattttcaaggtttatttgtgttgtaacgtgagtgcgcacctccttcgtatggctgagtaatagtgtggacgctcggcgtgtgcatgcacacgccgagacaccacacgctacacagtttgttcagagccaggtttctatgcttttatgtgatttcttccctcaaacacttcttatactctgatgacatgcatacatg

SEQ ID NO: 171065 - DNA, 129 bp, Homo sapiens
tgaacattggggtccttgcatccaaggaccagcaggcaagaatagtcaccatcttagcagaagtaattgaacttgatcagcagaaaaaagtagggctgtacacattggggatgtacgtggaagaacagg

SEQ ID NO: 171066 - DNA, 337 bp, Homo sapiens
acacctgaacataagaggcaaaacagcaaaagttctggaagacaatatagaaacagggccaggcaaggtggctcatgcctataatcccagcactctgggaggccgaggcaggtggatcacttgaggtcaggagtttaagatcagcctggccaacatggtgaaaccctgtctctacaaaaatacaaaaattagctgggcatgatggcagctacctgtaatccaagctactcaggaggctgaggcaggagaatcacttaaacccaggaggcagaggttgcagtgagccgagatcatgccattgcactctaacctaggcgacagagtgagactccatctc

SEQ ID NO: 171067 - DNA, 399 bp, Homo sapiens
tcattgaagtaacttgtttttataaaaattttatagactgtcaaaaatgttttatatttcttatcatattttgctctcataaacactctgcagcaagctcattgatagaccagagctctgagtacttaattatcattgaaaagaaagctagatattgactctaagagccctggctcctactttgaggacctggtccccttggcacaatggctgtaatggctgtgccccaatagctacacaatatcaataggcaaacaatgtgaatgtaagaatgacaagttcacttccgaggaaggaaagaggtccaatgaaagtgtatagttggggatttaacttcactcctacaattgcagtttaccctgataatggctttataattattagaacactttgagctct

SEQ ID NO: 171068 - DNA, 225 bp, Homo sapiens
gttcctgtgtccaggagtagaggtgaattggggctctggatgccaagaacagaggaaggacaaatgccagccccagagaccctcacctcctcaagaccaacaggagctggcgcctgtccgcccagcagcagcaaagccagagcgggtgccagccagggtgggtaggcacaggcctgggcttgaagattgagacagcgctgccccctcctggctaattcacggctg

SEQ ID NO: 171069 - DNA, 561 bp, Homo sapiens
tcagacaggcaagtagtgcttcgctgatctgtgtccaaggctctttggagaatggaatgataaaaacacgtggacacaaagtttcatctttcccctttcacagggaggtgaccatttcacccttggtctacctgggaggccccaggctctcggtgaagacccctgcttttgtggggaatggagtgatgcagcactggaacatggcaggcaggggagacagtgcgtcttcacgttttcccatgtggagaccaaggcttggagactcagggggtctgttcaaaaccactcgatttgtgggctccatagcaccccagagcacatcccctctccggtggcctagaatgggcagaaggaaaagtgcagagcatgttaaatataagtgaaccccaagtttcttttcaaagaatcaatacgtcagtatgttcagctctcttattctttgattctccattttaaagtttaacttcctggttctcttcgcccccttgcttctagtttcagtaaacaactttcccaacagtcctagtcagtagttcacatctgttccctgtgtcacccaat

SEQ ID NO: 171070 - DNA, 587 bp, Homo sapiens
catgtgaaggaattggcaatcaacttagaatggtaaaactggaaggaatgttagagatcacgacgactttcattttacagatgaggaatcaaacatttgaaaaattattttaataaaaggaggcttcttgaaaaggaaaaacatttttcatggaattctacgtgttgtacaaatccaatcaataatcttttaacacctctctgaagcgctggccttaccatctttccacttcacacacacgaaaactaaggtataagcaagctaagcagttcactcattatctctatgaatcagcatcattgctaggaacggaagccaaaactttgaatgttggaccattctcacagatgtaggctgatctcattcgcagtgatgctggctgggggcgaggggaagccatgtttgggaagtcccctcatggaacactgcatttcacaagcagagtacttgctgactaacgcaaaatgcttccttaaatgagttccaatggataatgcagtctttaagaaacagaacagtacaatacatcagtttcaccatcttcctctaaaacgaagtgcctttgaatcctagacatttaaaatttg

SEQ ID NO: 171071 - DNA, 219 bp, Homo sapiens
ctcccaaagtactgcgattataggtgtaaggtactgtgcctggcgagaaagctctcatatttaatactgactgtagtagggccagtatagtagggctgattataatacaaagaagtttgagagcagcctgggcaacacagtgagaccccatctctacaaaaaatgaatttaaaaagttagcccagtgctgttgcacgcacctgtagtctcagctacttg

SEQ ID NO: 171072 - DNA, 363 bp, Homo sapiens
gttgtgggtggcaatcagaggctcgtggatgacactaaggaagccgtgcatcttttctaagaaggataaaggaaaagaaagttcagagtacttcatgatattgttgttttggtagaggaaaaattggaaaatccacatatgaggcaatgggttctattttacattgtaataaaaggaatgctttgaactgtgcttctgttttctcatttttagattttttatctcctcacatcttcaaatctgtgagcatttgccaagattcttccttagtcgtacatatgggctcccagcattgcacaacacttatccttaaaagttacatgcaatttatccccttcctggcatggtcagacttcccttttc

SEQ ID NO: 171073 - DNA, 427 bp, Homo sapiens
taggccacctgcccagactgaatttctttgaactgttctccctgcaggagagagagctgttggctcgtcccaggtttaataaagagtggccacagggaggtctcccatggctgagagttcattagctgggcaaggccaggctgcaggagtgctgagtcttgctgggaaacagcctcataaataattaaagctcggccacagctccctgcctgtgctgtagcccgcatctggccctcagtgtgcggcctggacgtgtgctcctgacactggacccagcctcatctccttcgtggatggagccatctgacgacagtgtggctcctttctgaacctccccgtcttcacctgaccgggcaactccaccatccagagtcctcctggggctcccaactatccagagaataaagtcagtgtagactcctctgta

SEQ ID NO: 171074 - DNA, 264 bp, Homo sapiens
cttactgacaggcactgtgccacctacagggtacagaaatgagtaagtctcatgcctgtaatcccagcactttgggaggctgaggcaggcggatcacctaaggtcgggagttcgcgaccagcctgaccaacatggagaaacccccctctctactaaaaatacaaaattaaccaggcgtggtggtgcatgcctgtaatcctagctgccccgtaggctgaggcaggagactcgcttgaacccaggaggcggaagttgcagtgagcc

SEQ ID NO: 171075 - DNA, 398 bp, Homo sapiens
atctacgcttgtgttttggggaacaaaatgaaggaagtaagcttacaataactttgtgtttaaacaaattcaatcaaaacacgcagaaaaaagagccaggactgaagaaaggatagttaagtagtctttcctatccagttatcaaaattcttaggattctaagaagatgccatctataaagtacaaaaactgaaaaatgctaatgtagctactttgacatgaaaagtgtctttggtgcaccaccgaagtaatccactgctgactaccttatcatagaaatgacaatgcaggaagaagtgagaatggagacttcatgggaaagaagtactagggcaaacctagaaggtctgaccctggtctctctaccactgaaggtcaatatgctaccccaccaaatg

SEQ ID NO: 171076 - DNA, 175 bp, Homo sapiens
acggaagcatatagtattctaatattctttggcaaggagatgaaaacaatccactttccttctctttagccctggtttctacattatcagtgccttgtgctccctaagacataaagaattatttgttagtgggcctacatgatccaccaactgatcccatatcaacttttttttt

SEQ ID NO: 171077 - DNA, 329 bp, Homo sapiens
gaagatgatgaaacttagatcaagtcatcactttgcctacataggagtggacctataatttgactctctccaaagtggatagtatttatattgggatacttttcaccaaaagtgacagaatatcatgcctcatattgtcttacacaacaagacatttattactccccataatgggaagtctggagatgccatgagcagggtggcagggctccagctctcttctgactcatttagctcttcctcactctgatacttcaggttggagacaagatggctgccctggtcaaggcctcaggccaagcatgatgatggcattttgaagaaaggtg

SEQ ID NO: 171078 - DNA, 207 bp, Homo sapiens
cagtgctggggccaggccaggggctggtctctgctcaggctcaaggtacacagggatgtggatctggggaagggtgctctccctggcctcctgacaacatgcacatctccacagatgccacacatttaaaggctcaaacctacctcagacactgctctacccatccccatcccctgcaagggcctcaccttcaccttgcaaatgtga

SEQ ID NO: 171079 - DNA, 612 bp, Homo sapiens
agaattgtgctttcagactcacaaggcctataaagtagcaagttggtcttggtctttctggccatgatcataaactttcaaccagcagccaggtcataacagggaggcactggaaggtgtaatgacaacaggttgtacaacatcagtgaagtggagccaaggacaaaggaagaggcaaggagagggagggatgttttacaacttaccgggaattgtgaccagtatgatgcacagagtttcaggcttaagatagggatgggaaaaagtagagaggggttaacaacagatgctgatctgtggctttcattaaataagttcacatgtgttcttaaggacctttgaattttggaacatctgtgacaatttatgattagaatatttgatgaaatggtttaaactgaacagaaaaacttccataccagagcatttttatcagatttttaaaaatgcacccaaagtctctatgaaacatataaaaataggcttatttgggtgtaatgtgaaagtgaaccagtccaactgtgccaccaagatcctgcctctgatgatgcttctttgccctcattcttctctgcctttcagagaccagccagaaaaatcacaacattcaac

SEQ ID NO: 171080 - DNA, 790 bp, Homo sapiens
  misc_feature (661)..(661): n is a, c, g, or t
  misc_feature (666)..(666): n is a, c, g, or t
ttttcatctttcttctgcccaggaagaaaatacttcagggatcttaacccaaaagcatggaggtccacaccatcctccaggatactacagttgacaactggatcccatctcctgtggattccctctctgcctaagagcagtccccgctgcatccttgttagtcaaggcgactgaggagatagtcatgggattcctccctgactgtgttttttcctcgtgccatggaagccgttttacacactcatcacacttggcatttttctgctagcggactgacctcctatgaacctcttctacttactattcatcatattattcaatcatgctgcaataaccttaaccctgtggctctctggacctctccatcagatgaaacaccacatggctgcttaactctgacagaccagcttttaattccttgggagcaattcctgtggacaatgctgagttgtcctggtttacagatggctcacatttaaagaatgagtctggcaagtattgtgcaggctgtgcagtcgtgacttcctttgagattgtgaaagcagctcatttactattaactacttcagccagcaggcagatctgtttgccctcgcttgagcctgagtccttgctacaggaaagacaatgtttatgtaagcagcaggaaggggagaatcgnagtgncattgaatatgaatcaaagctaatggggcctgggccaatattcaaggatcagctaaaatattctgtttcaaaaatggtatgggcacaagggtttggtcggctaagatcttgatagtcctatgga

SEQ ID NO: 171081 - DNA, 510 bp, Homo sapiens
tagataataggggttggccgatgggaagcaaaaatgcccccagagctttgaacccaggtgccattcattatttctatgccatctgccaggcattgcatagctattatctcatttaatctcctcctaatcttgtgggttggtattttcatccttatatcagagacgagaaaactaagggtcagagaaaattagcaattggtctaaaattgtacagttgtaacaggatctagaacagggacttcagtacaggcctccctgacccccaagcctgtgttctttctactgtactaggcttggaagacagcgtacgtgagagcaaagacaagctctgtccactctgtgcatattcagtgtaggtgctggtgagattcccgccttcaggtgtccagcaagtggttggagacatggagccgaatctcaaggacattgggaggattgaaggtcaaggcttaagaaccatctgcatcctcatttatttattcagcagctatttgttgtgtcttcgtggac

SEQ ID NO: 171082 - DNA, 386 bp, Homo sapiens
cgctctgaaggatgccacatcttttccaatgaattcctttccaacttatgttaaccaaagatggtttctgttgcatgcaacaaaacaacaaaagctagtagaaccaccaacatggtagaaacccacatctaccacagctatgccctctacagcatgcctggcaattgagctttactatcctcggatggggagctaatattattatgtagcaaccagttggtcagtatgggctgttcttcgttagcctgcacagatggacctcagtcctacttctcctttagaactgcaccacaaaaattctgtacaagagctctttggacatttgatgacagtgtaacctctgagctagagaggccaatcctcgagtatctccagactccttctaa

SEQ ID NO: 171083 - DNA, 101 bp, Homo sapiens
tgttcacatctcagaaaatccagtaaacagtgaaaagacatgcctcagagaaggtatttatagctgatataactgacaaagattggtatccagcatgaata

SEQ ID NO: 171084 - DNA, 946 bp, Homo sapiens
  misc_feature (40)..(40): n is a, c, g, or t
  misc_feature (157)..(157): n is a, c, g, or t
  misc_feature (555)..(555): n is a, c, g, or t
  misc_feature (614)..(614): n is a, c, g, or t
tcgtgccgcgaaagcagcggcggcgtttgcttcactgctnggaagtgtgagtgcgcgaagatgcgaaaggtggtttgatcaccggggctagcagtggcattggcctggccctctgcaagcggctgctggcggaagatgatgagcttcatctgtgttnggcgtgcaggaacatgagcaaggcagaagctgtctgtgctgctctgctggcctctcaccccactgctgaggtcaccattgtccaggtggatgtcagcaacctgcagtcggtcttccgggcctccaaggaacttaagcaaaggtttcagagattagactgtatatatctaaatgctgggatcatgcctaatccacaactaaatatcaaagcacttttctttggcctcttttcaagaaaagtgattcatatgttctccacagctgaaggcctgctgacccagggtgataagatcactgctgatggacttcaggaggtgtttgagaccaatgtctttggccattttatcctgattcgggaactggagcctctcctctgtcacagtgacaatccatctcagntcatctggacatcatctcgcagtgcaaggaaatctaatttcagcctcgaggacttcagnacagcaaaggcaggaacctagagctcttccaaatatgccagtgaccttagagtgtggctttgaacaggaacttcaaccagcagggtctctattccaatgtggcctggtccaggtacagcattgaccaagttgacatatggaaattctgactccgttaatatgaacgctggttgattgccggcgacattgctactacgcttattgccaatggcatcacgttgacaccatatactgtgacagcagctctggtatggttttccaacataagcctgaatctctcaaacatctgatcaatatctgagggccccactggttcggagaattacttacga

SEQ ID NO: 171085 - DNA, 290 bp, Homo sapiens
ggataatagccatgatctgtggacacatacgcagcaccaggcacacggataccttatctttcatcttcctgacaactcaaagacttagggatcagtattcatccccattttacagatgaggaaactgatgctctgagaggttaaataacctgctcaaggtctcacagccaaagagtccaggagccaggcctggaaccagagtgtggaggagatatacaggctcaccctggtccaccctctgagggcaaggatgttcctctctccacatgccatccttctgtcttgccact

SEQ ID NO: 171086 - DNA, 440 bp, Homo sapiens
catgagagaatttttaaaagtcaaccaacaatatcccagtcctcaccagcaggtggtttaaagcatctttcagaatttgaaatcagttttaatgatggtcactaacatgaatcatgttaacataattttaagcatgttgtacttaatgttctgattgagattttttaaagtttctgttttaattgctgttttggtgagaagaaatgattcaggaggtctgtgctttgttacctgtacccacatggtgctcaaggttgggtgagggaaagatgagcagttaaacacacaaaagtaggaattccagatcatcagagtcatttaattttgttttggacaagaaacgtttacatgctgaatcactctgccttgttgtttttttttttatcccattgtctcctggtatccattgtttccaatgagaaatcagctgttaatctcag

SEQ ID NO: 171087 - DNA, 328 bp, Homo sapiens
taactccagtctctgaatttccggggagactgatttgagtaataaaactctggtttcccatttagctggttctgtgtgaattaaactctttctctattgcaattctcctgtcttgataagtctgttctatctgggcagcaggcaaggagaaacctgttgggcagttacgctaatgggcagttacaccgatgtgaacccaggtatcaaggatggcagaggagtatctaaatgcaacagttggccctgaacctagactaatactacgctagtgctagagttctcaggaagcttccacttaaatcagataatcacaatgcaatgtgtcaac

SEQ ID NO: 171088 - DNA, 118 bp, Homo sapiens
tgttatacggtcgtaaagaggaatgaagtgctgatacacgctacaacatggatgagtcttaaaatcatcatgctaagtgaaagaagacagtcacaaaaggtcacatgttgcatgattc

SEQ ID NO: 171089 - DNA, 560 bp, Homo sapiens
cgagtagttgggacaacacacatgctacaggccaccatgcccagctaatttttgtattttttgcagagacggggtttcatcatttggttagacttacggttcttgagggacaagaattgccaagtataatttaatagaattggaaaggcagtggttgttttgaaagagtttgtctgtagagtacctgatggaagtgaggtacatccgtggtccccagcctttttagcactggggactggttttgtgaaagacagttttccacggactccagggtgggaggatatgcgagatggtttcgggatgaaactgtctcaccctagatcatcaggcgtcagattctcgtaaggagcatgcaacctagatccttgcatgcgcagttcacaaagggttcgccctcctgtgagaatctaatgtcaagctgatctgacaggaggcagagctcaggcagtaatgcttgcaggcctgcccaccactgctcaccaccagctgtgtggccccgttcctaacagaccatggaccgctaggggtccatggcctggggtttggggacccctgccata

SEQ ID NO: 171090 - DNA, 248 bp, Homo sapiens
aagacatgtcactgagctgatgagtgatgtgacaaaacttataacacttaggatcaatctcttaagctcctctaccactgcatgtacgttcctcaccctccaaatcaccaagtttctctaaaacacagttctgacactcttttccaagttgtcactgaccccttcatatacttcccaagccagtgaacctgacataagtgactcattaacatctgcattgtagccaacaagctcaattcaatctataa

SEQ ID NO: 171091 - DNA, 505 bp, Homo sapiens
agaaaaaaaaattgagagacaatatgccaatagacaatggtcagataacgaatgacaataaactgactgcagcctctgcagtaaccgggcagtcggctgcttgggaaggacgtggtcaggactgcttgctcctctattttttgtaccaccctccccatgtcagaaccaacccaagaaagcgctccccaaaccagtcacagaaaacatcctgcttcttgttagctcacctccagtttccaacagcctgcggtcagaaccacctggagccttccccgttttccaccccctgcgtccttgcgcctacccacaccggggatgttgctgactcccttgctgtagcaagctctgaatactgtttctcatttgggtggttttccttcatttctacgtttgagctactgtggctgagaacagaaagcatctgcaaaaaatgttttatgcttaatgaaaggagtagaataaaaatttcatatatgacatcagttaaactctgaaaaaaaataca

SEQ ID NO: 171092 - DNA, 755 bp, Homo sapiens
gtgttatttttattttaagtgtttattctgtattttattaagattttataattttatataataaaattcctataactaaaatgtaatttttataaatttatataaataaacattatccagttcaacatacagaatatttttcttaccacgggaagttgccttgtgccctaaaaagtcaatccactcttccacagaggaagctgccgttctaattattgtcatagataagctttgtctggtctttgaatgcttccatgtgatattaaataggatgtaatctttgtatgtgggttcactcaacatagtgttttcacattctggttatagctgtcttgttttttatttctgtgccatattctattgcatgacttgccaaaaacacagatggttatttaggttgtttcaaatatggggctattacaataaagcttctgtgaatgtggctatgtatatattcattcatattgggttatctaagactggaaatgttgaatcatgagacagacaatatttaattttttaaaaaccaacaaagagatttccagtgtggttgcactattttatactctcatcacaaatgtaaatttccaatttgacacaatttttacccaaatttggtgttgtcacaattttttcatgtaattttagccattcaagtggatgtagagtaatatttcattgtgctttcaattttagttccttgataacttttgaagtcatatgattattgaccattctgatatcttctctgtaaa

SEQ ID NO: 171093 - DNA, 314 bp, Homo sapiens
cagtaaaagcatggaaaaattcggagaaattagggctcaacctccccgcaggtatcacacagtttttctcttctcaggtctgatcactgctaggggttcttcatgagcatgtgattatgaggcagagagttgcttcttctcccaggctcctagaaacatgtgccccttctgcttggcaatctgcttggagtaagacataaacaaacaaacaaacagcaacaacaaaccccatgggatgatagataatcagtttttaaacatttttcagttataatttttaatatttattgtgttggggtatctgttcccactca

SEQ ID NO: 171094 - DNA, 248 bp, Homo sapiens
caattcaaagatagcctgatgcagtttatgctcccattcaactgtgaccttctttgggggtagttttatggttaggaactagcagtattcccagaggtgggatacgcatgctccagaattcgagcaagctgactgggcgccgtgcttcttgcttgattccaaggacaggcaatggcagcaggttcctgctccctttctgcctgcagcctttccagcctatttcctcaaagccctgacctcttgtaact

SEQ ID NO: 171095 - DNA, 302 bp, Homo sapiens
ctgtgctcctgggttcaagcgattctcctgcctcagcctcccaagtagctgggattacaggtgtgtaccaccacacctagctaatttttatatttttagtagaaaaggggttttgccatgttggccctgctggcctcgaactcctgacctcaagtgatctgcctgccccagcctcccaaagtgctgggattacaggcttgagccaccgtgcccagccaaaaatttttgttaaaacatcaccttgtcttcagaagaaacttttctgcgaaatcaggttaccattagtgtagggttatatttgt

SEQ ID NO: 171096 - DNA, 121 bp, Homo sapiens
gcggaggcgctggaggccccgggcctgtgactacaaagagggagtcgggggccgggccggaccggagcgcggcggcggcggcggcggcggccgaggccgaggccaggccccctcccctcag

SEQ ID NO: 171097 - DNA, 515 bp, Homo sapiens
tgctgtcacgatccgggtggccccagttagcgtcccatctttactgcttgttaaaattggaaattatgaaactttcttttttttgagacagagtcttgctctgttgcccaggctggagtgccatggcacaatcatgggtcactgcagtctcgaactcctaggctcaagggatcctcctgccgtagcttccagagtagctggggccacaggaatgcaccaccaccatgcccagctaagttttttcttttttgtagagatgtagtctcgctatgttgcccaggctggtctcaaactcctgaaccaaagtgatcctcctgcctcagcctctcaaattgctgggatgataggtgtgagccatcacgcttggccaaaaaattgtgacacttttgaatactccctccccagcccccagctctgccaggcctctttggttatgtgacccacatgttcccatttttgctcaagccagcttgaggagggtttctgtcacttgtaatcaaatcaaagcccccact

SEQ ID NO: 171098 - DNA, 325 bp, Homo sapiens
gtttagagcttggggtacggagtctcctgagcatggaagaggtaagacccatgaaagcctggacatgttatggcctcttctccaaccggacacagcaaggaatgtcagcagggccatgcctcagtttcccccttctactccatcctctgcatcctcctcatctcccctcctggcggccccttcatccaccttctccctgccatgtacctgtgttcttcttggagcacaaagttaccctgttcatggcctggctgagaaggcagtcccaggtttgaggtcccattatcctgcctgtgtgagataaggccactcattcattcctcat

SEQ ID NO: 171099 - DNA, 424 bp, Homo sapiens
agctgaactgaactgaggatgagctggggatgagccagggatgagctgaggatgagccgaggatgagccaaggatgaactgagctgagggtggcacgaggggacttctcaggctctgcctgctgcaggtttatataaagaatgtcacacagagtgtcattctcagaggagaaaaacaagacaaaacagaaaaagtcatttttgtgggagaatctatgacaggatgctcaatgttcactgcatagtgagaaaagcgggaccggaagccatgcaggcagggcaaccccagtgctgggagggaaccctgcgtggggactatggccatctcaagtcgctccttcactgcctgagtttctaatggtgcactgaaaccccagctgcacagccgcagatctgatgacgggcagtgcagcttccgcatccac

SEQ ID NO: 171100 - DNA, 417 bp, Homo sapiens
tggggatgagttgaggatgagctggggatgagttgaggatgcgctggggatgagctggggatgaggatttaaggaggggtgaagaccggggcccattagtgtactcttctctgtcaccatggccgcaattattacttatgtctctcctctgtgcaaaatgtgttcagtcccatcccaggatcccccaaagtctcatccaatcatggcatcgggcttgaagtcccagatcttacgccacattaagtctatatgggccttttcttgatccagaaacctaggatctagaaagatgagtcttcttcccttcccacactcagcatgcaatggtaaaaagtaagatgaggtaaccaaaattaatgctctcatttcaaaaacgaggaagcaaggcaggcacagtgcagtcactaatctataaca

SEQ ID NO: 171101 - DNA, 1047 bp, Homo sapiens
tcctgagagcacttctctatggaagctgattaaactttttggggtgagattgggagaggcaaatcaggtgaaggagaagtagaactgagtgtgagtttttattcagaaagctgaaccatctgataatggcagagtttagtgtattcagaaaggattgaaaaactaaagtggacctataggaaaagtaaataagtgatctttgtatttcattgcaatgtcattacaggcatacaccattttattgcgtttcacaggtattgctgttttctggtatagatggaaggtttgtgacaaccatgcattgagcaagtctgtttatccaacggcacgtgcttacttcaagtctctggtgtcacattttggcatttctcacaatatgtcagacgctttcattatcttgatatctgttaaagtgatctgtgatcagggatctttgatgttaatgttgtagttgttttggggtgtcacaaactgtgccacataagatggcaaactaaattgataaaagttgtgtgtgttttgactgttctatggcccagccactccctcccttatctctccctctcctcccgcctccctattccctgagacacaacaatattgaaattaggccaattaagaaccctacagttacctcagcaacatctagaaatgattaaatttagtgagggagacattgaaagccaagatagcctgaaagctacctgaaaggccccggtgtgtgatgttccccaccctgtgtccaagtgttcacattgttcaattcccacctacgagtgagaacatgtggtgtttggttttctgtccttgcaatagtttgctcagaatgatagtttccagcttcatccatgtccctacaaaggacgtgaactcatccttttttatggctgcatagtattccatggtgtatatgtgccacattttcttaatccagtctatcattgatggacatttgggttggttccaagtctttgctattgtgaatagtgctgcaataaacatacatgtgcatgtgtctttatagtagcatgatttataatcctcttg

SEQ ID NO: 171102 - DNA, 246 bp, Homo sapiens
tagtaaatccaagatccagctaagtaaaagctgaaaccagttgggattaaagaagaaggaatgaatttgtaactgggtagtacgaaatttcttaaaatcagtattttttaagtgcgtgaatattggaatcattagaatgcttaaaaacagtaatagtttttatagcaactctgttgctataaaattcattgaatttctcatatcagttgccctgaaaaatcctaaatatcactgttgttcacctag

SEQ ID NO: 171103 - DNA, 545 bp, Homo sapiens
gtggttttaatgaagtatttaaacatataaagaagtaattaaacagggtacttgttactattttaaatattttttaaagccttaagtctttgttgcacttacaattctatcttgtattagtcttttatctagcaactttatttctagtaaccttaattcatactttgtagcatgtctgttgggatttttttatacggacagttactgttcataaataataccagttttctatcttgccctttagtcctgttacctgttatttcttactcatattttactatgctggctatatgtcagagtctttcaagagtctgggatgttaccatctgtgcaagctaacaagctagcctggatactgtttcatggatgctggcaaaagacatgagacaaagactttattactcatggtacagcaagcagcataagcgtgatgttggcactggttctgtacagccccctaagacctttggggattgacagggaggggcccaggtggatgctgcccttgcactgagtttggcaaatcaaccacatatataaagagc

SEQ ID NO: 171104 - DNA, 608 bp, Homo sapiens
catgtattagttaaatgcacagcaggcttaaaattcctgttttctaataagcagtaatggatagataatgataggtaatgtgtttcacattttaaaaattgattgctgattatattcctggcactctttttaaatacttcatatcgactaattatttaatctttaaaataatcctcttggataggctccattattatcccattttacacatgataaaaatgaggccaagaggtttaccttcctatccaaagacctaactaggatgaatataaaaagctggggttcaaactcaagcagtctggcttcagacctataagcacacactatacaatactaccttcccaaggttaaactgagtcttaaagcagttacttttgagtttaaattcagattctcttctgaatccaacctataagactaagacctcatgatacaattcccagcacaagacatgaaaatatttgtcctataagtcaaccactatacacttcatgaactgcttaataagcacctgatatctctaattatcacaaatgaaatgtcctaaggcctaaaaaaacaagaaatgcatactaagaatttcccagaccaaatttaataagaacaaa

SEQ ID NO: 171105 - DNA, 396 bp, Homo sapiens
tttgggaggtcgaggcgggtggatcgtttgagctcaggagttcaaggctagcctgggaaatgtggcaaaactccatctctacaaaaaaaaaaattaatacaaaaaattagccaggtgtggtggtgcacacctgtagtcccaggtgctcggtggggaggctgaggtgggaagatcacctgagccagggaggtcaaggctgcagtgaaccctgattgtgtcactgatcgaacttcagcttgggtgaaagagccagactctgtctcaaaaaacaaaaaagaatgtatgtccaaaacaccacttacaaaaacacacacaaataaaggaatacatatcagtcagaatagttatccttatctatgagagggagggggaacaagagtgagtatatgaatggaa

SEQ ID NO: 171106 - DNA, 367 bp, Homo sapiens
accccctatcgcccaacacagatatatcgacaaatggaacagaacagaggcctttttaataactccacacatctacaaccggttcacctttgacaaacaggacaaaaacaggcaatggggaacggattccctatttaataaatggtgttgaagataacatcactatgttatccccaacaccacgagaatgttatgatggcataattaaatgaatgtaataatagctcataaaatagcagctcatttattaagtacttgctttgttgttctaagtgctttacatgttttgactttccatataatatatgccgctctcgtacttttggcctcactgctgtgatctgaactgagaaggagtggactgtca

SEQ ID NO: 171107 - DNA, 305 bp, Homo sapiens
cttccctcctcccagtaaaaaaaatccctgagttgtttcggaaagtcccatgctgaggctgggcagtgtggctaggtatcaaagtgctggagcctttccttgtatccatcaagctgaattcacaaagggagggagagaagaagggaggagaggctgggggctgcttctgattagcctgtcctctgccaaagtgagatgtcctctctctgtgggcaattaaatggttctcatgaatccaccatctgggctcagcaatgtgtgctgtggctgctttctctctccacccaaccccaccccacctctgg

SEQ ID NO: 171108 - DNA, 428 bp, Homo sapiens
ggctgagggcactcctattaaccacatccagatccaggaaaaaaaaacatgggcacaaaatgagggcttccaaataaatgttcaaaagaaagtagacaaaggcaagaggctgagaatctgtgcttgtgggcgaagccaggaaataaggataaaccacagaaagaaaaaccatcatgacaatgtgcctttcacaaccgtctttctcactactgctgcccctgggggcacatgatctcagacacacccaggtgcactggaccaactctaaagacaagacagagataacagggggagcagaatctccagacacttctgcttcatgacctggcataaccttcctggacttgggcattctctccggggacaagttcccaggcctatcagagcagctggttgcttgtttgttcacctgtcagcaaatcgagcta

SEQ ID NO: 171109 - DNA, 537 bp, Homo sapiens
gtctctcccatcgcagtgccccttgccttctcctgccctagtaactgcctgcggggatccaggagcccccaggccgcgccgaactgcagtggataggggggaggggggcggtaaggatgagggctacggggaggcagaaatgggttgggggaaggggtggtggaagggaaaagaaaaaaccggaggcatgcaagcggctccccagccagctgttccagctgctgcttcctccggcgcgggccaggcggtgcaatattcccccccgctccatctttctcaccactacctgtccccccaacccaccacacgcactcatccctcccacccacacccctagtagcggatctccggcctgtaagggggtagtagggaggagctggggggagggggaggcctgcgagtttctaaccttgttcttataaacaaacccacatgtgcagctgccgctgctgcaactcaccccacaatcccggatataagtcctgcccctttaagaggaaaaaaaagattcccccgcctgcctcccaccccacccat

SEQ ID NO: 171110 - DNA, 420 bp, Homo sapiens
ggggacctagagtgagaactggtggtcacgtcctacgcctaggagggcccctgggtgttcacccacccccccggggggccccatcctgggccagggtccgcttcctcgagggaaggggcgaattcctggaaggtctccttccgggcgcagttgcaatggattgccttgggggtgctgaaccctgctgggggtacagagacgtttccgaaactcagcggctcggtcgcccccaaaggccaggcggaacacacgcccacaccgcggctcccttcccgaagtaagaccgccgggccacggccgcccccaggaagccccgcgccccgcaccccacacccggggacacaaacaggcgccgggtagccgcgagggccggcgcggcgcctttaagaggcggcgggcggcgctgccccctggcggccg

SEQ ID NO: 171111 - DNA, 500 bp, Homo sapiens
gcagttatcatttcagagcagctgatactgtgttaagagatccatgtgactgccagttggagactcatgtgacacatacttaagatgccatagttagagaaacagtggtttcgaaaaagagctccacatcaagccaactggcagattatctgtgtttgatcaaaattgagctgcttctacaaggggaactatttagcatgtgacaggatgtttatatatgacgattaatgtgagtgtactgaaaaacatggcagtgattagcaagagggtaattagttgtttataaatttgtatttatctctcatgagccccaggggacacccctttcctggactgagatttagagcagctcctgctggcataccatggcttcggtggatgctgagttattttctcaacatactcttctcttcccttttattaatatgtctctacatactatttaccagctttttgcccatgtcatacttcctactctgggtacaaattattttggcatc

SEQ ID NO: 171112 - DNA, 193 bp, Homo sapiens
aggctgagcaatacactttttgatattaatttttaatacagcttcttgggaagtcagagcttctatttaatgaagaattgacgattcgtcagttcagctcccgcttcggagctggccttggcgttcgcagtctcatgtcagatttttgacaaggtatttgctgcttgtaaatgtgttatctttgtaattttgg

SEQ ID NO: 171113 - DNA, 477 bp, Homo sapiens
attttctacgctttttttttcttttgacaaaaagaggaactaaataatttagtatatacattagaatatttccccttccctcatactgttttccatttattcattcaactgacgaatatttattgtgcaccttctacatacaggcactgtcaggtgcagagagaaaaatacacagatacacagattactgtaacaattacaacaaactgtagggcctcattgtaactgtgttccccatcccaatccacaaaaccacctggcacttagtcccagaaggactaagagtcagattcagaagacagtctccttctgttgttgttgttgtttgtttgtttgttttttgagacggagtctcactgtcagcagtctggagtgcagtggtgcaatctcagctcactgcaacctctgcctcctgggttcaagcgattctcctgcctcagcctcctgagtagctgggactacaggcgtgcaccacca

SEQ ID NO: 171114 - DNA, 377 bp, Homo sapiens
gtctggcagactctaggccatgcacaattcaccctgcactgatagaccctgggccactctgatcctcctggctcttaggtctaggtttgtgtattaaaaacaaacaaacgcaaccaaacaaaacccaaccaactcacaggtaattctgatctgcatccagaacaacatctctgtagatcatcagtttcttttttttaaagaaatgtacatatccatatatctgtaaggaccaattaattgccaacactctgccattagagatacaaagacaatccccatgcatcaatataggacacagtttcatctttgtggcacttttagaccaatgtgggacagattaatcttagggtcttacaaaaggctgtaagagctgaggg

SEQ ID NO: 171115 - DNA, 171 bp, Homo sapiens
ataagcagtatgtcagtcatatttcccatccacaaaatatggtctgtttttatacccatgtatctatctatttatatactcacaagatgaatgtatgtgtttttcttcacattttcctgaagatatcaaagcccataaaacttaaaaaataaaaactacaaatgaaaatta

SEQ ID NO: 171116 - DNA, 439 bp, Homo sapiens
aaggcgggcggatcacctgaagtcaggagttcgagaccagcctcaacatggagaaaccccgtctctactaaaaatacataattagccaagcatggtggtacatgcctgtaatcccagctactcgggaggctgaggcaggagaattgcttgaacctgggaggcagaggttgcggtgagccgagatcgcgccattgcactccagcctgggcaacaagagcgaaactccatctcaaaaaaaaaaaaaaagaaaaaagaaaaagaaaatgacattcataatctcaccgccaagaaatagctactgttaatattttggcatccctcctatatatcccttttttctgtatatgttttacccgaacataggattatataatattttaatactttgagtattaaatatttaattattgaaggtattagctgggcgcagtggctcacg

SEQ ID NO: 171117 - DNA, 628 bp, Homo sapiens
gaaaagcccacagaaataaaatcagatagtattattatttaattgcttattaaggttatttataattaatgctatatttggacctaaaaacatgaaaaataaccaccctaaaataaaaatatatttcttacatttataggataatcactgattagaacttaatgcttccactcacttacacatcctaatgtataggcagagacttgaaatttgaaaaacatttccatgttgattattctatagatgtgaactttttagtgcaaatgttaattttgctatagatgtgaatttttatactggctaaaagtcaaaacatgctagatagaaacttaaaaaaaaatcaatgttttagtacagaaaaaggagagtatcaatggggtctcagctttctagtgcatacagtactatgaatgactacagcctctatcatttcaagttttattcttgaaacttacattcatgcttaatacttccaatagtctcaatggtctcagtaactattaccaagatcattgattcaagaaatacttattaagaacttactattatgtgtttatatttttaaacattttacagctataccttttgctattttatagacaaatataaaaaattatgttaatttagg

SEQ ID NO: 171118 - DNA, 1393 bp, Homo sapiens
tgtgaaaccagcagatattagtcttactcatcagtttctgcttactggaatgactgtagcatctcaatgtatccagtctactatcctaagggatcttctatttaggatagcccatagctacaggatgaacagtgagaaaatgttggccactgagatcctcctctgccctaaacttgcccatcacccttcccttaaaaaattataatttcaggccagccatggtggctcatacctgtactcctacccctttgggaggtcaaggcaagaggatcgcttgagcccaggagttcaagaccagcttgggcaacgtagcaagaccctgtctctacaaaaacataaaaaaaaattagccaggtgtggtggcacaggcctgtagtcctagccactcaggaggctgaggtgggaggattgcttgtgcctgggaggtcaaggctgcactgagtcatgattgcaccactatgcttcagcctgggtgacagagtgagaccctatctcaaaaaaaaacaaaccccaaaaaaccagttacgatttcccccattttacaaaataagaaacagaagctcagagcaattaaataatttgtctcaggttatacagatagtaaatggaagacctgagattcaaacccagatttgtctgactccaaaagtcaaggccataatgctttacactattcctgttgttagaaagagaagttgtttcaattttcttttttgctggctccaattctcagccttgagtttcaaattttaaaactgtataaacgttgttgtggtgaatacccttacagagaaacctctgtatctatgactattttacaacttttttttttttacaacttttacaactattttacaatcgtcaaactgtatttttaccagcatatgtatgggtgtataagagagtgaaataaagatagagaacacctctgaaaatttgaaaccctgggtgacctttcatttattgaggaaagtaaaatctggaaaaggcaggaacatattaatactttcaagatactttgtacagatctgaagtaatttattagtttaagaacacaaaaatgtatcatgtaaaactgagtttgcttataatatgataaataaaatttaattacatttaagtaaatgtgatttaactccaaaatttaattataaccaattttataaatttatttaaaatgcatttagttttgatacttgtaaaactaaaagtttaaaaaatatgaaatctcatagttttgtggctttataagaagcagtttaaaaagtaaaactaggccgggtgcggtggctcatgcctgtaatccctgcacttagggaggccaaggcgggtggatcacgaggtcaggagatcgagaccatcctggctaacatggtgaaaccccgcctctact

SEQ ID NO: 171119 - DNA, 433 bp, Homo sapiens
atggggttttgccatgctagccaagctgatctcaaactcctgacctcaggtggtccgcctgccttggcctcccaaagtgctgggattacaggcgtgagccactgcactggcctaaaggtttttttcgttttgtttccaactgggccattattatttccaacctataagatggaagtaattgtttctgccactcgtgcctcctgtaaggattaagtaagataaagtctgtggagaggcctctgttgacaccagctctagctcagcactgcttctttattcccccagggtaattacctaaacacaagcctttcattttatactaaggaggctggtgaacctcttcttaatctctgggagatgatatcgttggatgtccattggaggcagctgaaagtattagatcagaatcagaactgccaggtcccttcccacg

SEQ ID NO: 171120 - DNA, 213 bp, Homo sapiens
cctctgagtgtgagtgtgcaggggcacattcccaccctggtgtgtaagggccagcatggtcctcatttagggtggggctagactactgtattgatggacaagagggtattgctgtaaggggcgtgccgcccaaggtacaagtacacggggtgcatgtttatgaggcttgagaggtatcattccagagatgcaggggactaggaagccattttc

SEQ ID NO: 171121 - DNA, 487 bp, Homo sapiens
cctctttaattgaagaaaagcaaagagtgacactaatcaaagtaaaagaagggaagtactcatagctgaaaatggaactataaattgtttgctttttagagcaacatcagttctttgaaacccatacagttccttataatattccaaaacaaactgccatatggaaacctgtttagaaaggaataatagcactctaccctcctccccagccactaaattgaaacatacgtgaaaatttaatgtagttttttaatcaagctcagaaaattttttttttttttgagacggagcctcgctctgtcgcccaggctggagtgcagtggcgcgatctcagctcactgcaagctccgcctcccggtttcatgccattctcttgcctcagcctcccgagtagctgggactacagcttggctagtttttttgtatttttggtaaagacagggttccaccgtgttagccaggatggtctcaatctctcctgacctcg

SEQ ID NO: 171122 - DNA, 659 bp, Homo sapiens
tgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagctgggacagcttttagcagctacatgcaaagaacttccaggccctaaagaaagcagacggactgccaaagaccttggggaagtggttgtccaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactcttggtgaaacttcacaaggtgcgggaggacattgtgaatgatattacagctgaacacatttctatttggccatctccattcccaactccagtctgtgactttgaagctg

SEQ ID NO: 171123 - DNA, 640 bp, Homo sapiens
tacataaagttttgttgaacttaataagtgcacatttaaacatatacatacatttaaaaatttatttttttaatggcaaagcctgttgatgcttaaattgtaactgatgtttgcctaaaagtgaggacagttcactgggagctgagggagaggagcctactcagtgaactcctacccaacctccaggacccatctcaaattgtccctattctgtaaagccttctcccaccgttctggttgtaacctaatgttcatattgcggggcatctcttcacaacaatcaatcttctctaaaccaggagctaatcctagaggaatgcaggaacttgttgcacgaagcattggttagtatgtgcttattaaacactcaatggttgcctaagacagacaggtacacacactcacaccctcacagtccagcagaagacactaatgcccacccccaaacaggatgtcagttcttctcaggcaacaggatccaggcacttggcttattatcaaaagagatcactttcaacatcccagcccaagcctcctcctttaacacaaatcacagccagaagagatcagagcggcccagagcaaactcagtttccagtgtccaccccaggaggctccccagtccttttgaggtcacctc

SEQ ID NO: 171124 - DNA, 621 bp, Homo sapiens
tagctgggactccaggtgcacaccaccatgcctggccaatttttgtatttttcgtagagatagagtttcgccatgttgcccaggctggtcccaaattcctgggctcaagagatcctcccgcctcataatccccgtgttgggattacggtcgtgagccactgtgtctggcctcatctggcttttttatctttatagtgatcttcacagtgaggcagaaagaacaggggtgtcgtcctatattttaccaaaagatgctgccattctgtaaatatactatagccatacagactccaaaatgaatgttgactgtcagcaataatgagggcagagatttagcagcaggtaccaaaggagatatgagcttgttgcactagcgagcagggctgtgctctcaagctgaggaaacactggtcactggaccacaagcctggtgagcccttatccctggaaatggttttctctcagacacatcctttagggcacttccgtatgcagcagatttagtgatcatggaaaaggtcaaggaaaaggaagaggagggaatggaggagaggcagattagagcagcctcttgttgacctgtgtgttcttccctggtagactgtcagccctgtgagggca

SEQ ID NO: 171125 - DNA, 661 bp, Homo sapiens
atgtttccctctaacatgagtatgtgctgcttactggaagcacatgagtgaatttctttgtttcttcacccaaagagccatagtaacaactttttctctatccactagggagggtaacagctgtgccacatggctctgtgtccctttccctgggtgctcagttttgtggtcagtacttgaccgcaaataaatgaacctcttacccaaggttgagatggagaatgaggagggataaagagctggcaaaatattgtgtagaaacaggaattgatgagatcagaatagattttgatctttcacagagagtaaaacatttcatcctctgtttctaaggtggtgtccttagggttgtgatgcagaattcagaagagtgtttgatggaccatgtttgtgttgggcttgatttcatatttagtgagataaatggctacataaaaacattgacttaaaactgacgtgagcagatggtagagaatattctattatttcaaattttaaaatagtgaaacagattaataaggtctaggttttcttccctgagaattttaacaaacaagtatcagtgacaaacagaatgttagttgtagtgaaagaggtatacgactgtcctatctaagaaacagaggatgtctcagctgttttggcctatatcaatgaaaac

SEQ ID NO: 171126 - DNA, 749 bp, Homo sapiens
gacagaacccaaaggaaaagagccagggtgcggattggcagaagctattctggcccatgtgcagagcatcaagaatgtgtgctgcaaaagagtctctctctgtcacccaggctggagtgcagtggcgccatctcggctcactgcaagctccgcctcccgggttcatgccattctcctgcctcagcctcccgagtagctgggactacaggcgtccgccaccacgcccagggagaagagaaaaaagtgcatgaagtaaagaaaaagcagggaatgagagaaaaaaatggaggagtgagtgccacagcccagtcagtaagtgctacatggagtctcactctgtcgccaggctggagtgcagtcagctcactgcaacctccacctcccgggttcaagagattctcctgcctcagactcctgagtagctgggactacagatatttagaaattattacaggaactttttctggacagacaagaacctaagtctgaacatctaaaaggctcacaaagaatcaagcaaatttattgaaagagaccaatacttattagacctatcttcgtgaactgaagatcgagaaaaaaattccaagaggcatttggacagaaaagcatgttgactccacaggaacaaaaatcaaactgcattcaaaattctcctctgcaatgtctaatagcaggagaaataaaatagtaccaacagagcttcaagggaaaaagactgcattctaagaatcctatatttaggaagt

SEQ ID NO: 171127 - DNA, 695 bp, Homo sapiens
tcgtgccgtccatatgtggatcctcataaatcaggacatgaaatctgggaagaattttcgatgagcttcactccagcagtgaaagaagtggtggaatttgcaaagcgtattcctgggttcagagatctctctcagcatgaccaggtcaaccttttaaaggctgggacttttgaggttttaatggtacggttcgcatcattatttgatgcaaaggaacgtactgtcacctttttaagtggaaagaaatatagtgtggatgatttacactcaatgggagcaggggatctgctaaactctatgtttgaatttagtgagaagctaaatgccctccaacttagtgatgaagagatgagtttgtttacagctgttgtcctggtatctgcagggaatctctgcatatagctacaaagtcacccagggaaggacaagctcatggagggctctttcctgcccattcgcctcatttaagtgcagccatccttcaggcccttggttaagcttccaaggaccctatgggtcaaggtgaagccatcagtgtctacagcttcagctattgcccgtgtgcagatggtgcttaatctctcttgtgccttccagacctgcattccagccacctaccaaacccctttctgtggatgccaagatctaatggagatacactatagaaggaagacctggccctgactctgaaattt

SEQ ID NO: 171128 - DNA, 671 bp, Homo sapiens
tctcctgcttccctcatctgttctcttccaaagaagctggtccttagcctgtattgcggagcaagctttcggcgaccagctggaccctgggcacccttcttcgaacaatggcttttaattctcagactagaacgtttaggattacaaaagaaactggttcttttcacattcttattcttgtgatgtagcattccgcatatatatatatatatatatatatatatatatatgtatccaactatcctaaaagacactacccttcatcattccatgccattagacatgtataggaccatgcatggtgatctcctccagacaaaagtaaatgctggtgcagaacaggatttgagtttgatgtcttgcatacaatgtgatcccactgtatgactacacaaatgttggcaaaagtgagttcagaggaaatggtaggcaagtacttcccagttttggccagaagatggagaaaaaagaattctcaaaaaatgttaaaggtgtctacagagaaatagacaagtgatgcacgacagatacatgtgtcagtctggtccctgcagttgtatttgtaataatacacattggagcaatttcatggccatcggttagagaatgtttgaggaatgatccattcatatcaagaaggacatttcaaagatcaaaacctgatggaaatg

SEQ ID NO: 171129 - DNA, 372 bp, Homo sapiens
tgagacggagtcttgctctgttgtccaagctggagtgcagtggcaccatctcggcttactgcaagctctgcctccattcttctgccccagcctcctgagtagctgagactacaggcgcctaccaccacatccggctaatgttttgtatttttagtagagatggggtttcaccatgttagccaggatggtctcgatctcctgacttcaagatctgcccgccttggcctcccaaagtgctgggattacaggtgtgacccaccgcacccagccagtatagttttctttaatctggaaggcttcctcagcctttcttgaattttccagagactgacatttaggcagagtacaggacagctattctgtagactgtct

SEQ ID NO: 171130 - DNA, 911 bp, Homo sapiens
tggtttgggcaggattttgagctaactggtctcaacctacaataaacataggggccaaaacacagaggccatctttggctcatttatgtaaccattcatcccttgaagaacatctgggttgtttccagtgggcaattataaacagagcctctatcaacattcctgtaccagttttagaatgaacataaatttatatttctctaagtactcaggagtagaattgacgttctgtcatatggatagccactgagcaagcctgtaaggctattttggtctgcccattctgtttcttcaccaatgagaaaactgggacctggggacagtttgcagaagccatccaatgggcacctgtttctcacagcacagaaattcctgcagccctccctccgtgttttgtttctcccttaatgtgagaggagaggacagaaccagatgcaggcagttccaacagtattgaatggctctaaggtgtggatccaagaccggtgacacaggtccgggaaattccatccgggacactgaccaataagagactgtgcatgatggctaaggtcagaagctctgagcgacgaatggtcaacacttcattttggcacgacaaccaggattatttcgcaacctcgtgccggccaggttctgcatttgaacaggtgcctgatgtgcggaatgcagtgctggagcactctgtgggttatactgggaaaaccttcctccgggtgttcaccatcaaggggacctcttccgtggtctggtttaggccggactggctggaatgaaggtggtcaccgagggagcgacgagaaattttccccggcatttgacagtttttccgaaggccactggtgtggttaacagtttgtggcacaacatggagctctcatttccaaaggcgaaaatattgtgagacactg

SEQ ID NO: 171131 - DNA, 542 bp, Homo sapiens
acacactcacacatgcacttgcacacaaacacacacatggagagagagagacagagacagaatgaaatactattcagccataaaatgaagaaaatcctgtcatttgttacaacatgtatgaacctgaaggatatatgttaaatgaaataagccagggacaggaagacaaatagcatgtgatgtcagtcatgtggaatctaaaaaagttgatctcatagaagtggagagtgaacttgtggtttccagggtctggggagatcaggtgtcagggttaaagagatgttagtcaaaagatagaaagaataagcttgagagatttattgtacaacatggtgactgtagttaataacattatgtactcttgaaaaatgctaaaaagagtggatataaagtgttctcagcacaaagataataatgatgtgaggtaatgcacatattaattagctagacttagtcattccactatgcatagatacttcaaagcaccatgttgtacatgataaatacagtacatacaattttacatgtcaattaaaaaaata

SEQ ID NO: 171132 - DNA, 420 bp, Homo sapiens
tgatttattgcttccaggacaacatggaggaatccactcccttttgcttaccagctccccacgaaacagacctcatggtgttctctacctccctattcccacccgtaatgctgccctggtcatcctggggtatgtccttgtatgttacctgtgcatgcttctctatggtacctacttggaagtgggatcgctggatcccgggagaaatgcacagtgaatgtcacaaaattctgccccattatctaaggtgggtcttgaagctctagcagcatgtcaccaggcagagaagggcggagaagggaccaaccagttcaaaggactgagagtccacagcatgtccagggttcagtgaattataggtgacccacccgaggggtggaacctttcagggaacagccgtgtaataaacacttgactgca

SEQ ID NO: 171133 - DNA, 372 bp, Homo sapiens
gtttctctggagaactgtgactaataaagggtctaataagagggcatggcacctagcaagagcagacattgataaatacaggaagaaagacacatagttcagagaatgccagaacaaagatgaagaaagaaaacaggaaaaaaagtcatagactgtactctatacaaagttttcagggaaagatgcagtattaatcatgtttctatataccaaattagcaaaagtggctttgtttatatgtgtggcaagataatagctcttattagcagactaaaaaaaaaaacaatttgaatttttatttaaaatcctgttatctgttaaaatgtatttaaataatgtcccagaaagcttctatttagcactaaaagcatg

SEQ ID NO: 171134 - DNA, 210 bp, Homo sapiens
ataacagtctaaagatttaccttcttacttctgtggatcgcttctgttggctgcctgcaccagtgagttaccttttttcttggtttattgggatattactatcagtgtgggtcaagttcacagatcaaaagtgctgtcattgggaaagctattaaaaatgcatagaaaagcttatatgatatgagactgggttaattagaagtgtttatg

SEQ ID NO: 171135 - DNA, 608 bp, Homo sapiens
tgagtgggtgaatacctggacggtgctcttctttcataagggtgacatacttcaactacagagcttgcatagggaattctttcttccagcaagattaatggttttgtgctgaggtcgccacagattctacctgatttatatttgccagtctgaaggccatgattagggaaatttttttgtgtaacagattgacgtcaatgaatctttcatatgttatacgaagaaattaagacatatagagaaaatttcatgttcacagggcagctgtatatgagtgattctggtcagaaccctcaaggctattctgtgtactctgtgtacaccggaagggctctgaagttttctggttgggctgaggagtagatgtctgtcccagtgccacgggattttcttttctggaggaagatagtacatcataaatgttgtctttttcttgtactgctggtgtgagtgcttctttattgatttgacatttgtattattgactctgaaaacattgagtggcccgagacctcacttcactgatttctgtgtcgaaaaacatccagagatcttcagatttgagctctcttggggtgctcctctgtgctgtcactgtacatgaaaaa

SEQ ID NO: 171136 - DNA, 445 bp, Homo sapiens
aaacaataagtacctgtaataataacattgaaaagattataaatgtttcctgatgtcacaaaaaaattcacataatgttttgattttaaagaacaaatgagtaccatgttttacatctatggactagttgcagattacttgtgtaatttctatacgttacaactataccaatataggtgtccttaatggctatgctaacagagagtaattacattatttttgaataatatttgtccctcaccaggggatgaggccaacttttcagtataacagataagtagattctaaagaccaggtgaaacttcaggtaaataccacaattcgttgaaaaaggtagaagtgagaattacataaaataattgcaaagcatgtaagggagaaattcattgttaaaaaatatattaatcagctcattcaaacctattttaaacaacctactatatta

SEQ ID NO: 171137 - DNA, 184 bp, Homo sapiens
agtgcctgcttttggcaagagagaccatcaagagactgaatgaccagtcactgcatgttttctacctagaatgataggaaactggtcccttgatgtactgtcttcaggagggacattgggctggctgatctgagctggaaattgatcttttatctttctgaactggcgcaagtgaagagatgac

SEQ ID NO: 171138 - DNA, 1201 bp, Homo sapiens
  misc_feature (100)..(100): n is a, c, g, or t
atggacaacgcctcgttctcggagccctggcccgccaacgcatcgggcccggacccggcgctgagctgctccaacgcgtcgactctggcgccgctgccgngccgctggcggtggctgtaccagttgtctacgcggtgatctgcgccgtgggtctggcgggcaactccgccgtgctgtacgtgttgctgcgggcgccccgcatgaagaccgtcaccaacctgttcatcctcaacctggccatcgccgacgagctcttcacgctggtgctgcccatcaacatcgccgacttcctgctgcggcagtggccttcgggagctcatgtgcaagctcatcgtggctatcgaccagtacaacaccttctccagcctctacttcctcaccgtcatgagcgccgaccgctacctggtggtgttggccactgcggagtcgcgccgggtggccggccgcacctacagcgccgcgcgcggtgagcctggccgtgtgggggatcgtcacactcgtcgtgctgcccttcgcagtcttcgcccggctagacgacgagcagggccggcgccagtgcgtgctagtctttccgcagcccgaggccttctggtggcgcgcgagccgcctctacacgctcgtgctgggcttcgccatccccgtgtccaccatctgtgtcctctataccaccctgctgtgccggctgcatgccatgcggctggacagccacgccaaggccctggagcgcgccaagaagcgggtgaccttcctggtggtggcaatcctggcggtgtgcctcctctgctggacgccctaccacctgagcaccgtggtggcgctcaccaccgacctcccgcagacgccgctggtcatcgctatctcctacttcatcaccagcctgagctacgccaacagctgcctcaaccccttcctctacgccttcctggacgccagcttccgcaggaacctccgccagctgataacttgccgcgcggcagcctgactcccccagcgtccggctccgcaactgcccgccactcctggccagcgagggaggagcggcccagagtgcgggaccagacaggccgcctatgctctggggaaaccgactcgcgccccatacccgacctagcagatcggaagcgctgcagctgtgcccgcagttgaccttgccaagccctccaggtgatgcgcggccatgccgggtgaggagaactgaggc

SEQ ID NO: 171139 - DNA, 133 bp, Homo sapiens
aactagaaggttagaaaatattatatgaaagagatgtgaggtaatccaacttaacaaaatgtaagtttttgtttgttctggaggagagaggagatcctcaccaattgaaacatcgtaaaaaggcaaagggcaa

SEQ ID NO: 171140 - DNA, 284 bp, Homo sapiens
gtgatcctccctccttggtctcccaaagtgctgggatgacaggcgtgagccactgcacctggccaaaccatttgtttttcatgggatattctaggaacacacgtggtgtgcagggcagggcctgcagtacaggtaggagctgtgctgtcttaaaatcaccaccttctcccagacccacatttttggaagggggcataaggggcaggtgatcagaagcaccacaggcagtatctgagctcagtgcatggcctcttgggctctagatatgggaaccttctgcaaca

SEQ ID NO: 171141 - DNA, 594 bp, Homo sapiens
ggaaatggcaatgataggcatttataatctccatatttagatatttccctcacagtgctagtttctgagcttattagaacctaatgttaaatgacgagttaatgggtgcagcacaccaacatggcacatgtatacatatgtaacaaacctgcacgttgtgcacatgtaccctaaaacttaaagtataataataaaaaaaaagaaatatcctggctatgagtcaagggtttaggaccttttgaggcacttgggtttagacaattctcagtgatgtgtacaggaatttgggtacaggaatactattcacaggtgaacagagtttgattttggctgaaggcatattatttgatccagataataatataaaaataatccaaatgttaggaccttagcttctgcgaaccctgacttgagaatagttagccatacatgtagttggactttatgtaggactaaccaatctcctctgcactatttttgcacagtacattgattatggtatccctgatgacctctgtccccatccttgtgagtagccttcattgctaccacccaaggatgttttaaaaaggctatgaggaaggatgcatgtag

SEQ ID NO: 171142 - DNA, 324 bp, Homo sapiens
tggcaatctggctgttagaccagaacaacaaaattgttccaactgattcatgacattcatcagctacctactcagaacagacatccataagtacacaaagatggatccataatagtgatgcaaagcatgcatcacttgttatcagataaaatactattgcatgttcttgctatcaggtgacagttgtgaatttaatcaaggctctacttgaattactcagtgagccacctccacccaattcatcccacaggaaagaaagtgaaaagaacaccaaaaaatgaaagtagcaacccaaaacactgcatacactgacagatgcactag

SEQ ID NO: 171143 - DNA, 562 bp, Homo sapiens
cgtagtcatcggcgctgcaggacggggtcctgggcgtgtgcatcacctcctcgtagctggggcaggatagcaccgacgtaggggtgggcacgccagtgggccggctctggtcaggcctgggggacgcaggcaggacctctttcatgtgagggcctgccagccagtctttggagtctgcacctgatgctgggtgtagcttattttccgcggcaggtggaataggagtcgactctttgagctttttgtctttaaatggagggtccagccccggcggtttcttagcaggaatgtccagacccttcttccgcccgtcgtctgccggcttcgccttctccttgagcttggggtctccggaccggtgcctcagcttctccatttgcttcatcctctccttgtgccgcttgtggcgctcctcgatctccaggtccttctgggacagcatcctctcgaagctggtcatcatcaggtcgccgtcccccaggagcttctccctgggcctggcgtctttcttgcctgggtctttggatggcgctaccttatcattcccgttgctcatcttcac

SEQ ID NO: 171144 - DNA, 164 bp, Homo sapiens
cccttcacctgatctccatgttgccagctcactccttcatgtccttccagtctttgctcaagtccgtctgctctctaagacgtgcccccaccatcctacttagtgatacaaactccacctcccaccgtgctgctccctggtgtcatgtgtcttactccactttt

SEQ ID NO: 171145 - DNA, 472 bp, Homo sapiens
accaaaaacaggatcagtcaacaaaagtagagatacagaggtcagcagccagcaaggccatgcccaacacccagtgcacacacacaggcccaggtacacacactcaagagcacattcaccacaccctgctgttataatcaggaacatggctatattctaggtccaaagagatgctggggacatgtcctagcaaaagataaattacaggaatgtaacaacgcccctaaaagctgtctttcctttgttaatcactagttccttgcctctcatacccattcatgatgccaaccaacgtggcaaacagcaacagccaataccactgtgcctgctgactaaagtccagtctgtatctggtttctccatttacttctagcctgttagcaaaaggaaaaataattttatcacatgcttgaacttgccaatgaataaatgcacagagactgattttgaatgacagctttgccatgcagta

SEQ ID NO: 171146 - DNA, 207 bp, Homo sapiens
cggtaccctctggttgcaagtgtctttacaatcagtcataagaatgatttatcatcatctcctaggtagtacatagttccaaaaactggtttcagaaaattttttgattggataaaatattcatcttttgccaagaattatcccaaggtgactttcttaagtctcataatcttaatatatgagtgtaatgcagaaatgaagggtaga

SEQ ID NO: 171147 - DNA, 258 bp, Homo sapiens
ctgtgggggtgggaggcatcccgggtgcctttctgcccctatacattttgttaacaaggcagctgcacttgtctgcttgagatgcgagttgatttcccgacgtcttctggcccgagatgtctcattcccacaaaggaggctgacccaggcggctgtgggtgctgccattttgttctcattgttttcacttgtgatactaactattgtttttctcccccatgccaagagcatgtgggagaaaaacaatagttagtatca

SEQ ID NO: 171148 - DNA, 375 bp, Homo sapiens
tacatgcttgtccacttcataaactgcttactgaagacaccttatgtgtgtttttccctactcagtcccttaactgtgattcaagcctttttccactgtcttgtccacagtcagggctggtggcatacctaattttaaaatgcctcgagtgtgggaaaacgttgccttaccacaactaccattccttttgcccacggattggggaatttcctaagcccaactcctctgcctatggttttgtctttgaactccctctcacatctagatttgcacattcttacaaacccttcgaggttggaaacaagcatttgctctcagcctaccctttggaaaacgagaccaaaaacaaacatctccagtgtgcatggatgctgt

SEQ ID NO: 171149 - DNA, 344 bp, Homo sapiens
aagtaaaagattgcagtgaaaaaataagcagtagtaacagactatcttagcagaataaaagtatttttgttcattttccaccttgtattttatgtggtattttgtattcgaaagctgttcttggaatattgtgtataaacttgaagtttacatgaaatcattactcttttgaactgagagttaaagctacttactctataacagcctggatatattcactcagcagcgtttgggttgtagatctaattaattagccattaaatttttttcccctgaaggaaactaacttctgaaactaatctcagtctctctttcccctgcctcattgaaatgattgtttaatg

SEQ ID NO: 171150 - DNA, 490 bp, Homo sapiens
caggatatacttattaatctcaggactccagttttggaaaattctcagctattatccttttctttattgttcctttgtcattacttccattttctttttctggaattcttataagataaacattggtattttctaatcagcttactgattagtatctcaattgctatttcattttcaaaaaattaattcttcttgctacaatttttttctgagtgaattccttaacattaccttccaatacactcaattctttccttgaaattcctttatttcatttattgtacttttatattaatgaacatttttaattttttaagatttctgattaagttttactcttattcacctattcttattttatttctatctttaatcatttcttgttcttttttaggtatgagtactttatcactaagcatctcaagcatattcatgctgaggtcattgtcagataatttcataaaatcaaatttatctggagtgaatgtta

SEQ ID NO: 171151 - DNA, 159 bp, Homo sapiens
tgatccaacaccctccacaccagccttgctgctcgtgctctggagtttctaaacaaggagctctgagtacccagatgaggaaagtgaggctcagagaaggaaacagactggccagtgggtcaagaacggtgaagctagacaaagtccaaagtgttgggg

SEQ ID NO: 171152 - DNA, 727 bp, Homo sapiens
tgtcctgcctcagcctcctgagtagctgggactacaggtgtacaccaccatgcccagctaaacttgtatttttagtagagacagtgtttcaccatgttggccaggatggtctccatctcttaaccttgtgatctgcccaccttggcctcccaaagtgctgggattataggcgtgagccacaatgcctgggcgagttgacagttttttatcattccctttgcccccgtactagcttggaaatgttctctcttttacttttcttttagtaatcataagacaatagcacgcattcgtgacttatcaaaatctaatatttagtgagtttttaactcttactgttttagtggttattctaaattttacaatatgcattttcaacttaccaaaattcaatattcattaataattatgtccttcttcttaacacaatgacttagagattgacactttaacttcgcttaccccatccagacttatatgccattgttatcattttctaaacttctctctatatttgaaactccaaaagacattattaatatttttctagagtcaacatccatatctacacattactattatgtgttttctacatttctgatcatccatctagatcattttcttcagcgtgaagaacatcctttagtgtttccttcagcatggctctgcggtgtcatatctctcaggaggggtgtccttgtgtgtgcagccgtgtgtgcatatgtgt

SEQ ID NO: 171153 - DNA, 194 bp, Homo sapiens
cagcggggagtgcggaatagttgtatagtcttctaaagctctaactgaccatcacaatataattgcagtattacaaattgtacaatattgtatttacataaatacaaaatatgttagaaattcagcagtggaggattatataccaatttccgtgacactaatgttaataagttctgataacctctcagaccagc

SEQ ID NO: 171154 - DNA, 652 bp, Homo sapiens
ggggtgcacgtgccccccgttaaggcacattgcttcgccctgggtagaactaagtgggcgactcttgggctagccccattttttcccctcagaccaaacaaatgagtgcttttttcccagaaaaaaaatttcacacagttataagattttgcagatcctgagtaagacagtccctgccgggcgcggtggctcacgcctgtaatcccagcactttgggaggccgaggtgagtggatcacgaggtcaggagttcgagaccagcctagccaacatggtgaaacccccgtctctactaaaactacaaaaattagccaggcgtggtggtgggcacctgtaatcccagctacttgggaggctgaggcaggagaattgcttgaacccagggggcagaggttgcaatgagctgagatcaagccacttcactccagcttgggcaaaagagcaaaattccatcttaaaaaaaaaaaaaaatgggggggcccttccaccttcccatttaaaatgtgccagacactgttaggtactaagggcatgtcctcaaatgtcctaacatggaggacttttgtttcttcataggtaggctagagctaatgatagcaccctgaaagggtactcaatttgtggagcctgagaaataaagataggtaagatcc

SEQ ID NO: 171155 - DNA, 471 bp, Homo sapiens
ttgggagagtggcaagtggtaaggctggggagtaggtgaggttttacagggtcttgcaggtcctggtaagagatggagattttctctaagtacaatggaaagtcaatgaagggttttacccaggagcgacatgttccaatcattacttaagatcactccagttgccatgtggagaacagaatggaggctggggaagagtgaacactcaaaggctattgcttaatccagcccagaggtgatggactacaaagctaacattggagatggtgaaaagtaactgcattcaaaatatattctagggtggaaacaacaggaccactgatggactggatttagggagtgaagagagagggctagatttttggtctatgcaattggatagatgatgagaagaaggttagaaacatacctttgagaaccatcagcacatagatgggtgaaatgacagagtgtggagagaaagggtcccag

SEQ ID NO: 171156 - DNA, 577 bp, Homo sapiens
ccaagaacacggcacgaggtgtggcgacagagctccatccgccgccgctggaagcggaaatggtaccgtgcacccgcccttcccggggaagtctgcaaacacagctgttccagagcccgggaaccgctggaagtgaggccacaagagctacaccactcgggggcgggggcaggaaggggccagcagcgggcgggggttcccaggtctacagctcctgtgagggccccaagaacctcctcctgcggcggccgcccccggcccttaagccgaacctggagagcgcccccgcacacactaaaatctcccggggagcagcgggaaacggactcccccacaccctccaggaaggacacacccgccctcccggccgttcacgggaaaggggaggttgccaatttggacggcgttcgcaggccagaactgcgccgagtcgccttccacggcgcaccaggtttaattagttaagcaaagagatcagctacaacgatctcttggcttggggccgggagagttactctgggaacttcaagttgcaagtttacaccggccttcctaggagcctggtcccataaaccct

SEQ ID NO: 171157 - DNA, 760 bp, Homo sapiens
caggcagagggcacacccccaacatttccctttcctccccttctgcaatcgcacccatcttccttccacccattttgggatgttgcaagggcctcgctgcaggatctgccagctgggcccgggcctcgagctcctttgggggcggaatggggcggggggatgagggcctatcacttacaccctcaggcactacctccagaagaccaccccttccaagccttggcacggcccccgaaggcttgcgggggccgtgcacccgcccttcccggggaagtctgcaaacacagctgttccagagcccgggaaccgctggaagtgaggccacaagagctacaccactcgggggcgggggcaggaaggggccagcagcgggcgggggttcccaggtctacagctcctgtgagggccccaagaacctcctcctgcggcggccgcccccggcccttaagccgaacctggagagcgcccccgcacacactaaaatctcccggggagcagcgggaaacggactcccccacaccctccaggaaggacacacccgccctcccggccgttcacgggaaaggggaggttgccaatttggacggcgttcgcaggccagaactgcgccgagtcgccttccacggcgcaccaggtttaattagttaagcaaagagatcagctacaacgatctcttggcttggggccgggagagttactctgggaacttcaagttgcaagtttacaccggccttcctaggagcctggtcccataaaccct

SEQ ID NO: 171158 - DNA, 245 bp, Homo sapiens
gctgggtgtttccagccacacctgcatatgaagaaaacaagcacccccagtagctggggtgtggagaagagagaggttagtgagatgctgctgggaatgtaaatcgtaggggagattatggtttttagggagagaagcgatttttctctcacttctccattggccaggacagcttttgtttttaacctctaatactcattttctttctgactccaaaaacaatgtgtattaattttagaaattta

SEQ ID NO: 171159 - DNA, 525 bp, Homo sapiens
cagtgacaaggatggggtggttctgagtgtttttccgttggacgatgggttgggagaggatggccagcgaagcaaatgcatgttttttatgagtcctctggcgcctttttgccttggctaccgaagcgtcttgaaagcagagatttttgaaagccccattgatttttgtgtcatccatctcagatcctgcctggctcagaattttggaggaggcctcatcactgctcagtcattctgacatttcctgggtgcagaaacactgcctctgcctccttctagaacgtgctcagattccccacagtcatttctgatgaaacccatctccaggagagggtaggtggccgagggggccatgctcatctttccctggcaaacttttccggctcaaaaggttatttgggatggaagctgagctcagcaccttctcctcaaaacctgagaaggaaggacagcagtgtgctcctgagactcatctatgctagaaaaaccagaagctgcttttgtctggggacttaacggaaagaa

SEQ ID NO: 171160 - DNA, 124 bp, Homo sapiens
gaatgttgttgaaagtggtgccagaaccggtttaggggtacgtttcagaatcttaaccttgagtcaattgcatgaaattaaatagctgtggtatcacttcactaacagtgatgtaattttaatt

SEQ ID NO: 171161 - DNA, 175 bp, Homo sapiens
gcctgccatccaactgcaacctggcatccatcatagcctaataagccttctacttgtccttaacttactcctttagattctcagaggcaacattaaacctttactgcactcaagcttccaaatgatctcctgtccctatcctcatgtatcttagattcctcaataattggaaaat

SEQ ID NO: 171162 - DNA, 247 bp, Homo sapiens
ttatgcctctcattgcccttgccccagtccctcagtgggtaccgcaagaagtagctgtctttgctatgtgaatttttcccccaacaagtatactcatgattcacagttgtctgaaacccaccctgatttgtagaattcacctgaaatattttttatctggaatatatctgccaccccatttttctagtttttttttccttcatattcccaaatctctaaagattctagagaacatttgctgagtagg

SEQ ID NO: 171163 - DNA, 514 bp, Homo sapiens
gctgagggtgcatttttctcagggatctggcagggggaccacagatgttgaaatcagctcaggggcaaagtctggttctatcgctgaccagctgtgcccatggtcaagtcacttcccctctctctaaacatccacttcctcatctgtgaaatgggctagcagtgtctgctttggagggttgacatgcataggaaaagcaggcccagggcagcaatttgagtaacacgaaaaagacacagcctttgaaatcagacagatgcgaattctgatccaggctcctgggagctgtgtgactttgtccaagtgacttcacgtctctaggcctcggattcttcagggataaaatggtactaacactccctccctcacagggaggtccagaggattacaggagacaacatggttaaatcccagcacgtggtacctggctcataggagggacccaataaacaaaagctattgccactgttatcactatttaaaaatgtttttaatgaaagaaagttctggaaaa

SEQ ID NO: 171164 - DNA, 222 bp, Homo sapiens
tgttagttgataatgtcatgtggtactgatagaattgaatgataagtatgtgtaagaacttctatacccagttctatgctaactgctatgtgtaaggacttctgtgtccagttctatgctaactgctataagaactacaaaataaatcaaagacttggcattttccatggaatgtagagtatagaacgtgaggggggtaaatccctaataaatttaactagg

SEQ ID NO: 171165 - DNA, 1879 bp, Homo sapiens
ctgcctaagcggtcgcggaagagcgcgcaggcctgccggggcgggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtgattggtttactggcttcgcacacagctgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagcattc

SEQ ID NO: 171166 - DNA, 951 bp, Homo sapiens
ctgcctaagcggtcgcggaagagcgcgcaggcctgccggggcgggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtcttcaccccggttgaaaattaaaaacaacaaagaaattattggttaaacctttttccatggcaattgggtattgaaaacaagggcaaaccaaccttcttgggcttaaagtgggtgggaactctctggcacccggggttggtttcccttttaaaaaccaggcttatattgggctccaggaatgtggaaaaacgctttcccccagaaaaaattgttggttgcacggaacgaagttttggggaattggaccctgtaaatttaaggtgggaaatttaccgcatttcatctctttctacaatataaacctttgggggcccattttcctctcgttttggggtggaacccatttccctttccctatgagtgaagggaatatacccccctttgggggaagcggggccctggggacacacactgttgaaagagttttaataggaccaaaacctttttgggggtcttgggggcacaagaacgggtgtgggcaacgggggtttgcaaacactttctggcgaagcagaaggttccctttggggccattgggggtgtggggacagagactagaaagggaaaagcggcagcggaagggtgttgaaatacatgtggggggcgacaactttggtcctgtggaaagaaaatggccttgtgattacagaggtttagagatctccaagggggaaatcacccgggtatctaatacgaggaaagcgtaggaaatgg

SEQ ID NO: 171167 - DNA, 359 bp, Homo sapiens
tagttttacttctcccccccttttttttttttatatttaattgggggaagcttaggtccgtctcacccgtgaaataaaacacaagaatattgtaacttttcatgaatggtatgaaacaagcaaccacctctggctagtggtggaactctgcacaggacaggattatggttgattacttccatggatgtacacatggacaaggttatcaagacacagtcctggaattagttttttgcttcagctgttgtttctgatctctgaccagatgtaatatcctaactgtaaaacatgcctacgtttgtaactgcacgtcacccaccaaaacaaaataaaaccccaaatacctcttcccttcatca

SEQ ID NO: 171168 - DNA, 1625 bp, Homo sapiens
atcagattcttcttgggagatttgttgtggacatgtttagtgatagataaacctttgctgttaagccagtgggatgttggggttggtatattgaaggtttaacttaaactattctaattgaaatttaaaagaagaatgtagctgaatgtgccatacctctcaggtagattttaaacacttttttatattcacacacatcctttgcaaaatgtaaccttaaaattagaaaacatttaaaaatgtgaaatgcacatgaagttttattcatgcgcatgtttttctcctgccctttttcatctcatcagatctttcctaggtgggttcgtgttggcagcaatacaaatgcctaaccgagctgttcttcatactttgcttttaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtgattggtttactggcttcgcacacagctgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagcattc

SEQ ID NO: 171169 - DNA, 2170 bp, Homo sapiens
aggctggtcggcttcttccgcgcgttccgctttgcttcactgctttctcccccattcttgggcctgtggacctgtcctgaggcagaggccgagatgcgcgcaaccgcgggagcagccaagtggactggactcttttcttgacttagctaccaggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtgattggtttactggcttcgcacacagctgagctccaggaaaatacacctgttgttgaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaactctgaatcctctacaacctattattataaaatgtttcaaagattagaaaagaaaagaaagctgtaataatcacctttgtttccatcacctagattaaacagtaaacatttaaaaaaa

SEQ ID NO: 171170 - DNA, 2669 bp, Homo sapiens
aggctggtcggcttcttccgcgcgttccgctttgcttcactgctttctcccccattcttgggcctgtggacctgtcctgaggcagaggccgagatgcgcgcaaccgcgggagcagccaagtggactggactcttttcttgacttagctaccaggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtgattggtttactggcttcgcacacagctgagctccaggaaaatacacctgttgttgaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaagagcgtgttgtgaatcacatggcagcaaaaattattgaaaatgtctgtaccaccttttctgctcaggcccagggctttattacaggagaaataggacccattttgtggtacctattcagacactccactgctgattctcttaggataacagcagtatcggccttgtgtagaatcactcgccattctcctactgccttccagaatgttattgaaaaggtgggactgaacccagtaataaactccctggcctctgccatctgcaaagttcagcagtacatgttgaccttattcactgccatgttgtcctgtgggattcatcttcaaagactaatccaagaaaaggtttgacttagattttacctgttactctacattaaaaattgttttcttctgcattttagtggttccacaagtaatgtcatgtttgtagaattcattttttatcccaagaggcctttttgaactttgccaaacctttgtaccacagaatgttcatctgaacatgttccaagagccttttagtgattaaaatagaaattctttaaaggaaaaaaaaaggagatgcgcgcaaccgcgggagcagccaagtggactggactcttttcttgacttagcta

SEQ ID NO: 171171 - DNA, 2034 bp, Homo sapiens
aggctggtcggcttcttccgcgcgttccgctttgcttcactgctttctcccccattcttgggcctgtggacctgtcctgaggcagaggccgagatgcgcgcaaccgcgggagcagccaagtggactggactcttttcttgacttagctaccaggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggacaggattatggttgattacttccatggatgtacacatggacaaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtgattggtttactggcttcgcacacagctgagctccaggaaaatacacctgttgttgagactacaagctccattggaatcgggattttgaactgtcttgttcaacactccactccagtgcctagacagtgccttgtgtatgtatagatactgacaaatatttcaaaataaataaaactgtatcagcattc

SEQ ID NO: 171172 - DNA, 2247 bp, Homo sapiens
aggctggtcggcttcttccgcgcgttccgctttgcttcactgctttctcccccattcttgggcctgtggacctgtcctgaggcagaggccgagatgcgcgcaaccgcgggagcagccaagtggactggactcttttcttgacttagctaccaggagctagagatgctgttattctatcgtatgtgagaagtcggcccagagatggaaaactttattctgtatgaggagatcggaagaggaagcaagactgttgtctataaagggcgacggaagggaacaatcaattttgtagccattctttgtactgataagtgcaaaaggcctgaaataaccaactgggtccgtctcacccgtgaaataaaacacaagaatattgtaacttttcatgaatggtatgaaacaagcaaccacctctggctagtggtggaactctgcacaggtggttccttaaaaacagttattgctcaagatgaaaacctcccagaagatgttgtgagagaatttggaattgacctgattagtggattacatcatcttcataaacttggcattctcttttgtgacatttctcctaggaagatactcttggaagggcctggcacactgaagtttagcaacttttgcttggcaaaagtggaaggtgaaaatttggaagagttctttgctttggtggcagcagaggaaggaggaggtgataatggggaaaatgtcctgaagaaaagcatgaaaagtagagtcaaaggatctcctgtatatacagcaccagaagttgtgaggggtgctgacttttccatctccagtgacctctggtctttgggctgtctgctttatgaaatgttttcaggaaaacctccattcttctcagaaagtatttcagaattaactgaaaagatcttatgtgaagatcctttgccacctattccgaaagattcttctcgtcctaaagcttcttcagattttattaatttgcttgatgggttacttcaaagagatcctcagaaaagattgacttggacaaggctactgcagcattcattttggaagaaagcttttgctggagcagatcaggaatcaagcgtcgaagatctcagtctcagcagaaacactatggagtgttctgggccacaagattccaaggagcttttgcagaactctcagagtagacaagcaaaagggcacaagagtggtcaaccactaggtcactctttcagactagaaaatccaactgagtttcggcctaagagtactcttgagggtcaattgaatgaatccatgtttcttctcagttctcgtcctactcccagaactagcactgcagtggaagtaagtcctggtgaggatatgactcactgttcaccacagaagacttctcctctgaccaagattacaagtggacacctgagtcagcaggacctggaatcccagatgagagagcttatctacacggactcagatcttgttgtcacccccattatcgacaatccaaagataatgaaacagccaccagttaaatttgatgcaaaaatattgcatctaccaacatattcagtggataagttattatttctgaaagatcaagattggaatgactttttgcaacaagtgtgctcgcagatcgactccactgagaagagcatgggggcctcccgagccaagctgaatctcctttgctatttgtgcgtggtggctggtcaccaggaggtggccaccaggctcctccattcccccctgttccaattgctaatccagcatttgcggatagctccaaactgggatatacgggccaaggttgctcacgtgattggtttactggcttcgcacacagctgagctccaggaaaatacacctgttgttgagactacaagctccattggaatcgggattttgaactgtcttgttcaacactccactccagtgcctagacagtgccttgtgcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaactctgaatcctctacaacctattattataaaatgtttcaaagattagaaaagaaaagaaagctgtaataatcacctttgtttccatcacctagattaaacagtaaacatttaaaaaaa

SEQ ID NO: 171173 - DNA, 952 bp, Homo sapiens
cacgaggtggatttgggctaagactccaggtagcacctgatctagtggttctcaacattgatggcatgttggtgttaactgaagaatcccgaggctcctaaatttgaagaggaaaggttgatttcttatgcagcctgcaggcaattgttctcttaactgaattaattagggaaaacttcaggaacagcaaattaaaacagtgccttttaccaacccttggggagctgatctatcttgtagccacccaggaagaaaaaaaaaagaaccctagagagtgctgggctgttcccttggctgcatacacagtgctaatgaggtgccttcgggaaggggaagagcgtgttgtgaatcacatggcagcaaaaattattgaaaatgtctgtaccaccttttctgctcaggcccagggctttattacaggagaaataggacccattttgtggtacctattcagacactccactgctgattctcttaggataacagcagtatcggccttgtgtagaatcactcgccattctcctactgccttccagaatgttattgaaaaggtgggactgaacccagtaataaactccctggcctctgccatctgcaaagttcagcagtacatgttgaccttattcactgccatgttgtcctgtgggattcatcttcaaagactaatccaagaaaaggtttgacttagattttacctgttactctacattaaaaattgttttcttctgcattttagtggttccacaagtaatgtcatgtttgtagaattcattttttatcccaagaggcctttttgaactttgccaaacctttgtaccacagaatgttcatctgaacatgttccaagagccttttagtgattaaaatagaaattctttaaaggaaaaaaaaaggagatgcgcgcaaccgcgggagcagccaagtggactggactcttttcttgacttagcta

SEQ ID NO: 171174 - DNA, 321 bp, Homo sapiens
ataagaccactgagtgttgttcttgaaaactgatgcagaattagagaatacttaactctctcaagtttgggtacaatttctaagaatctatagtttagtgactcattggcactctaatgactactattccccccccacccactgcctcccaagattcacatgtgaaagaatgcaaattcaattcctcctgacaaagaaatctaaattcatggattttcccagctgtacccttgagcgagaactttcccaaagtgaagagcatggaaaaaaacaattggttttgcatgtttccttgggaatttcaggaggaaatggagctgg

SEQ ID NO: 171175 - DNA, 297 bp, Homo sapiens
tttcagccaaatcccatgcctcagttcctcttcatcttcagttgactgtgagagttaagatgaaggatataggaatttaaggtagtgcagccgccaaggttagcacaggttttgagttcaactctcagctttaccaaccatgtgacactgtgcaagtttaacttttctaagtatctgtttcctcttctgcaaagcagagaaactccttttatttttattactttttttcagagatggggtcttgctctgttgggtggagtgcatggtgcaaacatggcacgctgaagcctcaacctc

SEQ ID NO: 171176 - DNA, 313 bp, Homo sapiens
taccatgtggcattatagcctgttgatgccaagtaaatattaattgatcattcatattgacaggtatttaatactctgcatttcgcagatgctgtgggaaataaaaaggcacaactgatatactgattatcccttctatgatgtccctcttttctgaacttttcaccgtgttgtaattaaaacttgttttctaaagacacaacttcctctgctgccttctctaagggaggctttttacccatatccctgcatactcacattcctcaagacttaaaggctgttcggcagaggttgtcttgtttctcactgctgc

SEQ ID NO: 171177 - DNA, 547 bp, Homo sapiens
gtaagcaggtagatgttctttagagccatgagagtggaaggtagtataaatagaacagaagtggtgcaaggaccaggcttgaggacatagcatctttagaggtcaggaaaatgaaaaaccagaaaaagtgactgtttccctatactgtgtgatgttctgaggtgtgttggtgccacagttagtcttcagctaatgaacacttcgggtttttgtttgcttatttttgttttatttttagagacagggtcttgcccagtcaccccggctggagtgcagtggcgtgatcatagctcactgcagccttgaactcctgggtgcaaggatcctcccaccttagcctcctgagtagctgggactgcaggtagtcatcattatgcccagctatttttatttttttaatttactttttttttagacagaatctcactctgttgcccaggctggagtgcactggcaccatattggctcacaacagcctctgcctcccaggctcaggtgattctcctgcctcagcctcccaagtaactgggattaaaggcacccacca

SEQ ID NO: 171178 - DNA, 759 bp, Homo sapiens
gttttaacttttttaaaaaatgggactttggtgagggaatgaagaggccatcactttcccaggcagatagcctttctgcctccatcctctcctggggttctgcttgaagcctggtagagtcacatccccatgggccttgacactcagaggccatgctctcccaaagctctggctttctaacagccaggggacactcctgcttgggctgagacttgtgcagctctagtaggaatgtccctctgtgcttagaaaacacccaaagcttgccacggcatccaggctgcctactgcacccctcactcagccttctcgggccaccaggtgcccattccatgccaagctttgtctcctcaacaaagttgctctgcttgagccagtgaattctgtctccaggaggctgtgtcatggctttgtcttctacaagctcatgccctggagggaaggacagagtgactctgacatgtcagcccattcagtcattcattcctcaactctaataaatttcctgctgagtgtcaggtactggactggatttggggaatctggtgatgaacacatcagatggggccgggcgcagtggctcacacctgtaatcccagcactttgggaggccgaggcaggaagatcacttgaagccagagttcaggaccagcctggccaacatgctgaaaccccgtctccactaaacataaaaaaattagccaagtgtggtggcgcatgcctgtaatcccagctactcgggaggctgaggcaggagaa

SEQ ID NO: 171179 - DNA, 356 bp, Homo sapiens
aaagtccagcctcctggattagggtatcaggccccagctactaccaggcctctctctgtctagcgtgcacgctcgctctctcgctgtctctctctcgtgtctgccgcctcacaaccgcccttccctctgtctggcctgcacttgctccatcaaccgctgcctgattgctccttaccttcagctctcaagtgaaggagagcaaattatactttacctagggagcaactggatgaaaaggcatgcttagtgggtttgatatttttactgaatagcacatgatggagattcatgaaaattcccccaatgggccaaccaactggaatgtcacgtgagagtagggtttttaggaaaagttt

SEQ ID NO: 171180 - DNA, 491 bp, Homo sapiens
ggaaagagcctaggtctttgttctgctatatcccttgtgggctactataacaaggaaaaattcctgtgtgtaaaaagtcttgtgtcaggcagagttttttacttggactattgaagattttttttctttctttctttgtttttactatataaatactgtgactcttgcaactgatcatgttttcctcttcatattttatgccagaaagccaactacaagcaaaactcttttttgatactaatctcacttctggcactatctgattttcatgcacattttttccttgccttactttttgtttttattttaaatccatatgagatagctatattatgtgcaaccatgtaagctgctctaaatcactttttggataaaggatatccttgataaaaaataaataatggatagccatatttttccctttgggttctagtttggaataatccattatttatctcagaactcagcaagtcagaatcttgctccaagcc

SEQ ID NO: 171181 - DNA, 185 bp, Homo sapiens
gacaagaccctgaaacaaaagaaaaatgacacagagtatttagtattttaaaatagtttacatgggaagagtattaagaagccccatataaacatttttttaaataataggtatggctaggtcaccttgtagaatgtgttgtccagtcaccttcaaacaattcagacagggcagaaagcctacac

SEQ ID NO: 171182 - DNA, 376 bp, Homo sapiens
gctgcaaccactcaactccaaccctgtagtatgtaagcagccacagacaatacataaacagaggcaagctgcattccaataaatattaacaaaattaggcaggggccatatttggcccacaagttctaatcaacccctgctctaaactaacatctttatacaaatccaagtgatgtttttgttcaatggaatttattttcaaaatggagacactggttttcaaaatcaaaatttaggaaaaaaggtaaatcacatagttgagttattttgtttcttagctaaaacagtattttctgaaataccagtgatgctaagtgcttatactagtacatgtgaacctagccatctgatgacagatgaactttaattttcacta

SEQ ID NO: 171183 - DNA, 447 bp, Homo sapiens
aagccctggtggtggcatgacccagtgtatgtctgacaggggcacatatttgaatgaaagccacctcacctccatacagagatgggctgagggaataccaaatatgaagatgggagcagatccagatctactcgtctcagatgaaatgtccagtaagttgtattgcctgtattttgctccagctgaacagttgcactttcaagtaataatagttcaaatttatcaaatgctagcaggagccatgcattgtgttaatggagagagaccatccttattcactcttactcagtaaacagtgggtgaaactgcccttgcctaaatatagttatgtaatgctgtgtttccttaattgtatatccataaagcttttgacattgttttctaaatgtgttcctcaaaaaggagttgggctagtgaccaaagttttgaatagaatattgtaagaaa

SEQ ID NO: 171184 - DNA, 258 bp, Homo sapiens
acggacaaaaagattaaaaaataaacatagagcgggtaggataaaaagaaagcaatgaatcagaggacagatttaagctaaaatgtaacagtcattacatcacatgtacataaactaaatattccagctgaaaaatattgtcagatttgggacaaaaataaccaccataagcagtttatgagagacatattttaaaggcacaggcacagaaaagctgaaagtaagttaagaaagcaattaaccacacaaacactaatc

SEQ ID NO: 171185 - DNA, 201 bp, Homo sapiens
caggatctcaagctttggtcagatacaaagtcatatgttaaagagtgaggcgggtggagaggccttaagaagaacagtaactgcatggagtaatcgttaaatagcatgggagaaacgggcagcaccaacctgcccagtatagcttggaagttcacgcacaggtgtgaagaaggcagtcctggagggttgctgaccaaagat

SEQ ID NO: 171186 - DNA, 495 bp, Homo sapiens
ccttttgccaccagcctagggttagggtctctgtcattttctctcatgctgtgctgtgttgtagctccctgtgagtctccatggtgtagtgaaatgagcaaggctctgctgtaagacaagtctgggctcaagtgctggcctacctcttattggggtgtcctttaccagctttcttacctttctcagcctctgatcaaagctcactgcagcctcaaccttctggggacaagcgagcctcccgcctcagcctcccaaagtgctaggactacaggcataagtgactatgcctggcccaagcctgttttcttatctgtaaaattggaacaacaacaaaaaagtattctttgtagagttgtgtgagaattagagataatgtatgtaaaaaatctggcaccagtaatgaaacacagtaaaactacaaaaggaaagcaagtttttcctctgttttccctacattaaaacataataacattaaatgattattctgactgtatg

SEQ ID NO: 171187 - DNA, 509 bp, Homo sapiens
ctgaggccttcaccagaagcagatgctggtgccgtgcttctacagcctgcagaactgtgagccaaataaagttctttcctttataaattacccagcgtcaggtaagatgtaggggtagaatggtggcccctgcaaaaggtaagccttcctcctaatcctagaatcgtggatggtaccttatttggataaaaaggtctttgcagatgtaattaagaaccttgagatgaggagatcatcctggattatctggtggactgtaaagtcaatgacatgtattcatatatgacagaagagaagacatggagaagaggagggagtagttgtgaccgtggaggcagagaatggagtaatgtgatcataaatcaaggaatgctgacagccactaaagctggagaaggccaaggacagatattcaatcctcccgtagaagtacagccctgctaatgcattgattttggacttctggcctcagaactgtaagagaataaatttctattgttttaagcctt

SEQ ID NO: 171188 - DNA, 804 bp, Homo sapiens
cgaggaggagcctgaggaggaggaagaggaggaggaggacttgatcgatggcttcgccatcgccagcttcgccaccctcgaggccttgcagaaggatgcatctcttcagcccccagagcgactggaacatcggctgaagcattctgggaagcggaaaagggggggctccagtggggccaccggggagccaggggacagctctgatcgagagcctggccggccccctggggatcgggcccgaaaatggcccaataagcggagaagaaaagaggtctccgatgatgacctcgacccatcctttactgtctcaaccagcaaaggttggtcccaaggtctggggctggaggcacgggagggcagtggggtgagcatgagcctcaactgagcatgtctgccatcctgccccacagcctcgggcccccacggcgccttcaatgggaactgtgaagcaaaactctccgtggtccctaaagtgtcgggcctggagcggagccaagaacagcccccggggcccgacccgctgctagtgcctttccccccaaggaaccaccgcctccaccggtccctcggcctcctgtctcaccccctgcacccctgccggccactcccagtctgccacccccaccccagccccagctgcagcttcgggtctcacccttcggcctccgcacttctccatatggcagcagcctggacctcagcactggcaggtgagtggtcttgggggattgatgcggtccggaagggcctggtcagtttggtggcggggacacaggatggtacctgtggggtatgacttgaaaa

SEQ ID NO: 171189 - DNA, 339 bp, Homo sapiens
tgcagagcgagactatagaatacccgcgtgtgtacacgggaagctgaccaaggaatggagggtccatgctttggcatactatcctttccaaagcccttgagctacttctggttctccacggaaacccagagtggctgtggcactgagatgggccttcttcccatcttagaatgaagatctagattcaagtctgagcagagaccgcagatagagtagtgaggacactaaatcattgtagtcagtgtagggactcagcccataaaggtgtatttgagtttatccttaggggcgatttgcttgttgtgagatagtatgtcctagaagttaatgcgctaccca

SEQ ID NO: 171190 - DNA, 802 bp, Homo sapiens
cgaggaggagcctgaggaggaggaagaggaggaggaggacttgatcgatggcttcgccatcgccagcttcgccaccctcgaggccttgcagaaggatgcatctcttcagcccccagagcgactggaacatcggctgaagcattctgggaagcggaaaagggggggctccagtggggccaccggggagccaggggacagctctgatcgagagcctggccggccccctggggatcgggcccgaaaatggcccaataagcggagaagaaaagaggcgtcctcccgtcactctctggaagctggatacatatgtgacgcggaaagtgatctggacgagagggtctccgatgatgacctcgacccatcctttactgtctcaaccagcaaagcctcgggcccccacggcgccttcaatgggaactgtgaagcaaaactctccgtggtccctaaagtgtcgggcctggagcggagccaagaacagcccccggggcccgacccgctgctagtgcctttccccccaaggaacagagagagcgtcgacgctctctctgtggggaggcccaagccaagaagttaggaaacaattgcgttttcgccccagcggacgtgacctcggagaaggatgtgcaaacagctctggctctagcaaaaggaaagtttggccgtgtggatgtagctgtcaactgtgcaggcatcggcggtggtagcaagacgtacaacttaaagaagggcagtaccataccttggaagattccagggagtcttgatgtgaattcatgggcacttcaatgtgatccgctggtgg

SEQ ID NO: 171191 - DNA, 461 bp, Homo sapiens
gagaagctacagaagacaaagatggggagagatgctacagaaacccacatgaggaagccgcttgtgctgcctgggggatgggaggagagttgtggttggggaaagccccctaggatgtcttagtcaggtcctgaagtatagtcagaagtttgctaagaaaagacacggggaaaagttgttttgggcaagagcatgaagacgtgaggacccggcgtatttagagaatggtgagagcactgggacccgggtgggcagtggcgggagaagcagctggaaggagaggctgagagtagatcctggaggcccatgagcgccctgctgggagctgcgactttcccagctgcctcagcagccgcctccctcacctctggactctggtcttcctcaggcgtcctcccgtcactctctggaagctggatacatagtaagtgctatccacctgtcctggcccctccctgctc

SEQ ID NO: 171192 - DNA, 496 bp, Homo sapiens
tgatgcggttggcgtgggtttccaagtgggtaggtagcctggcctgcaggcccaaggttgtatcctccacttcgctccccagggtcctttcccccataccctggttttccttcccccttctccttcctcctccctcaattgcccctcccagctccagctggaaccagcccttctctgtgtctcccaagagtggagggatgtcctggagaaggaatggagtgagaggggccctctcataccctcatacccacacacatcagggataaaacactgtctccgatgatgacctcgacccatcctttactgtctcaaccagcaaagcctcgggcccccacggcgccttcaatgggaactgtgaagcaaaactctccgtggtccctaaagtgtcgggcctggagcggagccaagaacagcccccggggcccgacccgctgctagtgcctttccccccaaggaaatcacccgttctgtattctccaccagctgtgcaccgaca

SEQ ID NO: 171193 - DNA, 835 bp, Homo sapiens
cgaggaggagcctgaggaggaggaagaggaggaggaggacttgatcgatggcttcgccatcgccagcttcgccaccctcgaggccttgcagaaggatgcatctcttcagcccccagagcgactggaacatcggctgaagcattctgggaagcggaaaagggggggctccagtggggccaccggggagccaggggacagctctgatcgagagcctggccggccccctggggatcgggcccgaaaatggcccaataagcggagaagaaaagaggcgtcctcccgtcactctctggaagctggatacatatgtgacgcggaaagtgatctggacgagagggtgagtggggctagagcttgggtgggcagtgtcactgcttgtaaaagggactgcagcataaaggtcttctgcgtgcagcagacagccttcccttgagtgagaaacatggcttaggttgagtcaggattaggtttttgggaggaacgggggtggattgggagggtaaatggcgtcattttttcttttggtgactaggggttagctgaccaaggaatggagggtccatgctttggcatactatcctttccaaagcccttgagctacttctggttctccacggaaacccagagtggctgtggcactgagatgggccttcttcccatcttagaatgaagatctagattcaagtctgagcagagaccgcagatagagtagtgaggacactaaatcattgtagtcagtgtagggactcagcccataaaggtgtatttgagtttatccttaggggcgatttgcttgttgtgagatagtatgtcctagaagttaatgcgctaccca

SEQ ID NO: 171194 - DNA, 439 bp, Homo sapiens
ttgcccaaatcctcatcttacaaatgggaaaatagagggacagagaggagaaaactcttttcaataccccaaggcaggataaacaggaaagaaagaaagaaagaaaaaaaaaactaatttagagaaggagagctggagacaaagttcctaagaaaagaaaaaagtctgtagtgatagcgtcacaagatgtattacctcaggagtctatttgagagattgtgtcatgtcagaaaagttctagggactggagcctctttccttggtaagaggatgagaatgaaacaccagcccctcagtctgactcctggaaaaaagaacctcaggccgatgagcaataactccaacaatgtcatttccctggccatgctgagccccacaggaaatctcagagtttgtcatcacggcaagggcccacaagaatgtcgctgcacccagagct

SEQ ID NO: 171195 - DNA, 366 bp, Homo sapiens
agccagatttcgcgcggagaacgccgccccaatcccagtggccgtgtgtggactgcaaggtggtggcttgggtgagggttccagcagtgaggctggagagaactaaaaggacctggggtagattctgaaggcagagctaacaggacttcttgaccttcatcaatgcctcccctctacagggccaggtatggtggctcacacctctaatctcaacactttgggaggccaaggcgagaggactgcttgaggccaggagttcaatccagcctgggcaacatagtgagaccctgtttcaatttggaaaaaaaacaaacaaaaaaagagacagggcatggtagctcacacccgtaatcccagcacttcggg

SEQ ID NO: 171196 - DNA, 282 bp, Homo sapiens
tgagtaagcacatgcttacaagactaggtgctgatcagtacgctgcagtattcacagcaaccagtgtggcatgtgcagtgctgaaggtttctttctttttctcctatttcctaagttggagttgttattatggttgcttggttttgctcaactgttctggagtgtgttgctatggttacaagatggcaggggttacataggtgggtttggaacggaacaaatgatgggtaaactctgaggttgacagctattaaagtggttttttcatatcatgactcttaa

SEQ ID NO: 171197 - DNA, 156 bp, Homo sapiens
tctcactctgtcgtccaggctagagtggagtggtgctctcatggttccctgcagccccaaattcttgagctcaagcgattctcctacctcagcctcctgagtagctgcttcctgcttctgccgcttcctgcttcctgcttctgcccctcaccaaga

SEQ ID NO: 171198 - DNA, 246 bp, Homo sapiens
tccacaccacgagtgatctgatggagacgaaaaccacgtgacttggaatttggaagagtggaggggacccttaaaatacatgagaatcccactaaatttcaatgtggtaaatatttgactattatagctaatatgttctgcctgtttcaaggacctctcagccaccatctgccagagggcaggtggatggcgtcgctgaacctgaggtaccaagggctggggcaaagtcacgcagaggccactttg

SEQ ID NO: 171199 - DNA, 343 bp, Homo sapiens
tcctaccatataatttaaatatatcattagttatattatggataaaacattatatagtaattattaattttttcacaatggtcaacattctatcctcaaaaaaactgaagagcatgtttaaagatggattttcaaacatcttaatgaattttttgttcagaaaatatttttttaatatatggcaatggttgaaaaaaaacatagaatattgtagttcctcaaattgttaaacacagagttatatgatccagcaattctacttctaggtatatacccaaaagaattgaaaatacatagtcaaatgttcacagcaacattattcttaatagccaaaaagtggaaa

SEQ ID NO: 171200 - DNA, 395 bp, Homo sapiens
ccatcagctcctttattcactctgctactgttttcgtcactgtttcactgttcattaacacctccaggagagggtgagctgagtcaggacacctttgtggaattcaatcatttaagttatcaggacttatgaaatacatggatttaaaagaaggagaacatagatatgaaagatattgtttagagtcggcctcaggagtttaaagataccaattatttatgctatctattcctgtcatgccatctataatagagtccctaagtgtctccattccacttcattattgttagccaactttgagtataaactcccaaaaatatcatattatttttgtggtttcattaatagaaaattcagtttcagaaggtgcaaaagtcatgaaacccatctaagca

SEQ ID NO: 171201 - DNA, 784 bp, Homo sapiens
gactgggaaggaaccgcgcttggagtccagacatctggaatacggaagaggaagagacaccaggagtactcattcaagaaaaggccatgtaaggacacagggagaaggcggccatctccaagccaggaaaagaagtctcactgaaaaccagctctgttagcaccttgatctgggacttctcgcctccagaatagatcccttatgcaccgctttagatttttatagccttttatagccctaatgctgcatcagccagccctgcctgggctccagccagatgtcaagtaggttccatgtatcaacagcctctcccgggcactactttatgactcttctctcagaccacggaacttcctagttgacagaaacaagaatgtgactggaacccagcatgtgtaacctgaaagtacagggaagtggatgtggtgttgctaaaaagtttgattggtgggatgggagccagtgtataaatgttttccctttctccctcaagtgcttggacctgtgttatctcagaaaatcctgtggccaactcagtaacacatccctgctttactctcttctctcttattcctgaccccttgaactgctccaggactccagtaaaatattcttaacacgaaaaaaaaaaaaaaaaaaaaaaaattggggggggtggccggaaagtttaaaaacaatgtgtggcgggggcacaaggagaaatggttgtgcggtccagagaacgggtaaaaagggggtttacacaaaaaagcggggagcgggttggaaaacagggtgggaaggc

SEQ ID NO: 171202 - DNA, 576 bp, Homo sapiens
gttatgagaggcctccacgtggttgcccctggagtgctgctcctccttttgatctaactgggttcaccaccacatccatgctggagccagtagggaggggaagatgcacctttccttttaaggatatgacccagaagttgcactgccacatcactaccactgctatcgcattggccagagttagccatgacggtacctagctgcaagggatgctggtaaatgtagtctttactttgggtatccatgaacctagttaaaagttgaggttctattaccatgagagggaagagagaacagatactgggaagtcaccagccattgtttcacaaagggctgaggcatagccaaacacatttccagttggcaggtgaaggttcagcctgggacagggaagcgaacagacagaactaaagaaatagatttgtgagtaccaatctgctgaaaccataagcctaagcttttctctggggaaaaggactgtgttgatctgagtcaacagataggagtagtcatgcttgagacttattggggcaatgactacaagggaaaatgggaaggcgctcaggagacagtggg

SEQ ID NO: 171203 - DNA, 378 bp, Homo sapiens
accttcagaacaatgttaactagtagtgaacgtttcctgacttcagtggaaatgcctataatatttctgaactaagatgctggctttggacacagataatttcatgatgttaaggaagcatccatccatacttactttcttaagaatttttattaggaatggttgttgatttttttttttttttttttttggaaaggggttctaattgttccccccagcaagaagtccagggtaaaaatttgggttaattgaaactttggcttcggggcccaaaggattttttttttttaagcttccaagggggttgaaaagggcttccggggaggcttttaacagtttttaaggggcttaaaccaggaaatggttttaaccccaggg

SEQ ID NO: 171204 - DNA, 484 bp, Homo sapiens
gtagtgaggggtacctgtcccaggacaaatgatgacaagcagagagccaggccattaactgacccggtaagagaccccagggtggtatgatatcatgtgatagtttgaaatctcttccattgtccctggtcttcagtaaagccacattaacattttctagttgggtgtcagctgcattgagaggaacaaaaaaagcctccttgcttagagccaagcaaggcaggggataagagcatcccttccctcgtggccaggatctgaggttatagtggctatggctggtgagagatagcctaccccaatagggtgatctcacagcaccaagggtgatggtggcagtgcaaggagactggttgaaaaaaagtcaacaggattttcctgagccaacattacgagggactttgagatggtcttggaaataagtggaccctttgagacagtctcctttctgtgattgtgagtagcaaacaggttcataagatta

SEQ ID NO: 171205 - DNA, 604 bp, Homo sapiens
atagtctagtagcaaaatacttacagagcctaccacgtgccatttactctgcttgatgcttttgtatgaatcatcttatttacagaccaattacattttaaagcagatattattgtcactctttcataaatgatgcagctgccttggcagagagagatccaataaattacctaagatcacatcacactgagagatgggcctcaggtctgagcctaggactcccctcacagtgcgtgctgttttcgttatactgcatttctcttctctgcagaataatggagatggaagtgtcttacaggtcccctctaccttcctatggttatgattatatagtgctaccataccagtgagataacttattctcatagctttgagaatgtgtggttagaatgtgttcaaaaaagagtagtacagtattataaatgaatatcctaatcacttcccctaaagtgagaataaattctctttatttttactatttagctaaaagaccagcctttcgccagtcagtagtaaatattgaaactatctataccatggtggctactgtacagaatcaaaagaaatgaaacatataacttccatcctctagaattctatagtg

SEQ ID NO: 171206 - DNA, 183 bp, Homo sapiens
aatgaagagttaagcatccaacattcaaagtggattaataatttagtagcattcacaaaatcaatgtgttttggcaagtaacttgagaatgttcatgctgcattaggttagtgtttctatgtttgtattgtagcaaataatgcttgaatgagtacagctttcttccttccttccctcctatta

SEQ ID NO: 171207 - DNA, 677 bp, Homo sapiens
tagagatgggagtctcactatggtgccaaggctggtagtgaaccacctcacccagcccaggaggctgagaagtccaaaataaggcactggcagattcagtatctggtaagggccagcttctagacatctgtctttttgctgtaacctcatgtggaagaaagagctaacaagctgtctggagtcttttttttttttttgagacagagtctcactctgtcgcccaggctggagtgcaagcttgtaccctgttttcctttttcacttatatagaagtaaatggcatctattaagagttaaagaggaagaaggaatatgagacaacagaaaaatgcaattaataagatgattgccaagaagtaggaggggcctatttggaattgttcagcgtaaatttatagtggccaagaaatcttcataattactcaccttcctccacaaatatgctgtgacctgtgagggaaaacagaagaaatcgatggtggaaaaatctgacaacaggagtccagtaaaatataaaataagtgattgatgtcaaagtgcagactgtatctagtgcatacaggagttaagctaaacgtctcagactgtttgggttgctgtaacaaaataccataaactggtaacccttgtgccgaattcttgccttcagggccaaattccttatagggagtcgtttt

SEQ ID NO: 171208 - DNA, 167 bp, Homo sapiens
gtttattaagacgaatctggccccatcgtagtgtgggttaaaaaggtaagcagttttgctttgaagaattattttaaaaattctttttgcctagtaataatttgaattttcacatgtcatagcagcaaagattgttgagatttagtaatgccagtattaaccatacc

SEQ ID NO: 171209 - DNA, 403 bp, Homo sapiens
tacttccattcatttatgtccttttgtccagaaagtcaagcatttatgacgttatttgaatacaacagggtatgcatttactctttaacacttttgatcaatgtggtaaatttactttaaaatgtacttttgggatatatttgaagtcagaattgctttaaaattggaccacataaattttcccaatgctgagaaccacctcttgcatgtcagatttctatagaatatttcagatgactgccctgcgattcgtatcaccacttacttaataatctgctcaaacttggactacagtcatagttgtaagaccttaagaaaggagatattttctcatttagtatttttttgttaaaatgcctttggattttaatgaaaatactgacaactgtactttgctggttaa

SEQ ID NO: 171210 - DNA, 362 bp, Homo sapiens
ttcttggatactaactttataattatttctttttaagagaagagttccttttattttattttatttgagacagagtctcactctgttgcccaggctggagtgcagtggcaagatcatggctcactgcagcctccacctactgggctcaattgatcctcatgcctcagcctcccctatggctgggactacaggcatgcaccaccactcccagataatatttaacattttcagtagagacagttctcattatgttgtccaggctggtctcaaaccaggcatgagccactgtgcccagctgagatttatactttaaatttacacattccactatagagaaatacaccaacaccatagagagcttg

SEQ ID NO: 171211 - DNA, 600 bp, Homo sapiens
tgcagactctcaggctgagccccgcacgctccgtgcccgtttgcagacaccctctcaggctgaaccctgcacgctccatgcccgtttgcagacattctcaggctgagccccgcacgctccgtgcccgtttgcagactctctctcaggctgagccccgcacgctctgtgcccgtttgcagacaccctctcaggctgagcctgacatgctccgtgcccgtttgcagacactctctcagactgtttaggaaatccttctcttttcttatcacagagctacccatgctttcttttcaaaggttcagctttgctttctagtccgagatcttgactccgtccggcatcgtgtgtgtgctgtgagcagcccccagctgacctgccccacaggcgcctcctgcccccccgagtgtgtccaggcctcttctaagcccctgcaaaacccctgggactggtttccattcctggaccggttccagttcaatccctgtagttttataaatcataatatccagtaggcaatttctccccttttcaaagctatcttggcaattcttggtgccttcctgtcctcctgtgttgacttcacaacacatcaagcaccct

SEQ ID NO: 171212 - DNA, 261 bp, Homo sapiens
gtccactcgggagagcatctttaattgcacctggaacagcagcgacatcatgcagctgaagcagcaacagtggtgatcaccatgggctgtagaacatgctctttcctagttttctgacttctatgagcttgattcttaggtgatgggaaggagaaggaagcccttttgatgtgtgatagtggacttctcatccatcctgaagagtaaaggctgagagccagattcaactgtatttggaaataataaagtaaggtgacaact

SEQ ID NO: 171213 - DNA, 552 bp, Homo sapiens
tcatcttggataatcactggctcccccagcatcttaactgggcaccagctaagccactgtgctgcctaaatggacaaccacttctcagttctggaattcttcaaacacctagggttaggagggtcttcgctttggcagttagagttttctcaattcttttatgacacaggttgcaccggactcactcaactatggagatcagatgtcctcaggaaaaaaaaaaaaaaaaaaaaaaatacacacttaaggctgttcccgtggctcctctctcttcctgacacattccaaaaaggaatttatggatgttgggaaggacaaagggtgaggaatttctaggacatttaagaacgcccatgtaagcaactctatgcttgacaggccatgcacaataaaactcttgggcctgtaagcgagaagaaaaatttggtgtaagctgcctcatgggttgccaaaatgatgtggaaacaaattcatctgcatttctaaacaataggaattctccttgtcctcccaaacctagaatatttcatgtatgtgcttaagtcacaagat

SEQ ID NO: 171214 - DNA, 865 bp, Homo sapiens
gggtgaatgccattagggtccggccatcgctggcttcactctcctttagcaccttgtagatgtccatgcacacttccaccctcgcgccccacacgcgacgcagccctaccctggccagcagctgtgctttgctgcgggttccatgctgtagcagggacaggacccccaccccctgtcccgtctggccaccgacttcagcagaggctcggctgccgtgagggataccagtcatgggaaaactggcctccctgcagattcacagagcaaggtggttctcacagagaagtcagtggcttttttctacgttaatgctgtagcaaacgccaccttttctttcaccaccaatttatatttcttaacacccatggagcaaagtgtggtgatgtttgaactgtagcctggggctctcgctcccatgggactcctcggggaatttcccagcagcaggatcgcctctgtgtccttgcagggggtggcgtctgctgggggcacatcccatcgtgcagggggaacggctgaggtcacaggctttgcctgacaagtgccactcacagctgctgtccacgtgccagccctgggacacagccctctgccatccttccacccactcggaggccagggaggcacctccgtgccacactgcaggcaggcagggccgcgcttgggatctgccgccttcttgtcagtgctgctttgactaattgcctgaggcacggccggagtgacttgctatttttagaagctaattcaggcttcagatgccatctaggtaatgaggagagagttcaggaaagctgtatctaagctccagcaaaggcggcctcttccgtaccagctgtcgctgcgtttacactgagacgagcac

SEQ ID NO: 171215 - DNA, 1178 bp, Homo sapiens
gagtgcagtggcgcaatctcggctcactgcaagctccgcctcctgggttcacaccgttctccttcctcagtgtcctgagtagctgggactacagatgcctgctaccatggctggctaaatttttgtatttttagtagagacggggtttctccatgttagccaggatagtctcgatctgacctcgtgatccacctgcctcaatttaagtagtcgtgtgtggcttatacctactgtattgaacagtatctaggcaatcaacttgttagccacttttctccatttgtactgttcttgtccctaaacgagctctcatgatttctggcccatctcagtcaactgcagtggctgcctagctggtcttctaaattccactcctgagctgtagcctactaaacaaaaattgaaagtgatcttttaaaaatattagcttgagccaaatcaacttgcttatggaatatattgtccttttttttgagactgggtcttgccgtgtcacccagactggagtgcagtggcatgatcagagctgactgtagcctcaacctcctgggctcaagcaagccatcctcccacttcagtttctgggactgcaggcgcataccaccatgcctggctaatttttgtgtttgttttagagacggggttttgccatattgccaaactggtcttgaacttctgggcttaaacaatcctccttcagccttccaaagtactgggattacaagtatgaatcactgtgcctggctatatttgtcatttatttatttattttttgagaccagctcactcctgggcttaagtgatcctcctgcttcagcctcccaagtgctgggattacaggtgtgaatcactgtgtctggctgtatttgtcatttatttatttatttttgagaccaggtcttgctctgtcacccaggctggagtgcagtgatgcaatcatggctcactgcagccttgacttcccgggttccagcagtcctcccaccttagcctccttagtagctgggatcacaggtgtgtgccacatgcccagctaatttttgtatttttggtagagacagggtttcctcatgttgcccaggctggtcttgaactcctgagttcaagcaatccacctgcctcggcttcccaaagtggtggtattacaggtgtgagccagtgcacctggcccatattta

SEQ ID NO: 171216 - DNA, 501 bp, Homo sapiens
caccaacagaacaacaaaagacatgaataatgtaaaggaaaataaataggccaataagcataatgaaatacaattcagccaggcacactggctaagaggtgaaggtggaagaatcacttgagcccagaagctcatggccagcctgagcaacatggcaagacttcatctttaaaactaaaataaaatcgaaaaataaaaagtaatacaattcaaaacaatcatgaaatagtgttaaaaataaaaaccatatgactgtctcaatagacatgaaaaagcattcaataaaatccagcatctcttcatgataaaagccctcaacaaactaggcatcaaaacaatatccccaaaataacaagagccatctatgataaatccacaactaacatcatgctgaaagggcaaaagctagaggcattcaccttgaaattagaaaaagacaaggatgctcactctaaccactcctattcaacatagtactggtagtcccagccagagcaatca

SEQ ID NO: 171217 - DNA, 380 bp, Homo sapiens
gggtaagggggccgcagtcctgtaagatctccccttggtgccctcggcaggggtgcactgtcctgtaggatggtggggtgtgggtgagggtggctgcagtcccgctgttctccttgagtgggatcctgggctctctcccagcccttgccacccagaaaaccagacagcagcctggagccacttgtttgctggctgtggtccggcatcttggcagttctgttacccactctgctgcctcaatcctgcagacatcacttgacgtttctggcataaactttgcctgaaaacatacatttaaagatgatggcttaacctattcttgtgttgtttttttttaaattatactttaagttttagggtacatgtgcacaatgtgcagg

SEQ ID NO: 171218 - DNA, 583 bp, Homo sapiens
aatagatatagtgccaaatattggttccaaaatcatttttcataaaataaatcagggttccttagagaaatggctggttccagggccgaggctagtgaaatactagatgagccaggaacatcttactatgttgtcaaaaaggaagaaagtgctcaaagaaagatggaagatgtcaaatggacacaggaaccagttataaagagattcccattggccattctcttcataggggtgaaagaaagttcttccttatcataggatgttaacacgtgtagaggaaatatggaattagaaaatcaccactggggaaacaccattctaataactgttactacagatgctgaaactagggagtgaaagtgtaatgggaaacaagatgtttataaagactcaaagtatctcatccacaagatacttttaattaccaaggaaaaaaataacaattttatagcaggaaaatgtggcagataccgttttagccaactgattaaagttaacatcattatcaatataggctgtaatgtgcctcctgatatgatgcactgacagaaacccaacacttctaccctattccttccaaaaa

SEQ ID NO: 171219 - DNA, 790 bp, Homo sapiens
  misc_feature (17)..(17): n is a, c, g, or t
gcggtgttctagaggancccgtctgccacttttccaagggaggtgacaatggggtccaaagtgtctgtgcctttatggctcgcaactatgtgctgagtgtggcccaatattcctgctccaaatggtcacaccatgtctacagcaaatcagctgaccggggtggcaacccctggctctgctcaacaataatgacaaccaccatttattgagcccttactatgtgccagaccgatgctaagtgctttcctcagatgtttccatttaactcttaaaatcaccctaatgagtatttcctattattttacagatgaggaaatgagagtttagaaaagtaacttgcaaaatcatactgctggctccatgacaaatgttgattgaatgttgtctgggcggacagaggcaaggatgaccggaacaagacaaacaaacgaaaggccgactgacagaccactcgggtagcactttttctgggattaagcttagaccttgtaggcctatcagccagaagcagtgtgtaaaataagagcagctgactgggcacggtggctcacgcctgtaatcccggcactttgggaggccaaggcaggcggatcacgaggtcaggagatcgagaccatcctggctaacgcggtgaaaccccatctctactacaaatacaaaaatatccagctgggcgttgtggcgggatacctgtagtcgcagctactcgcgtggcttgaagcacagaatgccttcacccggaagtgaacttgaatgactgaatcagccatgatcaactggaacaacagac

SEQ ID NO: 171220 - DNA, 387 bp, Homo sapiens
ttgtacttaggaacactggacagaaccccagaactatgcttgggtgccattttaaacagaaaaagcacaaaaattaaaacaaaaaaagacactaaatagaccacaaaaagggttcttgtttacctgttcaactatgcagctggcaagcaaaacaacatgaaacaagaagtatgggaactgaaacaagaaggcaaagtaacacctttttcaactccagctgggaaaaaggaaatcagaagactcaaatttctaccactctgtacatttgagaatgatggcaaaagtgctgagagcattgatttgggggttacaaataaattttagggagtagatggattcacagatatggaatccatgatcagtgaggattgtactgaccaagaaaaa

SEQ ID NO: 171221 - DNA, 727 bp, Homo sapiens
gcaggtgtaagccaacatgcctggctatttaattttttttttttcaagacagagactcactttgtcacccaggatggagtgtagtggcacaaacttggctcactgcaacctctgccacccggattcaagtgattctcctgcctcagcctccggaatagctgggattacaggttcctgccactacgcctggctaatttttttttttttttgtatttttagtagagatggggtttcaccatgttggccaggctggtcttgaactcctgacctcaggtgatctgcccacctcagcctcccaaagtgctgggattataggcatgagccaccacgcctggcctatttaatttttttaagtaacatcaaatgataacacaattaaacagttagtctaaaatgatttatccagccatgaaaagatatggaggaagcttgaatgcctattactaagtgaaggaagctgatctgaaaaggctacatactgtctgactccaactatatgacattctagaaaaggcaaaactttggagacagcagaaggatcattgattgtcaaggattatgtgtgtttgtgtgtgggggtgtggaaaaagcagagcacagacaacttttagggcaatgaaattactgtattataactatatactataatggttaacacgtgtcattaaacatttgtccaaacttatagaatgtgcaacaccgagagtgaactctaatgtaagccacg

SEQ ID NO: 171222 - DNA, 397 bp, Homo sapiens
atgaaacacaaaaaagaatactgtaaggaaagaaaattacaggcaatatccccgatgaacatatgtgcaaaaatcttcaacaaaatactaggaaacggaatccaacagaacattaaaaggatcattcgccatgatcaagtgggaattgtcccaggaatgcaaggatagttcaacatacacaaataaataaataaaaggataaatggatgataaaaatgtgtgtatccatatgtgtgtgtctgtgttatacacacatttttatattatatatatatatacactcacatatacacattgtgtgtgtgtgtgtctgtgtcttatatacagacacacacacacaatggaatattattcagccttaataaagaaggaaaccctgcctttgcatcaacatgga

SEQ ID NO: 171223 - DNA, 413 bp, Homo sapiens
gagatggagtctcgctctgtcgcccaggctggagtgcaatggtacgatctcagctcactgcaagctctgcctcccgggttcaaacaattctcctgcctcagcctcctgagtagctgggactacaggggcccgccaccatgtcaggttaatttttgtatttttggtagagacggggattcaccatattggccaggctggcctcgaactcctgacctcaactgatccacccaccttggcctcccaaagtgctgggatgacaggcatgagccaccatgcccggccagaaccttgtcagttctatctctaaaacataactcaaacccaggcacttgtctcccgttccactgcatgcatctctgtccagacagccaccatctccctcccaggccaccgcccaggccctgctccacgcc

SEQ ID NO: 171224 - DNA, 169 bp, Homo sapiens
cgaagacttttataaacagaagtagcttctttcctggacatcatttacatgtagttttatgaaaaaaatattgtaattaaatggttagcttactgaatatataaaagtcttcgaaaatttggcaaggaatttaaaaccattcttttaaaaatcaatcctatcaatatat

SEQ ID NO: 171225 - DNA, 385 bp, Homo sapiens
ccgagcctcagtgtcctctatcaaaggtgattccacccgcctcatccacccagaccactgccagtcttggtggtgagggagactgagtgaagacggtctgcttgtcaccagtcaaaggccaaccaggagaggcctaaagactagtttggaaggtgaaaaaaagaaagaaaaggtgacagaaagccagggatgcctgggcacaccctagactcagggagcccaaggcaggctgccttctctgcagcaaagctcaatgcccgttagcttgaggatacctccagcagcagcacccaggtcagcgtgcaagggcttgagggaatgaaggatactctaggcctctgcccgggccctacctggaaacaggcaaagcccatccacacaggag

SEQ ID NO: 171226 - DNA, 225 bp, Homo sapiens
ttttccgtcgggagaagctaaagaggtgagattcaataaatccgcaagaataatataatttctggttttctaaacatcactgaatcttcacacaaagggctggcaaagagtgtcactcacgtggagcccagtcccctctatggctgctgttcccgctaacaggtagccagggcggatgtcccaggtgacttgccacccacgtgccgtctgccagatggctccgtc

SEQ ID NO: 171227 - DNA, 148 bp, Homo sapiens
accgattagaattcagccttatgcaatcttcccaccactccaatcattcctccattcccctgtttggcccatgagacaaacacagacggtgtctccttgtgaataatatttattctgctgctgactgttctcctctaattcaacacca

SEQ ID NO: 171228 - DNA, 168 bp, Homo sapiens
aaagggcaccctttaccacttctccctgtgcacccatgagaatttcatttctctagggcaggtaaagaattgcacctgcaggctgattgagtgcgcacttttccttttaacattaataggctccgacaacctctccaccaccaccacaacgcggcacatttacatcaa

SEQ ID NO: 171229 - DNA, 214 bp, Homo sapiens
agggagggatggagattctgcaagcacgtgctccggagccttgagtttcaaatcctgagtcgtccaggtaaaagtatgtgcatctattaccaaccaggtggatgtctaaaatacatccctcgacagccagtcaccgggttctgcccacccctgctccaaagccaaagtcccagcaccctcggcccctctgacttgggtcatcccccagctccca

SEQ ID NO: 171230 - DNA, 428 bp, Homo sapiens
cagaagttgagaaatgaaaaataagacaagggcaggaagtatgatcttaaatgtaattgcaggaaagtccacctgtcattgagaagctagtacttgcgtgaagaactgtgaaagacgaggaggggagccagttgggttctgggaggagattgttcaggcagagggcacagtaaatgcagagcactgaagcggcggcgtggccgaagcggcggcatggggggtagagtgaggaggctgctgtggctggcaaaggaagtagcaggaggtgacctgaagggtcaccgtcacagcaggaccttgtcagccagtatgaagactgtggcttttactctatgggaagttgtttaagagttttgagctaggggccccataaaacctgccttagggtttaagaagctgcttctgtctgcactgtgaagaagagactt

SEQ ID NO: 171231 - DNA, 407 bp, Homo sapiens
aaccaatctaagtccactttctaatgacacaatgccatttaaggagtagtgtgactactgtataaaaacaaaatagtcataattctttcctcctgtcttatgtgttattgctgtcatttgtttcacttattcataagcttatgcatatttacatgtatatgcttatgtatatatattcacctaagtatgcataattaaatactttgctgccattattattttgaacaaactcttatctattacatcaagaataagaaaaatagaagtttttgttttacctttagttactcattctctgacattcttcctttacgtagtttctgaaactatatcattttccttctttctgatacatttctttttttattaattgcaaggcagttctgccaaccaattctctcaatttt

SEQ ID NO: 171232 - DNA, 962 bp, Homo sapiens
  misc_feature (955)..(955): n is a, c, g, or t
gcacccatctttctcagtgactacaaactagcccagcaccaagcggcacgtgaattgtttcacctgcaccccatgactggacagctgcaataccaggggcctgaggcgggcacggcatagcccaagtcgccttatgcatgatcctgtcctggtacacatgtttagaagggagattgccacctgcagaattccagttttcctctcaaaaatctacatattcaggcagggtgcgatggctcacccctgtaattccagcactttgggaggccaggctggtctcgaactcctgacctcaggtgatccgcccacctcggcctcctaataaacactttttaagagcaccttccaagtgacaggcaagtgttctaggcactgggcagacagccctggacgaagcagacaagacgcatctgccccgtggggtcactctagcaaggcatcaggaagtgctcagaagcataacccagccaggggcacttccaggagcaggttcattgacagaaagtggacagttcagcttcatgcatctcctcattgcgcctctcggctcccagagccccaccatgggcccttactggctctagtccgccctgtcccctagacggtgcgcggcggcggtggccttggcgacttcttaccgttcggcgcgagcgcgggacgccgtcaccccaagcaagacgacgggggtcgggctgcggcgtctcggtgccttccgtctcggtgcgacaatccggatctcggtgaacacaacggatcactcctctgaaggggtttcagtcaccccagcttccatggaggaccggggggggcctggcgatggaaacgggcggaggtacggaggcccgcccagggggcggcgagagatgaaaccaccggaaaacgggggcggccaagctgggcccccgtgggcggggggaaaccggggggaaaaaaaacaagggggaagacactaagncattata

SEQ ID NO: 171233 - DNA, 1281 bp, Homo sapiens
  misc_feature (807)..(807): n is a, c, g, or t
  misc_feature (857)..(857): n is a, c, g, or t
  misc_feature (903)..(903): n is a, c, g, or t
  misc_feature (974)..(974): n is a, c, g, or t
  misc_feature (1017)..(1017): n is a, c, g, or t
  misc_feature (1023)..(1023): n is a, c, g, or t
  misc_feature (1037)..(1037): n is a, c, g, or t
  misc_feature (1041)..(1041): n is a, c, g, or t
  misc_feature (1050)..(1050): n is a, c, g, or t
  misc_feature (1092)..(1093): n is a, c, g, or t
  misc_feature (1101)..(1101): n is a, c, g, or t
  misc_feature (1123)..(1123): n is a, c, g, or t
  misc_feature (1126)..(1128): n is a, c, g, or t
  misc_feature (1134)..(1134): n is a, c, g, or t
  misc_feature (1158)..(1158): n is a, c, g, or t
  misc_feature (1160)..(1161): n is a, c, g, or t
  misc_feature (1170)..(1170): n is a, c, g, or t
  misc_feature (1177)..(1177): n is a, c, g, or t
  misc_feature (1202)..(1202): n is a, c, g, or t
  misc_feature (1246)..(1246): n is a, c, g, or t
acggagtcttgctctgtcacccaggctggagcgcagtggcacagtcttggctcactgcaatctccgcctcccgggttcatgccgttctcctgcctcggcctcctcagtggctgggattgcgggtgcccgccaccacgcccggctgatttttttgtattttttagtggagacagggtttcaccgtgttggccaggatggtctcgatctcctgaccctgtgatctgcctgcctcggcctcccaaagtgctgggattacaggcgtgagtcaccacgcctggccaattatttgtatttttggtagagatggggtttcactatgttggccgggctggtcttgaactcctgacctggtgatccacctgcctcggcctcccaacgtgctgggattacaggtgtgagccactgcgcctggcgtagacaacccaatttttaacaaaagcaaagatttttaacaggcacattccagaagagggcatgctgacagttaacaggcacatgggaaaagtggtcaaacatgagtagccatcaggaaaatcaacgacgtcctactacactaaaatggaagaaacattgccagacgtggccatttgcaaatgtcgtttcctggtctgtgtcttttgattctcctgacagcatatttgagttaattttttaatgtgtaaggtatgagtggaggtcctcattaaaaattgtttaggctggctgtatggctcatgcctgtaatcacagcactttgagaggctgaagtgggaggatcatttgagcccaggagtttgagaccggctgggctaacatggcgagaccccntctctacaaaaaataagaaaattagctgggtgtggcaccacgcatctgtngtctcagttgtacaggaggctgaggccagaggatcacttgagcccnggagattgaggctgcagtgagccatgattgcagtaagatgtgatcacatccagttacatttgattttcagntaaacaacagaagtttagtggaggctgggggcagtggctcacngctgtnatcccagcactttnggangctgaggcnggtggatcacctgaggtcaggagttcgagaccagcctggccnntatgatgnaaccgtgtctctactaaaaatncannnaaattngccgggcgtggtggcgggcgcctntnntcccagctnctcaganggctgaggcaggagaatcgcttgancccgggagacggaggttgcagtgagccaagattgtgctgctgcnctccagcctgggtgataagagtgaaactccatctc

SEQ ID NO: 171234 - DNA, 754 bp, Homo sapiens
ctcatttaatcctcctaacaacatcatgaaattggttacgatattattctcattttttttgttgtttttttgagatggtggctcacgcctgtaatcccagcactttgggaggccaaggcgggcggatcacctgaggtcgggagttcgagaccagcctgaccaacatggagaaaccccatctctactaaaaatacaaaattagctaggtgtggtggcgcattcctgtaatcccagctacttgtgaggctgaggcatgagaatctggtcaaaactccatctcaaaaaaaaaaaaaaaaaagtataagcattcttttacctattatgaaaatgggaagaaaataatcaaccagggttgatatgcccaagagcatgccttgaatgtatcagctaccccaaattcccttttttgactgtttgagtgcccaaagaagataagaaatccgaagtttatttactgctctataagttaacattgaaggagataggaggaaagaacacttttctacaaactggatataggtagaatgctataagcttagctgaaacacttatgccatctatggaatgaggacccattagattatttgacctacctcctctgtgaagatcacatgagaggaagtgtgtgaagccctacatgagtataaggtagatggagaggccaggcacagtggctcatacctgttatcccagcactttggatctcgagcccaggagtttgagaccagcctgtgcaacatggcaaaatcccgtc

SEQ ID NO: 171235 - DNA, 437 bp, Homo sapiens
cttttgttgcaatcgcttttggtgtctttgtcatgaaatctgcccattcctgtgtccaggatggtactgcttaggttgtcttccagggttttcatagttttacgtttaagtctttaacgcatcttgagttgatttttgtatatgatgtaaaggaggggtactatgtagcttcagtcttctgcttatggctagccagttatcccagaaccacttactgaatagggagtcttttccccattgcttgtttttgtcagctttgtcaaagatcaggttatcataggtgtgtggcctacgattttaaaacccctgatttttaaaataggctctctgttctgttctattggtttatgtccctgtttttgtaccagcaccatgctgttttaattactgtagccctgtagtatagtttgaagtcagctttgttctctttgcttagg

SEQ ID NO: 171236 - DNA, 245 bp, Homo sapiens
tcagaaatgctctaagactcccttttacccctaccatctgccaacttctgtcaacacaaactgctaagaaagggaacctatttttcagcctagtattcttactatggcagagatagagaaaagtcatgcacatattacataagattgtcaagatctgccagggattcaccctctgcctctgagcaagactgtttctaacacgaataggaagactaccagagaagggagagagaaatctgtttcct

SEQ ID NO: 171237 - DNA, 172 bp, Homo sapiens
ctagtggccaccttcattggactgggaagacagagaagtagaaacagaccaaaatcttcatgcttgggacctttgataatttagcttcacccaatcaagaaatgaggcccaatggctgtcattaacagtcaggcaacatgtccaatccacacggagaatattaagagacgga

SEQ ID NO: 171238 - DNA, 300 bp, Homo sapiens
aggcactttgcacttcacctgctgaaaacgtggtagtcataaacacgctggtagctcaatcgtcccacctatctttactatgttattcattcctagcagtggggcctgggtcaaaagttctgcagggttttaaggctttggatcagtggttcgggattgtcctctgggacgggctgagaagcacacatgcctgccggtggtgacaagcattccttcctagtgcagagtcaggtctgcacctggcaccccctacccatccaggttgggtccctggcattcagttatgtggaacagaccaga

SEQ ID NO: 171239 - DNA, 440 bp, Homo sapiens
agcactttaggaggctgaggtgggagatttgcttgagcctaggaatttgaggccagcgtgggcaacatagcgagaccctcatctatatatatattttaatgttttttaattagctgggtgtgatgatgtgcacctatagtcatggctactctggagaattgcttgagcccaggagttcgaggttacagtgagctgtgattgtgccagcctgggtgacagaccaagaccctgtctctaaaaataaaaaaaaaattttaaagactatataaatattacaaggccaaatttacattctgtttcttgtacagttttgtgtgggaactctctagagtttttttaatttttcccccttttttgtttcccttaggttcttcttttttcccttctttcattgcctacctgtactgtagcctaaaagtcttatcactctgtgctttgaa

SEQ ID NO: 171240 - DNA, 411 bp, Homo sapiens
cgtgggccatagacaaaacattcctataatccgatttcaaaggaaagtgtccaccttatttaaaccataaaacaattaagcccagacgtctagccagctccgcgctgctgttttgttcggccccattgagaacccagaacagggagacaaacagcgccataaaagtggcatttcggggctgcggaaatgtacctatccgctgccttctcaagtggaacaatctttagggttttgtgattctgacaaaggagcagaggagaggtgggaggggaagattaggggaagagggcgtttgctagcccctctctacccccagctttcatttctttccccagatgcgtgttgtgttgttaattcgtaaatgatagcgaataaaaaatgattccaatcctgacctgcaggctgggctgg

SEQ ID NO: 171241 - DNA, 342 bp, Homo sapiens
agatggacagtgcccccctagccttttttactggaacagatccaaggctgagaagctgaaatcaggagcagcccatgggcccactgtctacaccgagggagtcatgagcagcccatggaccactgtctacacccagggagtcaggagcagcccggggactgctgtctacaccgagggtgtcaggagcagcccagggaccactgtctacactgagagcgtcaggagcagcccagggaccgccgtccacaccaagagcgccaaggagcagcccagggaccgccgtccacaccgagggcgccaaggagcagatagtagcccagagacccaggggaggctcacctt

SEQ ID NO: 171242 - DNA, 649 bp, Homo sapiens
tatatccgaggaaactaaggctcagagaagttaaataacttacacagcactgattttaccgagacctggctgaacaccccttattttttctctatctgttagggacacttacagaatcttggggatctttgtgaagccctctctgtcttatgtgtaattattaaatctattccttttgtactttttgtactgatgtaaccctgattgattactgtagtgttcacttcctaataagtttccccgcttctgctctgtttatcaataaagctattctactgctatgagatgacttttctctaaatacttcttttttcatgtcagcttattgatctaaagtcttcaattaatgattgttagccagattttcttaatttgacttttaagtttctctgtaaattaatcctagtctattattctaaacttactttgttttacttgccagcatcaagtgtgtatttcacccagaatgatcttctagtctgtgaatataccatgtaaactttgttctgtgtcatttgtcctaaatcctgatcatcttttaatgtacaattcaacttctgcctcttagacactttactttttaattccgtctaaactttaaagttacttatctgaatcattggcatcatttgtgccctcttcctttttg

SEQ ID NO: 171243 - DNA, 301 bp, Homo sapiens
ccccctaacccttgttcactagctcctcaatattgcgtaaggtaacttttctgtatcaaatgtagacttttcctattagcttgaaatatccagtgttgctctatttcctaacagagcaaagtgcaggatttaagatgtaaatgccgaatcatgaaaagctgttgattttatatgtgtactaataagaatgtaaaagttcagtccaattaaagaccataagatgtcatcaaacctttctaaatgctgtatttaaaagtctgcggctgggcgccatggctcacacctataatcccgacacttt

SEQ ID NO: 171244 - DNA, 421 bp, Homo sapiens
ctattaggtatacaaatgttaaggatttgctacataagacactgtgattgttttagatcatcttacaatctagttgaggtaggactaacctgaaaataagttgtgcatagagcagtgagtgcccaatttagtgataaagatagtaattgctgtgggatcttgatggtggtggtttgctgcgagtgtatggcactaaccccacccaatccctctccacttcttggccttgtttatgcagataaacaagaaaagtaaggtcaattgtgaaggaaggagaagacttaaggcattttacgcttgccatcttgattgacaggtctagggacatttgggtcaggatgggccataatgggatggggagacactttctgcatggaacaaagagacttgagagaaaacatggaagtgtcttggcttgatt

SEQ ID NO: 171245 - DNA, 283 bp, Homo sapiens
gatgctctgtctcccacagggcagccctgggcctgtctggttttgctggaagcagtggctttgggaggttggggatggaggtggcccctcatttcagggcccttcatacttcagccaccaggagttaggaatgagacagtaatgatgccaagagggaaactcagaggaaaagcccaactgcccagaagtccagttccctcaggacacctcctcctcctgctgctggtctctcttggaggctctggaagttgcctaggtccctgctgactcaccttgcccccta

SEQ ID NO: 171246 - DNA, 245 bp, Homo sapiens
acttgggttactggtataatctgctttagggtggattctcagcagaatggaaaggcaaatgggacttggagagaaaatggccttgaagcagtctctgttgccctgaaaatcacttttcatttccaaaacatcacaacttccttttactgaagatctctttaagatccagaagcaaataaacaccatattcttaaacagcacaggtttcccaatgtcagttataatatctggccaggcatggtggg

SEQ ID NO: 171247 - DNA, 222 bp, Homo sapiens
ccctggagacgagcaggggacaatggccaagtacccaccttttggcgggtcacagcccctctggccacaccaagagccacagtccccaggtgcgatcccaggtctgcctggagtcagggaggggtggggacagaaaggcttccagggccaggagcagacacacactgcaaggccacccaagaccacactcaagaccctaggccagcaggggaccctcctgtc

SEQ ID NO: 171248 - DNA, 592 bp, Homo sapiens
taagtctatctccatcctgcccctctccccttgaattactaaattaactatggaacagggcaaaggagtaacactctgacagggcatggcagcctgagaagtcagagctggaagcatccagttgcctgctcttcacttgtgtcaggctgttccttcctggcacgggggctggagggaggccagggagcagcgaggctgcacggcagccctggcacagagcctcggctgccgtctggggatgaaactgggctctggcaccaggagcgtggttccagctccctgacccagaactgcctgtgcaggggctgctctgccacttgtgccctggtgggaccccactcctcctgcccctctgaggcagggcagattcaggagcagagctggatctggatggaatggcaagtcagggatgctggggcgaaggcaagtcatatcccttctgcagaagcagcctttagggatgtgcctgtgatggggaagagaatggcatgtgtgttcagcaagtgacagagtgggctttaccgcagctccttcctctgctgccagaccagtggcctcagctccatcaacagcctccctccatgactcccca

SEQ ID NO: 171249 - DNA, 180 bp, Homo sapiens
tttcacaggatgttggtgacgtagcgtggctagtttccacataggcttcactcatttttctgacatctcaactgaagtgactagaacagctgggagctggctgggcgctctttgcggtctctcattcaaaacgtctctctctctccacgtggccctatctccagcaagacagtgtcttag

SEQ ID NO: 171250 - DNA, 293 bp, Homo sapiens
tcaacatggtataagtgttacatcaataccatttcagaaataaaacactagccatgcaaaggctgaagcaaattgttttccaactaaatgctggcagcctgctcttatagattaagaccaggtttctccacaaagcactgaagcagcaaatttaaaaggaggcaaatagaacatagactatatagcaacagagataaaacagttcattacctagctaatgtttgcatttttctgctttagagcatgtaaaaaattagagataacaaaatgacacttaatagacgctggacatg

SEQ ID NO: 171251 - DNA, 320 bp, Homo sapiens
cataacattgtgtcacaattgcctacagtattcagtacagtaacatgctgtacaggtttgtagcctaggagcaataggccataccatataacctaggtgtggagtaggttataccatctaggtttgtgtaaataaactctatgatgttcacacaatgatgaaaccatatagtggtgcatttatcagaatgtatcccattaagcaatgcatgactatatttatcattaaattatgtatcgtatcataaataaagcctattcaaatgggtgacgtgtttaaaaaataacatctgttgaaccattaaaattttaccataaata

SEQ ID NO: 171252 - DNA, 550 bp, Homo sapiens
cttaattttggtggctggaagcctcaggaacacgacaaattccatagcttcatggaagaacttactttgtttctgttgctattttcatgaaggcagcagggaaaggacatgacttgctgcccagtctcttcatctctctttgtaaatttgttcactaaaaacttgagactaagattaagcctttactcattgccctccaatttacagagaaaactacaaaaatacgccacaccctatgaaacactccacattaaatagatactactaaaaaatttcaatggggcaaggcactgtggcttatgcctgtaattccagcacttggggaggccaaggccggtgaatcacttgaggccagaagttcaagaccagcctggccaaaatggcaaactgccgtctctactaaaaatacaaaaattagctgggtgtgatggcgcatgcccataatcccagctatgcgggaggctgaggcacaagaatcacttgaacccgggaagttgaggttgtaatgagctgagatcgtgccactgcactccagcctgggtgacagaga

SEQ ID NO: 171253 - DNA, 452 bp, Homo sapiens
ctgtttccatttcaaaggggattcacaacatcattttatgtcccttgggctcaaaaactcagaagatcaccaggctcagtggctcacgcctgtaatcccagcacttttggaggccaagtcaggtggattgcttgagccctcaagtttgagaccaacctgggcaacatggtgaaaccccatctctaaagaaaatatacaaaaattagctgggtgtggtggcgtgtgcctgtagtcccagctactctgatggctgaggtgggaaaatctcgtgagcctgggaggtcgagggtggtgatctgtcagcctgagtgacagagcgagacttcctcccaacaaaaaatgaaaatctacaggccacagtttaactctttttctaaacattatgtctactataactgtgaatttgtttgatattagctttgttataaagttgaaataatatttacaggctc

SEQ ID NO: 171254 - DNA, 676 bp, Homo sapiens
caactgtcactgtgtggccagttttgcttcatctatatgcccagccacttcttcctctcccatcttattttaaagtagatcccagttttgtagggttttaagcctgcaagttacatgatttgatttacatttttaaaaatttctggccaggtgcagtggctcatgcctgtaatcctggcactttgggaggctgaggtaggcagatcacaaggtcaggagtttgagaccagcctgaccaacatggtgaaaccccgtctctactaaaaatacaaaaattagccaggtatggtggcgcacgcctgtaatcccagctactcgggaggctgaggcaggagaatcgtttgaacccaggaggcggaggttgtggttagctgagatagccgagatcccaccaccgcactccagcctgggcgatagagcaaggctccatctcaaaaaaaaaaaaaagaaaaagaaagaaaagaaaattgttaaggggcaaaaaagaagcagaaaggccaatcaggctacttctgtgatccagaggaaaaatgagagtggcttagactaacagtggtgggactggagatgagggaaatggatgtgtgggagaggcctggattcatcgtttctgttgtcttttctctccttactgaacttggagtttcttgaggtgatgggctttgttttactcatc

SEQ ID NO: 171255 - DNA, 239 bp, Homo sapiens
gagtgttgagaccagcttgggcaacatagggagacccacccatctcaaaacaaacaaaaaacccaaaggaatgttaaaggcagatatctccatggaggcatttcaggcctatgacgccctcccgaagctctcttctccatcctccatcctccattccactcaggctttctggtctagcctaatgggcatcccagccagatactcccgactcccctctgcctccttcctctcaccctgga

SEQ ID NO: 171256 - DNA, 194 bp, Homo sapiens
gacctatggcagcccccctgggacccctccttactgtaggtcccccccaacccttccctgcactgtagcctctgcagggacccagaccggccctcaggggtcaccatctggtggggagggggatggaaggtagagaaatgatccctgttccataggagagagccagtgctgggtgggtattgatctgttgcttt

SEQ ID NO: 171257 - DNA, 404 bp, Homo sapiens
gcaagacagaatttcaataggaatctagggaggctgtgtgattggagaaggtagggacctttaaagcgagctagtgcttgagtggacagaaagcttaatataagtccactatataacaaagctaatgtgctgttggactacattaatagaagcatggaattcagttcctaggaggtaatcatcctactctgccctattctgtagtggtcatcaccatctgaagtcctccattctgtactgatatcatcattcaagagattgggtgactagaataatgaaaggagtcaaaagcatgtcatgtgagaatagttagaagaactgagctgtttggcctatgaataagcagtctcagagaaagcattttgaggttttcaaatacctaaaggactgggattaggaaagaa

SEQ ID NO: 171258 - DNA, 414 bp, Homo sapiens
ccaccacacccagctaatgtttgtatttttagtagagacggggtttcaccatgttggccaggatggtcttgatctcttgacctcgtgatccgcccaccttggcctaccaaagtgctggcattacaggcgtgagccactgcacctggcccataatctcttccttaaatcttagaagtgccctgggtgaattatatggccctcttatagctaacactcttagttagaaaacatattatgtgccaggcagcattgtaagcatttgatatatattaactgaggcctcacaacagccctgtaaggttggcactgctttatccttgatttgcagatgagtagactgaggtacagaaaagttaagtaacttgtctaaggttgtacacctagcaagtagtagggtcaggattcaaacacaag

SEQ ID NO: 171259 - DNA, 430 bp, Homo sapiens
gtcgtcgggcactctagtccaaggataatggaatagccagttcacacgagaaggaaatacaaatttcctacaatataaaaagtgggaggatcacttgagcccaggagttcgaggctgcactgggccatgatcatgccactgtgctcgctctggcctggatgccagagtgagaccccatctcttaaataaaagaaagaaaaaagaaggaaaaaaacagaataatgcccttgagattcatctaagtcattatgtacatcgttcttgtttattcctaaatactattccatagtattgatgcaccagtttgtttaaccattcttcagccataggactttttgcttgtttctagtttttggctgtgtttgtaattatttgtaattgttacaaataatcctgtacaggtttttgtgtagatatgtttttgtttccc

SEQ ID NO: 171260 - DNA, 483 bp, Homo sapiens
cacatataaaatcctatgagagcagaaaggcccctgagctggcctggcctggactagagttccagctttgaatctggcaccatcattgagagattgtgtgaccttagacaagcctcttaagctgtctggtcctggctctcagatagggtcaataatccatgccccacaggccactgtgaggatgaaacaggaaaggtctctgaaagcatgcagctcagtgcagggagaaaccagcaaatatctgctgcaagttcaccgagaaaaatcaaagctgtgctccccactgcatggaatagtttctttatttttattgttttaattaattaattaattttagagacagggccttgctctttcttctaagctggagtgcagtgggtgtgatcacagctcactgcagccttgaactccttgctcactcgatcctcccaccttggcctcctgagtagctgggactacaggggccccccagcacacctggct

SEQ ID NO: 171261 - DNA, 960 bp, Homo sapiens
  misc_feature (960)..(960): n is a, c, g, or t
gagcgagggctagtcccggaccgccgggccaggggtccggcggcagcagacgggtaccgtggcggccaaaaaaatgctcctgtaccgaggggcccccgccggccctggcgcgccgggctgcgggctggcccggcccggcggcggcccgcaggccttcgggatccgcctgagcacgatgagcccccgctacctccagagcaactccagcagccacacgcgacccttcagtgccatcgcggagctgctagataatgctgtagatccagatgatctgccaggacggtctttatagatgttgaggaggtcaagaataaatcttgtttgacctttaccgatgatggatgtgggatgacacctcataaactacaccgaatgctcagctcttctggcctaaatcccgtccttcgatatctgtacaggtgctggggagattttacttgcagaactttcctgtccaggcaaccatcaaactatacgaggactcagacagcgaagaacgaagaggaagatgaacgagcaggaggatgacacgaagagacagtagcgaggccaaatgaaaaggggccagaacgggtgtgtgacggctaccagggtcatacccctaaagggcacacaagtcaatgccccattcttcagacccttacctaatcaaaattggaggcacgcaggagtctggttgggggtcaagatgacgtggaaagtattgagcagacatcagttagccggcaggtttactccaagcaagatagagttgtctgcatgaaatgggtcaactactgccagtcacctggttactgcatggctgtgcgtcaggccttggatcacaattgttggttgctgtggatacaaggcaggtcacgagctacacgcaggttagttacaccaggagtggcacggagaagcctcgcgtgagatcatctaagcttacgaacaggggattccactagaagacggcacaan

SEQ ID NO: 171262 - DNA, 2286 bp, Homo sapiens
gagcgagggctagtcccggaccgccgggccaggggtccggcggcagcagacgggtaccgtggcggccaaaaaaatgctcctgtaccgaggggcccccgccggccctggcgcgccgggctgcgggctggcccggcccggcggcggcccgcaggccttcgggatccgcctgagcacgatgagcccccgctacctccagagcaactccagcagccacacgcgacccttcagtgccatcgcggagctgctagataatgctgtagatccagatgatctgccaggacggtctttatagatgttgaggaggtcaagaataaatcttgtttgacctttaccgatgatggatgtgggatgacacctcataaactacaccgaatgctcagttaggaatccaacttacaggggatgtgaaggacctcttcaaggagaactacaaaccactgctcaatgaaataaaagaggatacaaacaaatggaagaccattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaaggcaaaagaaaaaagctggaggcatcacactacctgacttcaaactatactacacggctacagtaaccaaaacagcatggtactggtaccaaaacagagatatagatcaatggaacagaacagagccctcagaaataatgccgcatatctacaactatctgatctttgacaaacctgacaaaaacaagcaatggggaaaggattccctatctaataaatggtgctgggaaaactggctagccatatgtaaaaagctgaaactggatcccttccttacaccttatacaaaattaattcaggtggattaagacttaaacattagacctaaacataaaactagaagaaaaccttggcattaccattcaggacataggaatgggcaagcacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaattttcacaacctactcatctgacaaagggctaatatccagaatttacaatgaactcaaacaaatttagaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccactatgagatgccatctcacaccagttagaatggcgatcattaaaaagtcaggaaacaacaggtgctggagaggatgtggagaaataggaacacttttacactgttggtgggactgtaaactagttcaaccattgtggaagtcagtgtggggattcctcagggatctagaactagaaataccatttgacccagccatcccattactgggtatatacccaaaggactataaatcatgctgctataaagacacatgcacacgtatgtttattgcggcactattcacaatagcaaagacttggaaccaagccaaatgtccaacaatgatagactggattaagaaaatgtggcacatatacaccatggaatactatgcagccataaaaaatgatgagttcatgtcctttgtagggactataaatcatgctgctataaagacacatgcacacgtatgtttattgcggcactattcacaatagcaaagacttggaaccaagccaaatgtccatcaatgatagactggattaagaaaatgtggcacatatacaccatggaatactatacagccataaaaaatgatgagttcatgtcctttgtagggacatggataaaattggaaatcatcattctcagtaaactattgcaaggacaaaaaaccaaacaccgcatgttcagactcatagatgggaattgaacaatgagaacacatgaacatacgaaggggaacatcacactctggggcctgttgtggggtggcgggaggggggagggatagcattaagagatatacctaatgctaaatgacgcgttaatgggtgcagcagaccagcatggcacatgtatacatatgtaactaacctgcacattgtgcacatgtaccctaaaacttaaagtgt

SEQ ID NO: 171263 - DNA, 839 bp, Homo sapiens
  misc_feature (281)..(282): n is a, c, g, or t
  misc_feature (347)..(347): n is a, c, g, or t
  misc_feature (353)..(353): n is a, c, g, or t
  misc_feature (615)..(615): n is a, c, g, or t
gcttctcgtctgtcgccatgtgagatgtacctttcactttcctccatgattgtgaggcctccttagccacatggaactgccctggcaatcactattccagtctctgcttctatgagtttgactatttcagattccacatgtaggaaatgctggagtccttcatccgaatggtaaatggcacttgtgacaaaaatcaaagtaactaaaaaagaatctggttgaaacctcagtaacagttggcctgtctactgcctcacactaacaagggggagctaataaanntgaggtcagaacacacaatgtggaaatgaaaaccttattcttgtcaatggatggagggtggtganccccanctttacaagtgtctgtaattctcactagcagtatattagagggcaaaagatttgaacagacacatcagaaaagaagacatacaaatggcgctaagcacttggaaggattctgaacatcattagtcatcagtgaaatgcaaattaaagccataatgaatggcgctatacattttcagaatggcaggattgaagaccgaaaaaaatccagcgttgaggagagtgacccaatgggcgcgacagccgtggtgcatgatccgcgagnaataccatgtgacggtccggcaggaggtgggcatctacaggcagggacagctcagagaaacaactttttaaggcgggggaccgacttctattccgaatgttctgccaggctcttttgtcgtgcccccataaccggggggggcttctgggaggcggcacccgctcccatgcgcccaaacttgcaaccgcggggggcccccccacgtttcgcggcatattcgctgg

SEQ ID NO: 171264 - DNA, 1034 bp, Homo sapiens
  misc_feature (476)..(477): n is a, c, g, or t
  misc_feature (542)..(542): n is a, c, g, or t
  misc_feature (548)..(548): n is a, c, g, or t
  misc_feature (810)..(810): n is a, c, g, or t
gcttctcgtctgtcgccatgtgagatgtacctttcactttcctccatgattgtgaggcctccttagccacatggaactcaaatctggggctacgtttctaagaattcccttcactgaagagttccaagttactggaagaaacttggaacaaaaggagttctgcatgaattttgaaaggtctactgactcaacaggcagtcagatatgtaagatgggtataaagcggtgagagtgaggacaaacccataatcaatgtctggatccctgatgaactgagactcacattgatctttcaatatgtccaagcctccaactggaatgatttggttatcctgcaggaaatgctggagtccttcatccgaatggtaaatggcacttgtgacaaaaatcaaagtaactaaaaaagaatctggttgaaacctcagtaacagttggcctgtctactgcctcacactaacaagggggagctaataaanntgaggtcagaacacacaatgtggaaatgaaaaccttattcttgtcaatggatggagggtggtganccccanctttacaagtgtctgtaattctcactagcagtatattagagggcaaaagatttgaacagacacatcagaaaagaagacatacaaatggcgctaagcacttggaaggattctgaacatcattagtcatcagtgaaatgcaaattaaagccataatgaatggcgctatacattttcagaatggcaggattgaagaccgaaaaaaatccagcgttgaggagagtgacccaatgggcgcgacagccgtggtgcatgatccgcgagnaataccatgtgacggtccggcaggaggtgggcatctacaggcagggacagctcagagaaacaactttttaaggcgggggaccgacttctattccgaatgttctgccaggctcttttgtcgtgcccccataaccggggggggcttctgggaggcggcacccgctcccatgcgcccaaacttgcaaccgcggggggcccccccacgtttcgcggcatattcgctgg

SEQ ID NO: 171265 - DNA, 1012 bp, Homo sapiens
gaacttacggctaggtacgaggccctgggtgttacggtctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccag

SEQ ID NO: 171266 - DNA, 1230 bp, Homo sapiens
gaacttacggctaggtacgaggccctgggtgttacggtctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccaggggcctcatgcctaagatagagggtgggagcgaacccacatgaaccaatacagcccagctccaactagatccagattccaggtttcttgcttctttcttgggttcctcagttctctcctgggttccccaacctcctctgccaccacaccaaaccaccagtgatgcatcccctggggcaaagctcatcataacccctctgcacaccagccagcctggagaccgttgttcctggggcctgttactgatcctcatctagccttgatttatccacaggagactgcaggctttgaac

SEQ ID NO: 171267 - DNA, 1065 bp, Homo sapiens
  misc_feature (943)..(943): n is a, c, g, or t
  misc_feature (946)..(946): n is a, c, g, or t
gaacttacggctaggtacgaggccctgggtgttacggtctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccagggccngcnaaaaggggggccctacaataagcgccctaaaaaaaaacggtttcgcggaagggacgacggctttccttaggacgcctgtgtagtatccaacatcgcacccacgctcctcgccgtctccg

SEQ ID NO: 171268 - DNA, 1057 bp, Homo sapiens
gaacttacggctaggtacgaggccctgggtgttacggtctggctgcccggcggttgagagcatggcctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcagtagtggatcctgactagcctggggtgtcaagtgtcctccgggctcatgctagatggggggggcgacccttacatagcatcataaaaaaaaaaaccgttttccgggggaaagtaaggcggcatttcccctttagggaagggcctttggtattcgtttcaatctcgtaaacggcgaacccc

SEQ ID NO: 171269 - DNA, 1038 bp, Homo sapiens
  misc_feature (916)..(916): n is a, c, g, or t
  misc_feature (919)..(919): n is a, c, g, or t
tacagccttagtacgaggctggggtggaatcggccgaggctctccaggggcaggtagggcgcctccggagttaccggagcggaactgcgggtaccgcgaagtcgagtactgggatcagcgctaccaaggcgcagccgattctgccccctacgattggttcggggacttctcctccttccgtgccctcctagagccggagctgcggcccgaggaccgtatccttgtgctaggttgcgggaacagtgccctgagctacgagctgttcctcggaggcttccctaatgtgaccagtgtggactactcatcagtcgtggtggctgccatgcaggctcgctatgcccatgtgccgcagctgcgctgggagaccatggatgtgcggaagctggacttccccagtgcttcttttgatgtggtgctcgagaagggcacgctggatgccctgctggctggggaacgagatccctggaccgtgtcctctgaaggtgtccacactgtggaccaggtgttgagtgaggtgagccgcgtgcttgtccctggaggccggtttatctcaatgacttctgctgccccccactttcggaccagacactatgcccaagcctattatggctggtccctgaggcatgctacctatggcagcggtttccacttccatctctacctcatgcacaagggcgggaagctcagtgtggcccagctggctctgggggcccaaatcctctcaccccccagacctcccacctcaccttgcttccttcaggactcagatcatgaggacttccttagtgccattcagctctgaggccagagcatggtcctccacccttcctgccattctgccctgggctcctcaggtagttggaattcctgacttaggacttggggttgggtccaaggtgcttacatcccagggccngcnaaaaggggggccctacaataagcgccctaaaaaaaaacggtttcgcggaagggacgacggctttccttaggacgcctgtgtagtatccaacatcgcacccacgctcctcgccgtctccg

SEQ ID NO: 171270 - DNA, 468 bp, Homo sapiens
tcaacctccgcctcccaggctcaagcaaacctcctacctcagcctcccgagtagctgagactacaggcacccgccaccatgcctggctaatttttgtacttttttagtagagacagggtctccccatgtttcccaggctagttttgaactcctgagctcatgcaatccacccacctctgcctcccaaagtgctggtagcgcctggccctaccccttctacattaaaggctgggggagttcattcggtacagcccatcataagcacaggccccggacactgttctaggggaccgtgacttgtgcttaaggctgcaaacgcacggagcccagatggtgctgagatgccccatctccactctagcgttgagcctggtgtggtcccagcgggaaccctaggcaggggagtggctgcagggggagcctcctctctcagcctcagaccagggacccctggccacgtgcttgtgg

SEQ ID NO: 171271 - DNA, 288 bp, Homo sapiens
tctctaagaatcatttgttaaatgaaatgccataatatccagtggggtgaaggtggaaggaacaggcatgcctatattctgttggtagaaatgtaaatagattcaactttcatgtgaggggtatttggcaatgctactttttaaaaaatccgatgcacattaaacttttcacccagtaactcaactgccaggaatttttttttttttttttttttttggggaaaaaaacagttttcacttccctcaaaaaaaaaacatatttttttattcacccaccatttttttttc

SEQ ID NO: 171272 - DNA, 262 bp, Homo sapiens
ttgctggaacccaggctgtcattctgatgtgtgagtctcacctaactcctccgcctgtctgggctcccgtttccccatctgtggcccagattttgaggatgtgctctagttgggtggtcatgtgctgcaagttctgtacaagggcttgtgcccattcatttattcattaccctgatggttggccttagggacacagctgagcagctgtctctactcagtgggaaacacagacagcgatagaagagaaatcagagtcagtggg

SEQ ID NO: 171273 - DNA, 517 bp, Homo sapiens
ttatgtatgctgaatgagtgagtgaatgaagaatgatggacacaagacaagagagaaaatacactgaggagatagtaagaaattgacccaagacatgagataacagagttttatttctactgccttgagattattacaggaattaaagttgtaatttttctacttaaacataaaattcatatgtagtagagattaggtaattagattatatattgggttagatgattaattagattttataattagatttgattggtctatatttatctgatatataaatagattatattgcattattggattattagataataggatttatataaaattattccgtcaacgaactgccattttacaattattcctaacatataaaaatgcacttctggctgcacatgatggctcacgcctgtcattcctgctatttgggaggctgagggaggaggattatttaaggccagaagtttgaggtgagattagccttagtaacagtgcaagactctgtttctaaaaaaaa

SEQ ID NO: 171274 - DNA, 418 bp, Homo sapiens
gatgggcgggcagcggcggtcacctgtgcatcctagacctgcctggtgttaaggactgtgcttgcagattcctcacaacctggtagagccaagggctgggcccttgtaggctaggatttggggccccctcagccacccaatagctgtggggccttggcagtcacttaacacctttgtttaatttccatatctgtaaaatggatgctagtgaccacccaccttaaatatcctctaatgagcatttctcagtgttggtgctactgtcatttttagccggataattttccattgtgggaggctgccctgtgcactgtagggtgttgagcagcatcccagcttctccccttgtgacagctgaaaatgtctccagatattgctacatgtcccctgggaggggtacaaaaattgccccagttga

SEQ ID NO: 171275 - DNA, 341 bp, Homo sapiens
tagaggaaacaacaactccgtttgaggggccaggaggatcttatggatgggctgctgagccctaaatgaatgtttgccaagagcagtccacggaccactgcgtgttggtgaacacagagctgctggtccacaaggtctccatgagggatgaagaatattatattgtgcttttctgtaatctggaccctctttaccagagcttcccagctgaggtaccacaaatgggttacaagtgggcaatgacatgaagaacgttgagataccagatgaccaccatataatcaagaactactagaaaattttagtgtgtaaggctgggcgcagtggcccatacctgtaat

SEQ ID NO: 171276 - DNA, 185 bp, Homo sapiens
ggaaagagaattggagtgggggattagggcatgaggagaatgaaatagcaacagtaagacaagcaataaataagacataatttgaatgaaaggaacacagaagtgacctggtctaacctatttaggttagaagtgagaccacaggtctgatgagggaagtggttttcctagtgccacacagctag

SEQ ID NO: 171277 - DNA, 307 bp, Homo sapiens
gagactcaggacctgccctccatagttccaatgcaggagtctggattgctcctccccagaatatccaaggcaccctcacagcactatctcaggtgtgagctcagccctgggtagctcagaggaagggaataaatgggaatgtaccatcttagccacaagcatagcttagggagcctataatgatcattctttccttcactcatgtacaaatgatgactgaacacagctcaatgcctgacacaaggcccaatgtggggcgggggataggaggttgccccgggagctgtaggggacagaaagccagtct

SEQ ID NO: 171278 - DNA, 256 bp, Homo sapiens
cgtgtgtgcatgtgtgtgaatgcatgtgtgtatgcatgtgtacgtttgtgtgggaatgcatgtgtgtgcatgtgtgtctgtgcatgcatgctcctgctcacatggtgttgctgtaggaagccaggaagtctcctcaaggccactccttgtccactgctgtccatttccaaagaccctcttttcagcatccttcctgcctgttctaagccacggtggtgaaaatccaatccccaggctgtgaaagcaacttccctct

SEQ ID NO: 171279 - DNA, 230 bp, Homo sapiens
gatctagaggatcccttgcttgtggtactcctccgctgctcagctcctggctgctgcgctcaccgggcacgtaaatcagcactgccctgtggcccaggtaaatcagcactgctgtgttccaggtaaatgagcactgccctgtggtccaggtgaattgtcagtgccctgtatcccaggtaaatcagcactgccctgtggcccaggtaaatcagcactgctgtgttccaggt

SEQ ID NO: 171280 - DNA, 259 bp, Homo sapiens
ttgtgaagatactttcctcctttcctgaaatgcatgtgggtgcacacacaggcccctaggatcgtggtcccagaggtgaggtggctgaggacctcgtgcgagggacaaggaccaggccctacacgttgggacgttgaggaaggctgcacatggcagtggccttcaaagtaatgatctccccggtcggctctcaagcactttcacacatgtgggctcgttctgtcactcaaggccagcagaaggggaaccagaagtgtca

SEQ ID NO: 171281 - DNA, 327 bp, Homo sapiens
ggctgacttagaggacccgttatcgccaacacccactgccatctaccctccacctagtctgtcatcaggttaccaaactcaacccaaatcccttttccaaagcagcgtgatgaggtttgctacttactttctgcccaagtcctgggagccctgttgtccagtagggctatgattcctctttaactgatccccactatggcagtcatttctggtctagagtagttgtcccatctttaacaatttatctcattcttttgagaggccttggctactctgttattctccttagttcctgctgactgcaacagtgttgggcgataacatcag

SEQ ID NO: 171282 - DNA, 369 bp, Homo sapiens
atctcccaactcaggaagtgagtattaggttgggttcatctgggtggccccgtccacctgttctccctcctctagcctttgcacatgccgttcctttgcctgtttcatcctttctccgctctactcttcttcaaagacccagttcattttatgatccctcgctagggcctcaaagagactaggggcagaaatcagacctgactcacttctgggtccccagcattgccctacacagagcctggtgctaaagtgaagtgaagttatataaatatttacacagtgatctgaactcaggggtaacaacaggtctttggggtgagaaaggggagtccatgaagccaagcgatgtctgcctgacagggcccgtct

SEQ ID NO: 171283 - DNA, 164 bp, Homo sapiens
tccaagtagttattgttggtgtagagcaatgctattgatttttgtagttgggttggctgcatatctggcaaccatgataaactctcattagtttcaatagtctattgagactgttgatttgtctgggtagatgatcacaacacatagaaataataacattttat

SEQ ID NO: 171284 - DNA, 464 bp, Homo sapiens
gagttcaatgaaaatattttaattgatgcttaaacgtggcaattaagttgaacaggtacttctgatgtaaaatcgtaaaactctaccaacaaaagcaaacattatacttaataaaagcaaacattatacctaacattgccattaaaatggggaacaagacaatgaagcagactttgatcattattagttgcactggaagtgctaatatcagtgtagtaaaaataaataaaattggaaaataattatttacagataatacttcacaaattaaaaagtagcactggtaaatccattagtactaacagacttcactcagtatagaaaataaatagaactaaaatataaaagattttgggactggcacagtggctcacgcctgtaatcccagcacctcgggaggctgaggtgggtgaatcacctgaggtcaggagttcaagaccagcctggacaatatggtgaaaccc

SEQ ID NO: 171285 - DNA, 295 bp, Homo sapiens
gagccgagattgcaccactgcactccagcctgggtgacagagcgagactccgtcttgaaaaaaaaaaaaagacaagaagcctcagattgttgaatcctattggtccgtgtactgcagggtgaggttgtgtggaatttgtgtagatagagtccaccgaggaatgagcaatgatcttagcaaatgcttgggccaaggtggcaaacagggttctctgcccacagttcggagatgcccagtgggagcaaagagaaacgagtccccagtaacacccagcaggtacctttgcccctggaaa

SEQ ID NO: 171286 - DNA, 334 bp, Homo sapiens
tcagacagcggacccccgagaatggagtttcgctctttgttgcccagagtgtaacgcaggtgaacgatcttggctcacgtgcaacctccacctcctgagtacaagggattctttggcctcggcctcccaaagtgctgggattacaagcatgagccaccgcacctggacctgcagtgtgttttgatcagtattattgagaatgaggcaccagtttcctctctgagccatcccttactctaatctggtggttgtcactgggggtgattttgtccccggggccatctgacaatgtttggagacactgttggttgttacagctgagtgggtgggaggt

SEQ ID NO: 171287 - DNA, 452 bp, Homo sapiens
ccagtgagagaaggcaagaacactagtgacgggaaagaaaaagatgatctgcaaactcatgaaaaagcagcctgtacatctgggattttcttctaaactgcagagtgggatatttgcactttccttcaggcaactttggaaagtggatcatagttctggtagctcttgctagaggacgaattgtactcaccactccataaggctttgatcctaacagtgttcaatcagtagcagtcatcattgtatacttaaagccttggacgtggggcagagagataaggaagaatgaggaagcaaagcagttacagaggacggcagaaagaaggctgccatcctgccctttctcccactccagctggggatgagcaaccagctcttttcatttaacccctttgctactctgacagtcatcagggaacactgaactaaaagggctggctgtgaaactacta

SEQ ID NO: 171288 - DNA, 432 bp, Homo sapiens
ttacagttttgtggcatttcaatgaataatgtgtctcaggttctgggaaccctatttatggggaacactcaacccacaacaatgtcacaccatggtagatactgaagtccccccaccggcaagaccaaattctgctaccttctcacatggagaataaaggtatcgggtttgctttaggaaagtaatgaattctcaatacactccaggtacccacagactcaaatgaccctgtgtggaaggtgctagcagaaacacagccagagacacagctgccctcacaaagagcccactgtagggtgtggaacctagaggctgaagggcatcaagaggccagtggatagcctggacttcatccctgctctgcccatctcagcaggacatgtctcaggcttcaacaagttgccaagttcatcttttatatctttttttttg

SEQ ID NO: 171289 - DNA, 259 bp, Homo sapiens
ctcgggggcagttttgggggtgtctagcaaagacctggaaggccttcccggttaaccctgacttcaggagctgctgcactgggtcatttgtttcctcagtgctgggccttaaactttacctcgtacccaaagcagccatggctaagacccttgctagcagctcaccaggcatgtaggaatctgcaggcctgggcatgggcgcatggaatgattaactcttcatgttcgagggagccaataatagtctttacctcatagg

SEQ ID NO: 171290 - DNA, 181 bp, Homo sapiens
ggtggtggaaatatgtggactaacagggtagcagtggagcatctgaagcaatatcttcccagagtttacattctagtgagcgcattaggtagtatatacaaataaataagacaactgcagattataccaaatgctatagaggaaatggagtgatatgctggagatttattggaggtggtac

SEQ ID NO: 171291 - DNA, 574 bp, Homo sapiens
gtaaagcttattttcaaatgcatttcccactacccaagactatataaccccatctctactaaaaatacaaaaattagctgggcgtgacatgcctatagtcccagttactctgaaggctgattcaggagaattgcttgaaccgagaggcagaggttgcagtgagctgagatcgcgcctgccatgtcctggatgacatctgcctggggacactcgaggcagacacagccccggttgcaggctagccactggtctgtgcatcccctcatcctaggcagattgggcacagggccaggcaggctgtggggagggctctccgcctggactcagtaccatccagccattccctgaaggtgactttgccccccggggatcccaggccatatcttcacacattgggtgcacccagcatctggtgggtggggtctggggatgctgcaaaacacgttgcagcagacagcatggcccaccgcagagaattctccaacccgaaggtccatagtgcccaggctgagaagacctggtgtggaaaaaacaggatcgcatgacagtcaagttgcccatggccttttgcagg

SEQ ID NO: 171292 - DNA, 311 bp, Homo sapiens
cccagcttaaacgcacaagtccttgaccttttcacattttgtggggcaagccctagctggagtatgaagtgaaacctcaggactttcttgccagatcccagagaaggctgggagggcctaatggctggttactgatttgagatgctgctgcgttattcctcagggagtggcactttcagggctgtttttctctcgttcaaaccaaagaagttaatattagaacctgctttcaaaagcagtgtatttgtggactctgagttttatgtgtgttgggttggtgcccaggggtgaaggcagatgtaaattatttg

SEQ ID NO: 171293 - DNA, 275 bp, Homo sapiens
ccaggctgggtgacagaatgaaactctgtctcaaaaaaaaaaaaaaaaagtacagtgtagtaccccacaattgctatcccagaaaaacaatttaaaattacctcaaaatacattgaatagttatgagcacatgtaaaatatataaggcaaaattctatacttgtttctttaaaacatccatatgatgtttaaaagaaacaagtgggagaatcacttgaacttgagaggcggaggtcgcggagcagctgaagatcgtgccactgcattcaaggctg

SEQ ID NO: 171294 - DNA, 581 bp, Homo sapiens
tgctgcacagggatgcctacccacagtggaatgaaacttaagtcaaccctttctctcttcttgaccacatgtatcatgacacataggaacgaaattgtgtagcagcattattttaggctgatttacagtttcctgtacttgtttttatttcctggttttaaaacctaatattataaaattgtttgaggaccagttcagctgtcatcaggttgactttgagacctgtctgtagcctctgagaatcctatttctttctttctgagaagtcagctttagaagccccctttcacttctgggacagccgaagatatcctacaagtactattgctgacagtcaggactaaatagttcactcagcagttataaagtaatggtcactggaagtttactatcttctgaagcggcagcctttgctgctacggttcctcaattatctgccctattggaaatgggaaggaagagagaggttattagcttttcatagaaactacgttggaactcctattcctgttttgaccagatacctgtttgttacacattctggtgtatgcggtactccacgagattagaagtgcatattc

SEQ ID NO: 171295 - DNA, 705 bp, Homo sapiens
aagacggagcccccatatccaaagatagccaaggagaaagaaagacccctgttgccagagccagtgggcaaaggcaacagaaaaggagacaagggtcctaatgggatgagatcctttcggatttaggcttttacaaactcctgagaactggcaggttgacagccataaatggggtaccaaactttctactcattggattacaagttctcaggcatccagaatgatgaacaaaatgacaatttctagggcttctgtgggagagtatggaaaggtctttttgaaccttttaatgctgtcaacggaagaatgatgaggttcataaatttggaaaggagacatttcttcatttttatgtttatttttattttttttgagacagagtttcactcttgttgcccaggctggagtgcaatggcgtgatcttggctcactgcaacctccgcctcctgggttcaagcgattctcctgcctcagcctcctgattagctgggattacagatgcccaccaccacacctggctaattttttgcagttttagtagagacagggtttcatcatgttggccaggctggtctgaaactcgtgacctcaggtgatccactcgccttagcctcccaaagtgctgggattgcaggcatgagccacccaaccagtgagagatttatttcctataaagggttgtagcctgcagggttgtccttctga

SEQ ID NO: 171296 - DNA, 372 bp, Homo sapiens
gtcaatctttccttcaaattgtttctgaaggctttgtgcacccacattacttgcaagaaatattttcgtatgttttctgctaggaataagagactgcctataacaagtaaaattcctttagctgatgggtgtactttttgaattatttggaatatgatccttctgttaaatattaggccaggccaggcacagtggctcacgcctgtaatcctggcactttgggaggccaaggtgggtggatcacctgaggtcaggagttcaagaccagccgatacagattgttttttaggtgagtgactgctaaactcttgtttctttctttttttttttgagacggagtctccttctgtggcccaggctgtagtacagtgg

SEQ ID NO: 171297 - DNA, 179 bp, Homo sapiens
tgcaaacctgcttagagagaggagaaaacagaagaagactgttgtgtttaactgaaactgaaactgcaaatgaaggggtttttttgtcattttatgttttctttttggtttgtattcctcaatccgtgccttgataacaattcataaatctaggttcaaagagtacaaaatccatatta

SEQ ID NO: 171298 - DNA, 546 bp, Homo sapiens
aacagtatcagaaaattgaaacttttcagttggtatttatgaaggaagatgttccttgcagtcctataacaataaatagttgtctctactaaaaataatatttgaatcattttaaattgagtctagaaaggacttcagataataacagctgttaaccatttattgaatgtatgccatatgctgagactgctaggctctaaatacattatctttaattttcacaacaacccggcaaggtgggtggtgtacaattttgaagctcaactacactaaacaagaagtgaataggcagtaaaatgggatttcagtgttggacatacctggtctcaatcccttgctctttcatttgttagtagtgtgaacgtggaccaaaaaactaccttttaggccctcattttcttcactgggttgttatttgataatggtaataatcacagaattatatttattgagctgttatgtgccaagcaccattgtaagtgctttacatatactcttttattcctcataacaacccagtgaggtagaaaaagaaattggcggccg

SEQ ID NO: 171299 - DNA, 400 bp, Homo sapiens
aaaaaaggcttcttgatatgggtctgggttgtggtttttaaaaaatataaccccaaaggacaggcaacaaaagcaaaagtagacaaatgggactgcatcaaaataaaaagcatctatctgcacaacaaaggctcaatagagtgaatagaccagctatggaatgggagacaatatttgcaaaccatacttcttataaggagtaaatattctagtttataaggaaatcgagcccctgactgccaccaccgctgccgcccagagactgctgagcccttgttggtctgccatcaccacccactccagaaacagaacatccagtcatggataaaaatgagctggttcagaaggccgaactggcccagtaggctgagagatatgatgacatcgcagcctgcatgaa

SEQ ID NO: 171300 - DNA, 308 bp, Homo sapiens
ctggagtcagttacaatcaaggaaaactagttttttggcctgagaactggaaggatggagttaccataaacgaataactgcaatgaggaaggccaaagtggattaaattgtcctggccaacatagtgaaaccccatctctactaaaaatacaaaaaaattagctgggcgtggtggcgggcacctgtaattccagctgctcaggaggctgaggcaggagaatcgcttgaacccgggaggcagagattgcaatgagccaagattgcaccattgcactacaacctgagcgacaagagtgaaactccatctc

SEQ ID NO: 171301 - DNA, 154 bp, Homo sapiens
acctactggtccagctcttcttcccctctttgattattctgtctcagcctcctttctttgtccttcgcctcttaaacactggtgtctcctgagtgtttctcatttctcacattctcttagagtgaactcatagttttaactatcacccaggctg

SEQ ID NO: 171302 - DNA, 632 bp, Homo sapiens
aagagtggatggcgaccagttcaatgtatctaagtaagagtgccataaggagggggtctgcttggtgctaaggtctagttcaagttgtcaaagcacatgtaggaggagaaaggtatccacgcagggcaggggtagcaagtactcctgtgaggcttacaagcctaggagcatctgcattaggggttaggataataagaaaataagtaaatatgctgagataacaagccaggtttctcaccgtctaatgtactctgctggacttgtaatgggaggtagcagtaggaactcatggttttcaatattgatagatatggaaattatagaaaggaatatgtgcactatatgtaaatgtacatcattatatacatacatacattctctagctctgtccattgagaggcctaggagcagctatatcccaactgcaaggagcagcatgttcagcacccagaccttggcttctaaataccattctccactaaaatgaactagggggtccttggagaaatggctgactccagaactaaagcagaaaaaggacaagataagcctagaacataatgtgccaaaaagcaaagaagtactcaacgactgacgagatatgtccaagaacataaaacctgcttgaaaag

SEQ ID NO: 171303 - DNA, 315 bp, Homo sapiens
caactttattcctttaatcctttgaaaaaagcaggacttgccaacctggtttaaggaattatctgttgcattcaatgtttttgctgtttaaaaatacagactgattccatttttgatgatgtacagtgggccttggcgccccagtggattcttcctttaagttccttgtcactatgggcatcttccctgattattttgctgttatctctttcctgtgggtttcttcagtaggattctatgtgtgggctcagttgtcacagaggagacagtgtcccatacccagggaatgcctagagcagcatccacattgttttt

SEQ ID NO: 171304 - DNA, 137 bp, Homo sapiens
aggtagcatctcaaatcaatgaggcaaagatatgttattcagtccatggtgtgaaacaaatgagtaggtcaatgcaaaacaatgttactagcacaagttaattgctacagattgtttttttttttttttattatact

SEQ ID NO: 171305 - DNA, 238 bp, Homo sapiens
tgaaaacattttgaaaatcaactggaaagttctatacagtattggacagagttcagcatggtgtcttatacaatgtagatattaaacacattttaattgaattcatttagaggtggaattttgaatgcaatgtgttgaaaaatatggattttgctataataatactaataataatttaccatttgttgggtcctaacatacaactagtattgttttaaatgccttttcaatcatttac

SEQ ID NO: 171306 - DNA, 493 bp, Homo sapiens
agaatgttgtcagtttgcatttgtctggtgttccctggttggattcagatgatgcatctggggcaggaatatgtaggtagagatcgagaatcactcatataagcgagaaagtggataccagaagaggtggcgttccggagcagaaggtagagagagcacacgctggagtccagggcgcggggaggcccaggggtgtttgggagcccagaggagttgttgcagtggcggtggatgagggcgtgagaggacagggcctctgtgtgggcaggggctgtttgcaatatcaggaagaaggtggattatgaggagaagggatgactccttgaagcccgagctggtttagtgagcagaagttccatatataccatcattcctggggtgcgtctgtggcacgggagcggcccgtgtgaccctctggatgaaggaggttttgtacctgttgagttggaaacgtacctggttagagtctttcccaaggaaatccagaacccct

SEQ ID NO: 171307 - DNA, 370 bp, Homo sapiens
aagcttctattctccagaacagaactgaaaagagagccagcaggccaaggatctccaagtcagatacatcatcagaggggactcaggaaagggaacgtgttgccggatagtgtctgagggtgggcacccggggacagatcctgaggagggaatgtctgtctgtgtgatttaacagggagcaaactcaggagaaaggaagggaaggtggcagagccaggcaagggaaggaggtggtctcggctggggaccaactcaggccatccacaggatgccctggaacatgaaccgcaccatggagtttaccccacatggaaacaaggaggagcagccctttgcacccctgagtcagccagggctggtgcagggtgag

SEQ ID NO: 171308 - DNA, 453 bp, Homo sapiens
ctgggagtggccaatgaggtggaagtgaaaaccagagggggcggggtggaaaagggcctccaggaacactcagctaggaggcaagtcttctgctctggcttattcctcctttttgctgctggaacatgactgtgatggctagagctgcagcagcaatcttgtgaccatgaggtgaccttgaagatggaaatcagagctaagaatagctgagcaagagagaaagggccccaggctctgaagacagtgggctgcctacctctgcatttctttcccaaaggagagaactgaacctgtgtcttgatcaagccactgatttgtgttctctgctgcttgtagcagaatccaatcctagattattacgcaattttggaactgtgtttcctggttttcctcttacctcttgggttgaccttcccatttctgtttgtgggtaccttcattgtccctctaata

SEQ ID NO: 171309 - DNA, 322 bp, Homo sapiens
cactctgttgcccaggatggagcgcagtggtgcgatctcagctcactgcaacctccgcttcccgggttcaagctattctcctgcctcagcctcctgagaagctgggattacaagcacgtaccaccacgcctggctactttttctatttttagtagagacggggtttcacccatgttggtcaggctggtctcgaactgaagtcaggagttttctagctccctttgatgaggtggcagctctacctgggtctccactttaggcagttccaactccttggagttggtccatatcccctttctgccttagtttcattttacctagc

SEQ ID NO: 171310 - DNA, 303 bp, Homo sapiens
aatcttcaaatacccaagaatgactgtaaagaaatattaagttcctaatgaaaaataccatagtaacacagaattttgtcttttaagaaaatgctgaatgtagctgatgaaagaggatgaaaagtagggttgaatctgaattatgaagagcaaaatgtacagagtttgggaagaattgagaacttctaagacaaagccaatggctaaattgatctaagaggaaggattggagtgactttttgtttactccagctttgtacaacttgctgtgttcagttgtgctagcatacttttctgtgagct

SEQ ID NO: 171311 - DNA, 333 bp, Homo sapiens
gaagggagggaaagagaggcaaaaagataaacacagaaaagaagagaaatctaactaggattagaaggataaagaggaaaggtaagtcagttcctctaagcttataggtgtgctgggaacattgatgaatgaatgcaggaatcactgagtgagagagggaaagacctgaaatgggaggcatccaaggacaggaggggcagggctgacaggagctggagctgcaagcatcttgggaggtggtggggagggaattgcccaggaggataaagaggctttggtttttgggtcacctcggctaggcaggggctccgcttgtgctcggtcagaacaggg

SEQ ID NO: 171312 - DNA, 165 bp, Homo sapiens
aaccaatgatttcttcgacagtgtagtgcatatttacttgtattgatatactttctaatttttttaagaggtagagtctcaccctgtcatccaggctggagtgcggtagcatgataatagctcactgcagccttgaggtcataggctcaagcaatcctcccattt

SEQ ID NO: 171313 - DNA, 366 bp, Homo sapiens
aattaaatcagaatcagtgggaacagacctgagcactggtaatttttggcagttgtattctctttaaaatccccaggtgcagtcagtactgagaaatattggtatatggcagtgattctcagagttgatccctggactagtagtgtcactatgagttggggacttgttaggaaacacattatcaaggcttgccccagatttactgaatcagaaactctggaggtggagcccagcaatccctgttttaacaaactctctgggtgattatgatgcatgttaaagtttaagaaccactggtatatggtgggggtgggagcacagggggagtagctacactgtatctataagtatccttcatggtcagca

SEQ ID NO: 171314 - DNA, 342 bp, Homo sapiens
tccctgtggaagagataagagaaagtgaatgaaggtttgaaaagaagcatggagaccttcaaaattatcaaatttttgagtttaaggtgatatttacattaaaatagcttgccagtgatgagccaatgaagggaaaagcttacttttcagttagttatgatttccagggcagaggaaaagtaacaaggagacagggtcaaaggaagtgagaagctgaacagaacttttaaagtttaaacttaaagaataaaaacacaagagaaccagaaacaggttcaattatgctgaatactctatttcccaaacctatcctctacttgtctcattaatgtctatatttct

SEQ ID NO: 171315 - DNA, 465 bp, Homo sapiens
ttcctggcataattagcctgttatgtggctatgccttttgaaactactagaccaaatgtgtgtgaagagtaattgaccacaggataaacctaattgtgttttgtgaaggaggtgtggttaagtgagctgcaatgtgagaagagaggagaaattctctaatgcaattattctcagagttcctgagactctcaggagatctgcaaggtcaaactctcttcaaataccaagatattatttgccttttttggtctgtttctctcataagtggacagatgagttttccagaagctacacaacatgtgaaagtgcaacagattgaatgcagaagcagagacgaaaatctgactgtctcctattacaccagtcattaaagagattgcaaaaatgtaaaacaatgcaactctcctccttaaattattgttttgggaaaaaattttgaaaaatatagtatttattttaacatgt

SEQ ID NO: 171316 - DNA, 501 bp, Homo sapiens
gaaatgtaggatttttgtcggagtttgtaatgccaacaaagaatctcttctgcacatgatagcctgcgttggttttttttcccccatttattttcttctttccttttttctttttgaaaagtgctttaaatgcaggtttgtaatttatatcaaagaattactttaaagttctgatgtctcaggcaaacataagatgcctgggatttggggagatgaggttcttttgcatgtctatatctgaatattttattgccgtgtcgcaaatgttggggcaggcagacaggctgggtaggaggggtcttcctacagcccctgggctgtgaaaagcctttctttgtgcctttcaggaaaggactttttctctgtgagaaaaaaacagctttcctgattttagggagactggacctgtctatggcctccaaaggggaaaatctggggtcatgtcctgctttcagcaactggctttgaagctacctttttgggtccacttcctagggactg

SEQ ID NO: 171317 - DNA, 589 bp, Homo sapiens
cctagcactttgaggagaccaaggcagaaggatcacctgaggtcaggctggtctcaaactcccgacttcaggtggtctgcctgcctcggcctcccaaagtgctgggattacaggagtgagccaccgtgccaggccttctccaggctcttggcaccttagccagaaacaatttaaggacaagtgcaaaagtcatgaacgtaggcagatttcctgcagagtaaagggactcactgaagaagaggaacgtgggggtcctcaagagagtgtctcatgccctacaaggtgtggggctgacctttatgggcttcttcaactaaagaggggtatattcatgaagattccaggaaaaggtaaagatttctcaagaccgtggtgccacaatttacacccaaatacaggtgttcctggagccgtcttggcactggtgggtgtacggtttcatatgttactgattgtacagtgagatcctaggtgaaacctacatcaaatacagcgccatgttgtgtctggttggtcgtagccagcttggtcctcatcctatttttcagggacttattggcccttagcgcatgcagctatttcaagtttc

SEQ ID NO: 171318 - DNA, 417 bp, Homo sapiens
gacaagacctagattttgacagctgggatcttcaggtgctgctggtctgtcccctggcctaggggatggtccctagagagtctcttacaccgatcagaagcagccttatgaacttcttgccagtcagcctagtgtttgtctctccctagagattttgtccccccttccaaagcctctcaagacccatttctccgtttcctcggaggacatttgctggtcagagggtaggcacctctccatctaaactgagggaagctggtggagtcacattttgggggaagtttcagagtcaaagacctgtgtgaacctaacagaatgttggaatggctggtgcttttgcacacaccaaatgtgttagcacactcacctttatgcacaggacagcgggaattctaggtctggaaaaaaacccaggtg

SEQ ID NO: 171319 - DNA, 469 bp, Homo sapiens
tattaggcaggggctgccggggaataaacgaggactccaaattttctgtaggaggggttttggggggtgagcaattcagtctgggagagagaaggcctttaatcctagtgaatagctctttgcactagcctgggaggaagctgaactgtcatcctgccttgacttaacacagcctttaccctagaagctacagcgccactcttcagaggtctaccctgtgtgcacacagggagaagacgcttaggttgttaaagtcagcatgttaaataattttctgaaatgcgactataactagaacccagctgacttcccccatagccattcttacctatcttattactgattgtctggtacaatcacaaagtgcggtggtactgacacctaccttttagggttgtttgaggatttcatgggataatgaatgtagactgctttgcaaacagtgagctttcaataaaagggatctatt

SEQ ID NO: 171320 - DNA, 548 bp, Homo sapiens
taggtcaaatccaggaacccctgttttccgagttacgtaattttgcagaacggacacagaggctcctgggaaaaactgcctgtccgcctgttaatattaaggtccatttataaaattagaagctatgttgaacagatgaatctgaaatggaacttgcctattaaagttttttgtttttgtttttgttttttttttttggtcagatagccttatttaacctttctgtgtctcagaggttggtggcctttgcctatggtgccttcatggaaaaagttctaaatatagctcctgtttgttgttgaataatgacttgcgagggcggatggtagagtttccaacttctttaagtcagcaaactggacaagagggcatctagtccgaaggaaagccatgtgcctgagtgttcagcactgctgctgtttttactgtggtcctgggtttagtggatgttcagtacactgtgcctgtctctcttgattgtccttctcctcccagtttttacctccaaaagcctgtaactttttcttttttttctttttttttttttg

SEQ ID NO: 171321 - DNA, 218 bp, Homo sapiens
tacattgacaaagctacaccatttatgctaaaaaatctatgatacatattcatcttgaaaactaaacatatactttccttccatccttctggcaaaattaccccaacttactgtccttttactatggatagcatgagcatttttcctcataaacaacaaagagaattaacactaaacagcaatgaatagaaaactgtagtgtaaatgttttataccac

SEQ ID NO: 171322 - DNA, 168 bp, Homo sapiens
tgacataagcggagttgaatttactaatatggttttaccaagagagtttttcaggagagtagtggaagggaatagaagtatacacaaggaaatgattacagtgatgaattgtggaatataagctgagtaggaagggaagagggtcttgaaaagctggtaggcttatca

SEQ ID NO: 171323 - DNA, 371 bp, Homo sapiens
tgctcaaaacagcatacaataaatgttacctcctttcatttttcttaagttaatgtttttatgcccaatcctgttttatcagcttaaaacccaaatgttacgtaaatataacatatagtatgactatcattttaatcagtgattcagaatctggctttgaaaacaaaaatctcccaaatactttacttatactgtatgcatttgacatcttatgaaatgtacatacctctatgtcatttcgaatatgaagtacctgtgtttttattttaataaaggttcaatgagaattgatttgtacttttattagcagattatagacatttgaaaaatggtaaaaacaaactaagactagaacactttacttcattagc

SEQ ID NO: 171324 - DNA, 393 bp, Homo sapiens
aaaatcatccacaatcccagcactttatcctttccccagacatctacacacactctcttatttttaaaaattgaggttctacatcatggtttgatcatctgcctttaaacccatttttgctggccgggtgcagtggcacacacctgtcatccagcactttaggaggccaaggtgggaggatcgcttgggcccaggagtttgagaccagcctgggcaacatggcaaaaccccatctctacaggaataaaaattagctgggtgtggtggcatgtggctgtagtctcagctactcaggaggctgaggagggaggatcgcttgagcccaggaggttgaggctgcagtgagctgtgatcacgccattgcactccagcctgggtaacagaccctatctc

SEQ ID NO: 171325 - DNA, 527 bp, Homo sapiens
atattgaggcgtttagcatttccaatgaagagtaaatccgctgtggttgggtggatgagcgtggtcacagtggtgaaactaaatgcttggatttctgtgatcagatggggtcatctccactcatcacttcctgaagtcactgcccatttcgtcttgcaatctgtgactctcacctttagacccagctttggaagcctaactgcagagacattaatgcatgtaaatgtgcaaaatatgtaattttgccccacaggcagctttggtgttctcatgttatagttcttaatctaaattgtaggtgctaaacaaaactacctgccttaatggtaggcagaggtatttgaaaaattaatgatctacttgtttgctgaatgtccacaatacaagctttgatttaaaaaaatcatgttaggatagcatgtttattacatactatttattatcatacttaatatttcttgcctatcaaaagtaaaaacctgatgctttatgttaaatgtttcttgcccattggagcctgttcatgg

SEQ ID NO: 171326 - DNA, 381 bp, Homo sapiens
gtgtgatttcactcttgactctcatttgtaatggttgttctgcctttattaattccacatagcacagaacaagtctggagaagtacatataagattgcaaaatgtggttatctggcatgggataagaattaggttaaagttggggaatgttcctttaacttctcactttgtatgttttttcaaaatggtgaacttcctagtgaattttaacactttcatttttcaactttaacatgtatttgcaaattaataagtatatataacctagcaattacatcccagttacataatcatgtttactaaaaggcatacattagaatgttcctagcatcacctcttgtaatagcttcaaacggaaatattgaagttctacaaaagaag

SEQ ID NO: 171327 - DNA, 747 bp, Homo sapiens
aggaatctaggaggaagtctctatcccctttggggtaaaggcacagagaatttcaggcagtaatttcccccttcttggagtcagtcccaggttagactcagactcattgagctactgctatgtagacatcccatcgcaggccaggctgggatggggcacttctgggcagcaggatgtcatggctgattcagcttatctggaagcccagtgatcaggtgtaacagaggcagtccccgaaacttagaggggttgtgatggggcccacagcaggcaagcctacctagaaactcaagatcctgccctacgagtgagagcaagccctgcgggagggccaggcgatgaaagcctgcagaggtgaggcccgcaggtgcctggtgggactcaggctgtgttttagaaatgcacctggaaatgattatgtgcatctggcaggcaaaggggccatagagaaagcacgggcattcattagcggagctaaagagggggaaggtggactttcctctcaagcctgggaatgtggagggctgcctttctgggtggggactgtggggatgcacagaggatgtgtgtgtctatttccaatggatacatgtttgaaaggcacacaggaggccaagcgcagtggctcacacctgtaatcccagtactttgggaggccgaggcaagaggatcacaaggtcaggagatcgagaccatcctggctaacatgatgaaaccccgtctctactaaaaatacaaacaattagc

SEQ ID NO: 171328 - DNA, 357 bp, Homo sapiens
acctaaattgtagtgtacatactaacactagaatcattaactaattttagacaatttaacttccaacactattgtatataagtggcatgaatttacttgatgggcatcatgaccctgtgttgattttctttctacaagtctgcatgcaaatgatgtattttgtgatgttagcagattaatttccaaacacaaaatgaagcatgctttaacagttgtaacagcattattctaatgtctgaaaagaggcattgtttctgtgaaaatacatttacaaactttatattgtaaaacacctgttgaagatagcatcaacatttcctatgctcatttctacctttaaatttggaccaattcttt

SEQ ID NO: 171329 - DNA, 393 bp, Homo sapiens
agtccttccttcttcccttcctcttcccctttcacttccccttccccttccccttcccctttccctttcccttccttccttcctgccttccttcctttgtatttgcttataactatatgctggatgcaatgttaagtgccgtgggtactgtaaggaataagatagcatccttgttctctaggaagtcacaatacagacgatgaaatgcttaagaaaactcataattcagagcaagagaggccagagcctgaaataaagatgtgttattgtttgcacatatctttacaaaggtatgtataagatgccatgggaacacaaagaagcaaagagcaaagtgagcctattggagatcaaggaagatcatgtaggcttggttgaatagatgagcagggg

SEQ ID NO: 171330 - DNA, 192 bp, Homo sapiens
agagtgactggtttgtttcaacacgtaaaactggcatcaacctgtctgtgggtttcaatgctgttgcattgcagggactgaaaaagtgactgtgtaaggagaaggggttaccctacttttttcaacagggtaactaaattcagtttattgttctaaaacagaggggtgtgtgtgtacgtgcgtgcacgtgcg

SEQ ID NO: 171331 - DNA, 357 bp, Homo sapiens
ccagctagggcgacggagcaagactcagtctcaaaaaataaaaaaacaaaaaattctggtaagtgaaatagaagatactgttatgtaaaagtagagggctggaggaaggtcagcagagaggaggagaaatgatggaaattgcttgttatgttagacagggtgacacggaaactttctctcaggaggtcatacctaaattgagaagtgaggatcataagaagtcagctgtgtgaaagatcatgagaaaagctgatcaggcagagggaacaaaagtatcaagatcctgttgcaaaaaatagtttgtcatttttgagaaattaaaatgagaccatggtaatgagtttgagatttattcta

SEQ ID NO: 171332 - DNA, 881 bp, Homo sapiens
aagctggactgtcagatggggtcagtgcttggcactccctgactgccaagctcaggagttggtcctccacctggggagagattcggtcagactttcaggtttgggagatcttcaggaccatctggagggggatgggggtctccatagtcccattctctgggccccaagccttggattgggctggagacaaggcaggagaggaagccacaccagtgtgtttagagaatggcaggatttatgagaaaagaaatggggttccatttgcctgtgtcccagcctgagagcaggaaacccaagactattcagtcacaccaagatggtgcatgctgcagggtccaccccttgctgtcctgctgacctgggcagtgaggagagctgcacttctgaggctgcaggtgcaaagcaggcacccacctttgcccctagtactgcaggctgctgccaggtaggtcccagcagttgtcattaaactccaggaaggcaatttttgagctggatctgatgcctggggtggcctggtgggtggccagccctggaggagaggaggcaccccaggcaggggaagtgtaggctgtaactggaggtctattggataagtagttgtgaccagggtagggcatttggagccttgtgaattctcatgacaggtgccccagccactcttcaccaaaagaagccaagttgttttgagacaggctctcactctgtcacccaggctggagtacagtggcaccttcagggctcactgcagcctccatctcccaggctcaggtgatcctccctcctcagccacccgggtacctgggaccacaggtgcatgccaccacacctggctaatgttttgtattttttgtagaggtcgggttttgccatgttgccaa

SEQ ID NO: 171333 - DNA, 272 bp, Homo sapiens
gagatgaaagcagaaagacttcagtgtacatttattgagtctgacatttttctctcacctgatagagacacctgcctgggctgagtgaggtgggcagtggcctgagagtgggaagggaagagacttgggagggaggtggtgctgttgctgttccttgcttccaattttcccctaggccacagggctctggccaagacagcagctttaaccctggttttaagggctggatggggagcttgggtgggagaggacagtgggagaagtgggaattg

SEQ ID NO: 171334 - DNA, 669 bp, Homo sapiens
aaaatctatcagtgtaatctgtaacattgaacaaattaaaggagaaaaaccatatggtcatcccaatagatacattaaaagcattcaataaaattgaacaataattataagaaaaactcttggcacattaggaataggaggacaatttcttaatatgataaaaagcatttacaaaaaataagaaaaaaattttaagaatagcaagcatgccactttaaagtatgaaagaaaaggttgcctgttgtcatgcaaacttgtcaacattatactagaagttctacccaatgcagtaataaaaagagaaagaagagaaataaaaagattgactagcaagacagaactgttattatttgcgcatgttactattacctatatagagttaatagaaaatgtctgcaaatatgctggactaaaaatcagtttataaaataataactcccctatcaataatcaattgataaaaagaaaaagcttaccagtaataataacaaaaactatagaataacaaggataaacataacaggcacttataaacaatttatctgaagaaaactataaaactttgctgagagacatttaaacaaatagactggtaagactaacacaataaaacgcaaatttcttccacattagtctgtaaatagaatcctaggttttcaggtgttttat

SEQ ID NO: 171335 - DNA, 722 bp, Homo sapiens
tgaaagaatggctactccatactctatagactactccctcagggctgctggttggccatttttatggttgtttcttgataatatgctaaacaagggaggattattcatgagtttacagagataggggtgggtagttcctggaactgagggttcatcccctttttagaccaatatggggtaacttcctaatgatgccatggcatctgtaaactgtcatggcgctggtgggagtgtcttttagcatgctaatgcattgtaactagcatgtaatgagcagtgaggatgaccagaggtcacttttgtcaccatcttggttttggtggtatttggctgacttctttactgcaacctgttttatcagcaaggtcttcatgacctgtatcttgtgctgacttcctatctcatcctgtgactatgaatgccttaacctcctgggaatgcagtccagtagatctcagccttgtcttacccagccagtattcaagatggagtcgctttggttcgaacacctctgacaacatcattcctccttaggccttttgtttctgtttccactgaatgcaggtaagtgctatgggccagaggaacctggagaaggtgggtgtgccattgtagcagtggtggctcagttgagcctccaggcagctgcataatgcaacaaagcaagaagggagctgccaatcaccaagtgaaaatacatggacgttagtgttcagtccgga

SEQ ID NO: 171336 - DNA, 399 bp, Homo sapiens
atgggtgatttcactttgtaaaagtttattgtgctctgtacttacaatttatgcactttgcacttttctgtttatatattttctttcacttaaacatattgccaagaaaatcaaggctgtattagaggatgctatctagtttggaatggctttcttgcttagaaaaacttcctgctttgcagctctgcactggtgactgacagttgtgacattcagcagttctattacaatctactgaccaaatagagctttgagcaaacagatttcacaaaaggcagtgggtggccattgagttgtttgttttctgcttgtatctgcttagggtggtattagcagcagtaataggtatatcttctgatgttgattctggaatttgttatttgttgacttattctcatc

SEQ ID NO: 171337 - DNA, 556 bp, Homo sapiens
caggccttagagggtttcacttaatctggaatcaattgaaacactgtaactaaaaggttcatcacaatatttagtctttatagacccaatttccaaaatatcaaagttgaagggaagtagagtcatttttcatcatatttgcaaaaaaattctcccacaggctttggacctgcatctggagggaaaaataagagattaatggggaaaaaaatcatattatatcttaccttatccactgccccctgccttcaaatctttccccatcataaggtttcttcagtcatgcacaaatacttcagagactgctacctcagacactgccgtcagcgcccagaggattgagatttagtctttgcatcttaattacagctgactctttttcccttgttctgagctgagttatagcaaggaaagggggagatgaatgaatgacccatgcatctgacatctaatatctgctacttcagatttggggtttgatttagtgtctctatcagagagtttgaggaaacaaagtcttttatcttctttaaataaattcatgcactgaagcaca

SEQ ID NO: 171338 - DNA, 775 bp, Homo sapiens
tggggtggaggcctgggccctgtaaggagaggaatgttggttactcccattttagggggagaagactgaggcccaggcaacatcctgtaggtagctgggggcagaggcagcactcacatttaggaccattctcgaaggttcatgctgccatgccctgcctggggccttggttggggaagtggtaactgagctggggcctggttgtgcagggtgggccacgtgcctgccttccccgcctgctgggcctccctcttgtccaccatccgcctctgcctggctgactgtccattctgtctttgctgacccctccttctgctccgtgccttctgcttctgtgtccccagtgcccaacacagagcccagcatagaatgggcacaagcaaagttttgctgagctgtggggaaccctggggaagagtgactcgcgcaggccgttgcagggcagggatacgcctaggccaggagggaggagggaggaggggcagtggggtcagaggccagcctcgccagctctaggtgagccactctctggttcctcctgctaggcccatttgtcaatcttgctgaaaaaatgtgtgtgtaggggcaggagcaaggagagagagagatagaaaacaagagaaagggggagagaggaaaaggaaagacaaaaactcccaacatcaaaaacccaagaaaacacattggcaggttccactttcaatcctaagaaaggaaagccagccccctggtggccactgagtctccaccacctggatgcaggtcgacccagtgg

SEQ ID NO: 171339 - DNA, 445 bp, Homo sapiens
actggtcacactggggctgcctcaggcagtggggggtggaggagaaaccacacaaggccagaggcatctctgggaactcctgagcataccttagaaccagcagcctcctcccggcacggggagcattgcggatcctcacgtggagctcggttgagttcagcgccaggctgtctggcggtgactcgggcacgggacagatcctgacttgctggagcattcagaggtgttcattatggaatccctgtgggtttcctgtctctgtccttccggcttcagttctccatctccccagggaatcctccccatgtaacatcaggctgtgactcagcccccagcatctttctccctttctcttacacgctgggccggataatctttatactgagccttctgtgcgctccccttttgaaagccccaaatcctgcttaatctcagcagaaagcct

SEQ ID NO: 171340 - DNA, 386 bp, Homo sapiens
ggaagtgccaccctattttaagcaatcagatcttatgagaactcagagtgagaactcactcgttatcaagggggcagtgccgagctgttcatgagggatctgcccccaagatctaatacctttcactacctaatctaatacctttcacctcgtctaacattggagatcacatttcaacatgagatttggaggggacaagatccagaccatatcaggtggggtcagaggtcctgctaaaactgtgactatcagggatgttattcagatattagtgttctgtacttaatgggtgctgggtgggctgcctgtgtaaaaaacaaaaaaaaagatattgacacacatacacatacacacacacacacacacacacacacacacacacacac

SEQ ID NO: 171341 - DNA, 343 bp, Homo sapiens
caagtttcaatttggtttctgctttcaaaatcttgtcatacaatgacattgtacagacgtttaaaagagttttatttcttaggagagtggcccctttcctaatagctctgtactttaaaatagaattcccatttagatgaatcacattttaaaaagtagctactgtgagtgttttacgcttgtggaaacatatagcatcctcataagcagcatgagagcctgtcaccatacagcttttgatgtctgattaaatgatcgtagggacatctggagggagttagttttgaagtaactggtgtgaagcactggagaatccgaagccttctgacagactaaaaccatt

SEQ ID NO: 171342 - DNA, 491 bp, Homo sapiens
gtaagctgccctgacaggacagttgaaacacaattgtctaaagggttaaaatgtctgtccatttttcaaatgcgatggccactctgaatcaaatctgattgggatggagaatccaaatgtgtaaaacaaaagtcacaaaagacaaacagagcacagtatttcagtgggggaaaaaaaataagctaaatttagtcacttaagtcccagctcttcttgggatatatatatgatttttacgagaactaatcctatccggaaacatttccttcacctttcccttagcccttttccttcggtcatgcagtctcttaccgtgctaattatcatattaatataatcctcacttgcgatccttcctgactttattccccatgctcagattctcctgaaagcataacgctttcctaagtatacacacaatccatttaaaagtctttgtatgcgacagcctaactattcaaacacgaagtcatttctctaacggtcctaga

SEQ ID NO: 171343 - DNA, 1273 bp, Homo sapiens
cctgatgagcggtgcttccctcagatgatatgtgggcaccctgaagctctcacgtaatggttctgctgtgccgggttgtgacccagctgtccttggtaggctctcctgtttaatgagcaactgctatatgccaggccctgttctagaaacagatgaggcccctgttcccatggaacttagatctgagtatgtggacagagtgagtaggttgccagataatgtcagaggtaagaaaaaagccaggcagaggacagcagtgctggtttagacaagggttggcaaggcctccctgataaggggacgtatttgcgcagacacggaagcagtctgatggaaggcttgccctgtagggacctggggtgcagactgagctgggaggactcttggcttgctccaatgaggtaggggcgaagagagggcagaatggcccccgtgctggtccagatgtggccagtgccagatcgtatagagccgtggaggcacggtaaggacttggggtttgagggagatgagggccctgagcaggggtgccatgatctagcctctgctccagaaggatctgtctggctgccatgtgggggacatggagtggagcaaagacaggagcccagtgagagtcgagggagaggtgacctcagcttgggctgcggtgcaggccatgggactggcaggaggtggctggggttacgctgtcttttctaacattcagcattggctcaggggccaggtcagggctcacagactgttgctataaagggctgggtggctttcttccccacagctactcagcctaatgccattgcagagcacatgtagccatggacaacacaaggggcgtatccgtgttccaggacagccatattgacaggaataggcaggaggccagatttggtcctcaggctgtaatttcttggccccttgtctagggagaggtaaacgaggggaggagagatcagtcaaggatgacgtgagggtttgctgggagcaccaggaatcctggagaaggtagtggcaagagggtgcagcaagctcagctgggctgggatcaagtctgaggacttaatgtctcctctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaag

SEQ ID NO: 171344 - DNA, 792 bp, Homo sapiens
gactatggcaggtcgtgcgggtgttaattggccgagggagcactgggtgccatgatctagcctctgctccagaaggatctgtctggctgccatgtgggggacatggagtggagcaaagacaggagcccagtgagagtcgagggagaggtgacctcagcttgggctgcggtgcaggccatgggactggcaggaggtggctggggttacgctgtcttttctaacattcagcattggctcaggggccaggtcagggctcacagactgttgctataaagggctgggtggctttcttccccacagctactcagcctaatgccattgcagagcacatgtagccatggacaacacaaggggcgtatccgtgttccaggacagccatattgacaggaataggcaggaggccagatttggtcctcaggctgtaatttcttggccccttgtctagggagaggtaaacgaggggaggagagatcagtcaaggatgacgtgagggtttgctgggagcaccaggaatcctggagaaggtagtggcaagagggtgcagcaagctcagctgggctgggatcaagtctgaggacttaatgtctcctctgatctccagacccataagggagatgctgagtagacaactggggcttatgggtctggagttcagaggagagatcgggaaggtgtccatttggagtcatccacgcagagatgtgtgaaggctgctcaatgattttgaggtttaaagaaaaaaagagatgtgaaaccaggggccctgatgaggctgcccaggtggtaaggaag

SEQ ID NO: 171345 - DNA, 511 bp, Homo sapiens
ggaacgtggaaagtctagactgactaagcctggcctccatctgtctctggtgctggatgtttccttccctcgaacatcagactccaagttcttcagcttttggactcgggcttaacaccagtgatttgccactgaaggctgcactatcagcttgtctacttttgaggttttgggactcaggttggctccctggctcctcagcttgcagatgggctattgtgggactttaccttgtgatcatgtgatggtatagatggccttcgggaggtgatagatcatgacatggagccctcatgaatgggattcatgctctttcgaaagaggccccacgactgccttaccccttccaccatttgaggacacagctaggagataccgtctatataccagaaatacacaagagaagagacctcattgaaacctcaacagacaccaaatctgctgtcaccttgatcttggactccccagcgtccacaactgcaagaaataaacttctgttgtttataaatta

SEQ ID NO: 171346 - DNA, 627 bp, Homo sapiens
ggaacgtggaaagtctagactgactaagcctggcctccatctgtctctggtgctggatgtttccttccctcgaacatcagactccaagttcttcagcttttggactcgggcttaacaccagtgatttgccactgaaggctgcactatcagcttgtctacttttgaggttttgggactcaggttggctccctggctcctcagcttgcagatgggctattgtgggactttaccttgtgatcatgtgatggtatagatggccttcgggaggtgatagatcatgacatggagccctcatgaatgggattcatgctctttcgaaagaggccccacgactgccttaccccttccaccatttgaggacacagctaggagataccgtctatataccagaaatacacaagagaagagacctcattgaaacctcaacagacaccaaatctgctgtcaccttgatcttggactccccagcgtccacaactgcaagaaataaacttctgttgtttataaattaaacaaacaagaagaaaagaaaagagagcaccagcacaaagaaaacaacggagaagagaagagaaagcgcggccgcgcggggggcccacggagggggggcggggccgaaggggggcc

SEQ ID NO: 171347 - DNA, 829 bp, Homo sapiens
aatgatgttatttgctggagtaattgatggagttgcatgtcttataacctctggaataacggctgacaatctctcaagtctgcgccttagctggactcaggttcctcttctccccacagcctgactgcctccattagcttcacaaaagtggttgggtttcagggcaaggcccattgtcatttaaactgtagccgaaatgacttccaaagttagcttggcccaatagcccaggaatatttaagtggaaggcaagatgggggatgggttagcttagctctctttcactctcatagttttctcactggtataatttttgcaaaggcggtttcatgcctgccatctctttcgtcgctacctctcccagttcccattcttagctgttttatgaaatgcttctagtttcatcctcttataccaagttctgggagactgatttgagtaataataaaactccagtttcccatacagccggctctgcgtgaattaaactcattttctattgcaatttccctgtcttgataatcagttctgtgtaggccgtgaggaaggagaacccgttgggtgattacgagactgtgttactgcccactacctaatggatacatttagcctggtatccaaacccatctaattatgaccataactatatttatcaccttgctctgctttcaaacgatatgacacacaatgaatgaaaactttcatttttcatcttcatttgtgctgttccctttgcctcaaatagccctcaacttgcctacagtaactgtaaaatttgccacctaaaaaaaaatctcaaaatcctctctatgctttgatgtccagcaaa

SEQ ID NO: 171348 - DNA, 511 bp, Homo sapiens
tggcacagtgccccatacacagaagacatttatggacggtagtggctattacattccctggcacttgggagacactcattgaatgtttatagggtggatgcagaagcctaccataaaaggcttcattgagtagataggccttaaaggataggtgagatctgggcagacattgataagggaggaaggcaagcagccactccctatgggaggaacagggtgggcagaagaagagaatcagaggcttgcccagtgctgccctgctcgggcaagtgaaggaatcagtctggaacaaactgggggaagggctgtaggaagggcagaaagggtagaaaggggagtcaggatgagcatgtatggggacttctgagtctgcctcgccagatggctgttttgccaggccagcttgctctgcctgatacttgcccttggttccctctttttttttcccctccttttctttctttctttatttttccttttgagatggggtcttgctctgttgcccagactg

SEQ ID NO: 171349 - DNA, 166 bp, Homo sapiens
caaccaattgcccaatatcccaaaggtgacaaatatatatataattatctggtctgcaataggacatgaaacctgataatacatgagtaagcaaaacaagtcatttagaagatgaatcttaggctacagattatcttccacaacaatgtaaaaattgtaaagtttt

SEQ ID NO: 171350 - DNA, 587 bp, Homo sapiens
cggtcgggtctctggctctccaggtggcccttttaggtaaagtccacttaaacgtgactccagacatttatttccaagtctggtggactagaaaccctaaatgacccagccccaatttcagaaaaggaaaataaatgaaactggataaatatgaaacaaaagaaaataacattttagtgaatcaacatgccagcaataaagtgaggcatctatcttactctgaaacttggaagcaggagtttccagtttcaaagtaagatactgagcctgggaactacggaaagtaaggaagatccaaagcagcctccacccaaaactaagtactgaactctgatgacctttcgtttccatttgagagctacaggggcatgagaaacagaaaattaagcccacccaaggtggagagactgccccaccaagtgaagcctagaacatctatagccttagtataagggtaagtaggaaacagactagcaaagaaggggaaagaaagaacatgcctatcttgagaagtcttaactacaatccccactcatatgggttttcagccaatacacactatgtctgtgttttgaaaaaacagacaa

SEQ ID NO: 171351 - DNA, 560 bp, Homo sapiens
tgagacggagtcttgctcttgtcgcccaggctggagtgtgatggcgcgatcttggctcactgcaacctccgcctcccaggttcaagcaattctcctgcctaagcctcccgagtagctgtgattacaggtgcgggccaccacgcccagctaatttgtatttttagtagagacaggtttcgccatgttagccaggctggtctcgaactcctgacgtcaagtgatccagccgcctcggcctcccaaagtgctgatattacaggagtgagccaccatgcccagccatgaatctacatttgatgaaaacatttctttataatattctcaacataaaattatgaatattagttatcaagaatataatctataataaaagtgtgataatttaatcacagaatactactttgtattttctatcgccatttttttaaagagtggagaaacaggagaggagggtaggagtgtcagaatgacctgagcaaagaaccgttaccctccaggcaaagaatctgtcagttccttttcttttccactacatgactctagcctaagcaacctcctgg

SEQ ID NO: 171352 - DNA, 361 bp, Homo sapiens
cagcccccgttcccgccctcactctccagcagccccttcttgctctcctggcctttcttgtccccatccataaacctaaagcctctctgcctgactgccaccggcactcacacccctgctgtcatggagcccaaatgacccgatggctgtggagtgggtgccagggcagctgtgcctggattcacgcctcaaaggacagacacctggagggattcagcagaggggctgcttggggcagtcttcatctgggggttgtggaaggggcacccatggggaggacgtggctcccaatggggggtggcctggacaggggtgcagttgggaccactggtctcacccgctccctctcccccactccaga

SEQ ID NO: 171353 - DNA, 247 bp, Homo sapiens
ttgggcccctctttcctgatactccttaaaggttgttgcttccaggcttatacccagggtttggggcctcctgcctccctgaattctaaggagtagccacatgttccctctggaccagccctggtcaggcctggggagaagggcctgtcttttcttcgagcttccctcaccttcaggtgaccccagtgtagcagacataagaggcgttcattcagcaaatactaattaagcactggcctctcccggc

SEQ ID NO: 171354 - DNA, 446 bp, Homo sapiens
aggggctgcaggcaaccgtctctcttgtgggactctgcagagagccgtgggttctggctctgactcttgatgtgtgacctcaggcgctgtgtgcccctctctgcgcctccagttcactgttcaaacaatgagaggaatgccccgactgtggtctgaggccacccccatcagcacctggggtgctttgtaaactcctagttcctgggcacacgttggatcctcccagtcagagcttctgcatgtaggatctagagagctgcatttttaacaagcaccctgggtaaatgttaggaccacaaaagtttgagaatcactagtccactagaatatgtggctctaagcacagatctgattctgactgtgtgactctgtctgctagagggcagagttgatcccgcatcccagctccattcaggtggtcaccacatgctcactgtcctgctaag

SEQ ID NO: 171355 - DNA, 291 bp, Homo sapiens
cttctccagagcagaggttgtcagtgatgagcagaacaaagatttgagaagcactttccctgcatctggttcagactctgctcatcaataatttcatccagaattaagcaaagtatttgttactgcacacacagatcataagtgctctgctgcactgtacatctgaaatgcaacaaccactggtttgctctgtctctctctcaacttgatctctatcattaacttcacacctgatttatcatcttcttggggaaaacgcatttataataacttttgctattcctggaatat

SEQ ID NO: 171356 - DNA, 201 bp, Homo sapiens
tcagctggacaaggcggggtcagctggacaaggatgggtcagctggacaaggcgggggtctaggtgctgatgagggcagtccagtgcgctcttgttctgggacaggctccagtccccttgctccagcaggtctggggcaaggaggtcagaggtggtgggagggcccctgctctctgtttccacttcgtctggatccttgct

SEQ ID NO: 171357 - DNA, 464 bp, Homo sapiens
gtttctaggcagtatgaaaatgaaggaaactttgctagtgcaagaagttggtaggccgggcgcagtggcttatgcctgtaatcccagcactttgggaggctgaggcgggtagatcacttgaggtcaggagttcaagaccagcctggccaacatggtgaaaccccatctctactaaaaatacaaaaattagccggatatggtggcatgtgcctgtaatcccagctacttgggaggctgaggcaggagaattgcttgaacccaggaggcagaggttgcagtgacctgagatcgtgccattgcactccaccctgggtgacagagccagaatccgtctcaaaaaaaaaaaaaaaaaagaataagttggtgaaacaattggctgggataaccttgttcctatgtgtgaatatgtttttagcctcattgtattttttgctgtcccttaaagtgctgtgagataattttag

SEQ ID NO: 171358 - DNA, 1063 bp, Homo sapiens
tgaagaggaatggtaggggtagtcctggtcccttccacctctgacatatgtagtcttctgcaggtcaggctgtttgtgtgtgtgtgtgtgtgtgtgtgtgtgtgtgtgtgtgtgtctgtcagagattcactcttgttgtttgtttgagacggagtctctctgtgtcgcccaggctggagtgcagtggcgtgatcttgactcactgcaacctccactcctgggttcaggcgattctcctgcctcagcctccctagtaactgggatgacaggcatgcgccaccactcctggctaatttttgtatttttagtagagacgaggtttcaccatgttacccaggctaatctcgaacttctgacaccaggtgatccgcccgccttggcctcctaaagtgctgggattacaggcgtgagccactgcgcctggccaagtcaggctggttattgatctgctcccctaaaagaccatggcatgagttctgtgggcagagagggggcagggagttgccagtgcagtccccacaagcagctcagtaggcccctgtggtggccctggagggcagctggcagaagtcagaaaggcaaatgagcccccgtgacactgctgtgtccacagaattctccactttgagaatagggcccaggagaggggaactgaaaagaaaggcaacattctcttgggagaggaaggagggacagctctggaggagacaggccaccctggagcccagcccaccagcactgttgcggtgggaggcttgggccctctggccaggctcctgtgtgcttggagccaccccgtgtgcaggggagacctctctgggaggtcagctgaggcctcgtagttggactgttgatgatccccgtcgtcttctctgcccccatcctcttcttggctcaccctgtctcctgtctggtagagaagattctccaatctgtcaagggttcaggcctgctgtgtggctgagggtgctgagagctgccctttctggcagaatgtttggccctcctaggttaatatttggggctgggagcgttggggagcttggcctgggcagtgagtcaa

SEQ ID NO: 171359 - DNA, 492 bp, Homo sapiens
  misc_feature (68)..(68): n is a, c, g, or t
  misc_feature (101)..(101): n is a, c, g, or t
ccattatcatggatatctatcacctcaaacatttactttgtgatacaaaaatccatttatactcttanttatttaaaaatatacaatttttaattattttngacggtagtcaccctgttgtgctagcaattactagtttttattcattccaactatatatttgtacctgctaaccatcagtacttccaccccaaccacccactacccttcccagcctgtggtaaccatccttctactctgtatgggggatctcagatcccccatacagagtagggagtcaggaaggacataggatttccccattgatgtatctttgtgtcaagagctgaaaaatgtaggagggtactgccttactcttctgagctaatcaaaagcagcagcaagtacacagtgaaataagatttagttgttaagtggcagagaagagtgttacagtttgaaagtttatgttgtatactagacattatgtctaagtactctgttgggggatct

SEQ ID NO: 171360 - DNA, 424 bp, Homo sapiens
atcaaacttcaagcttctgccccaggacctttgtgcttactgctctccaatctggaatgcacttcacttggtccttttttgtctcccattttaaagatggtatctccctatgttgccccatctggagtgcagtggttgttcacaggcacgatcgcagtgcactgcagcctcgaactccccagctcaagcaatcctcccatctcagctccctgagtagctgggagtacaggcacatgacaccatacctggtttccagttctctcaccacattcaagaatctactcagatgtgaccaccttatagctgttttcaccacctaatttaaaatagcacagcacctccacaaacctctattccccctccctgagcgctccattcctttacccattcatacctcacgcatcactcatcactacctgacatc

SEQ ID NO: 171361 - DNA, 387 bp, Homo sapiens
tgtgaggtagggatccagtttcactttgtccgttatgtagacagctgagtggcttgggaccatgtgtgggaatgctcctctttcccatttgccagctctgttgtgtgtgcgtgtggacctgtttctgggctccatcttctgtccatcagtctgttggtctgctccatgccagcactcccttgtctacaggctataaatcttgacatcagatagagcttgttcccctcccctgttctccagggatgccttggctattcttgacctattggtcttctgtggagattagagaatcatcttgtgagttccctatgaaggaccctgtagataattttcttttttttttgaggcgggattttgttctttcacccaggctggagtacagtgcac

SEQ ID NO: 171362 - DNA, 657 bp, Homo sapiens
atggctcttctgtgcttgtgtgctgagcccgagtgctcggagcagacctcagaataccagggtacagaggaacttgggtcacagtcctggagcccagcctcgctgggtcctgggagaccacattttctctggacccttcatacagaagcctgggccgggtgtggggggtgccagctgcctggtgttgttctccaggttcctcttgttgttggccaccagcctctcgctgcctgtgttgcagctcttctcctgtggtcttctgtttacatcattggaggcagctctgggtgcccagcttgttggaaggggggccccatagcgatgtgtcattgactaaaaggcacgttctttctgtgtcgagttggtgtagaaaccgtggagctggtatgagacaggaaggatgttgacatttctcttcagtgaaccctgctcagcctcttgatttccacctctgtcgggaatgttgctgatggggtttctgatgcatgtttaccatgcacgggtgtctcccattagtcaagagctacatgtttgtctctccgtgtagagagccagatggcatgtttgcatataaattatttaagagaagaagtctagtcgaatgacagactgaagtagagttgttagtgtccttctatgtgtggcctggctcgattg

SEQ ID NO: 171363 - DNA, 521 bp, Homo sapiens
tgtaccacaccaccctgtgtggcatatggtgagcaacctaacctctctgtgcctcaacttccttatctataatgtgaaaatgacaataacaataggtactttagaggtttgttggggaaaatacatccatttatgcagataaagcacttgcaacgaagccagacacatgtgtaaacatgcaataaatagttattgttagccatcgactcactttattgaccaaacttggcccccaaatatttgctaactctgagaccccagctcgctatctgcagagccacatgggcgtcccatttgccagtggcatctgaggacatccttagaagaacagctcctaagggtttccagggatggcagcattatcggaattcctgctgtaaactcacgtgaacatatgctcttctattaatagttcatttttaaacaacaacaaaacaagcctcggattcttgaagatgccttggtaagttgatcttatgtccctgcatgatgaattgttctgaatgtattccgtgaagatc

SEQ ID NO: 171364 - DNA, 136 bp, Homo sapiens
tgagcgaatggtgtttgctgtttcctgcaaaagtcccaggggttgttgggtacacaggtcctgtctttggccacaagcaacctgaaatgaggcttggtcttcttcccgggaccccgggctgtgcctcacttggggg

SEQ ID NO: 171365 - DNA, 156 bp, Homo sapiens
tgctgggattggaggtgtgagccaccgcgctccaccctgatggacatttattacatgcaaactgacgactatctgcagggagtgggtgtgtttggaattaggcctggggagaagcggttccaggattccatatatggggaatttaaggtgtggaga

SEQ ID NO: 171366 - DNA, 212 bp, Homo sapiens
tctactaactcagctcaagcaatctaggcccttcacaaatataacaatgacataatctcttgcaattaatttatggaccctatagattgtttagaaaccattcattttgttgaccaaatacagtgttcgcttattagtttatatggcatcaaagacacattcacattaaattagcattttaatacataagttacttttaatggtgtgataaa

SEQ ID NO: 171367 - DNA, 319 bp, Homo sapiens
tgatcagttttactttagaaaaatgaaataatactgtgcataatcttttataacttgtttggcactgaagtacttttgtaggtatttttgtgaacatcataattatgcagcatagtatttagtatgtatatccaattctattgtaattaatagtgtaatttttaataaattccttttgggcgtttgaatgttttgattttttttagtataaaatctaattggtgaacattgttaaactaacatctttgtactttagacaattatttatttgggttaaagtcctagacatgtagttgttaagcaatattaaaattgaaca

SEQ ID NO: 171368 - DNA, 572 bp, Homo sapiens
tttaaaaatcagattttacataaaaatctcagacctttggcttctcttgaatcacaggatccagcaatactaaatccacaaggaaaactggagctgcctcctttagtgtactctcaagttacctaaagtaccgttcagccaatttctctaattgatattatgctgtctgtgccctataggcacttgagttcttcagtctctacactagggtttgcaagatatggaaggggaagatgggaggatggaaaatgagtctttcctgaagaaaccttgcaagaggttaaagacgagaacagtgagtggtcccaactttcttgatcatatagccctttccagaggcaaatttaatgagaaagaactgcctacaatagccaagggctggtaagtacctatcttccagagggtaaaaggatacagtaccaaaacattcctattaaaagaaaaaagggggccgggcgcggtggctcatgcctgcaatcccagcactttgggagcgcgaggcaggcgggtcgcctgatgctaggagttcgggacccagctggccaccatgatgaagcatcatctccactaga

SEQ ID NO: 171369 - DNA, 590 bp, Homo sapiens
ccagctctctgtaccactccttatgttgctctttgctcttcccttcatctttctcctctattttccttctctcaccattacagagaggtcatcctgaagtgtctgggctgcagtaggagctgccaaacattcacgaaccaccacgttcacattagatgcagagataaaactgcacaaagtctcaatacactattttgcatcactcatctgggacaaagtaaaatttttcaaagtcaactcaaaagaggaaaacaaaaggtattgcaaatctgttctctgttaggcactgagttagtgctggtggataagagaccttgtgcccaaagagcttgcagtccggaggggaggcagacgaggaacacaggctcaaagtgatgcaatgtgagaagtattgggacagggctgaaaacctaccccagcacgaagggctcaggagcgcttccaggaggaagtgacccaccacctgagcttctgaaaaagactgatagtcactgtgtcttgtggaagtttgaaaaccaaagacacttctgctaggtaacatccactcagcattgtagagacccagccgtttaactttccaggtaacatca

SEQ ID NO: 171370 - DNA, 528 bp, Homo sapiens
tttaatttttgcctacctgatgggtgaaaaatgttacttgatgtttcagtctgcacttctttaattcctggggcagctgaacatcttttcatgcttatgactcaactgtattcctttttcattgttcaaggctgtgcccatgttgctgttgacttaccacagcctcttttgaatatgctttgttatttttgttgtgcaaatggtttctcctagcttgtcatctgttttttgttgttgttgttttgttaacttactttatggcattttcccctcaggcttcttaaaaaaaaagaagcttcattgagctataattgatatacaacatctgcacataaagtgtaaagtttgattaaacatttgtatatacctgtgaaatcaaatcaccacctcatcacaatcaaatttcaaaaagtttcacctagtttatcatattgttgaatgtgaatcctttccttatggccagtggattttatgtcttgttgaaacgactttgtcctgctacagtgataaaaatggtcttcacgcttg

SEQ ID NO: 171371 - DNA, 417 bp, Homo sapiens
gcttctgccatacctgagatggcaagaccaacccctccttcctcagcgtactcaacgtgaagacgatgaagaccttcatgatgatccacttccacttaataaacagtaaatatattttctcttccttatgattttcttaacattttcttttctttagcttactttattgtaagaatacggtatgtataatacatgtaactatagaatatgtattactcgattgtttatgttatcaggaaggcttctggtaaacagtagactattagtaacgtttttggagtcaaaaattaaaattatgcaaatttttgactgtgcaggggagtgggggtcagcacccctaaccctggcattgtcataggtcaactgtaaacctaatgttatgagtctcctttaacaggaaacataatgatagtgaag

SEQ ID NO: 171372 - DNA, 312 bp, Homo sapiens
ataaaattagaatgagtagagggagaccgacaaactttcaactgttttcaatgacaacacttatttctatgcccttgatttttttcatttattcattccagaaatatctgttactatcatataccaactacagttggcctcctagtcagaacagaaataacaagggataaactattgctcatgtataaaaatctcatgtccataattttagcggactctaaaacttgaagtaaaatacacatgcatgaagttttagcaaataaagattagtcctttaaactagaatgtatttaaagtaagttctattccttg

SEQ ID NO: 171373 - DNA, 275 bp, Homo sapiens
gggaggatgacatataagacaggagttctcagactccaccatgcatggggaacaccggtggagctttcacaatgcctgttgctcgggccacaccccataccaactaaatcggattatctgaggtgggtccacgcatcagtcatgctaaagctctgcagtgagtccaatgtacaaacgaaattgagagtcagcagatgacagtcttgctactcaaagtgtggttcacagaccagcaccattggcatcatctggaaactgttagaaatgcacacttg

SEQ ID NO: 171374 - DNA, 393 bp, Homo sapiens
tccccaaaggatcctattcctgatctctaaatatgcccctcaccagtgcagagggaggagcagtcagagcctgggagacttgcctacctggagctgcacccatctttgaggccttgctctgtttcctggaacctgaaatggatttacctattctacacatttcatagaaatgaaatcacataatgtgtcacattttgtctggcttctctcacttggcataatatttttgggttcattcatgtcatagtatgtacttcatttcttcttatggctaaataacattttatgtatataccacatttcctttatccattcatctgttgatgggcattttggttgtttccaccttttggctgttgtgaataatgctgctatgaacatttatgtacaagc

SEQ ID NO: 171375 - DNA, 360 bp, Homo sapiens
caatatctgtcaacaattttatgtaggttgaacatctcaaatccaaaactggaaatgctccagtgagcatttcctgtgagcattgcatcagcactcaaaaagtttatgattttagagcgttttagattacagatttttggatttggaatgctcaacctgtatgtgaaagaaaggaaaaggaaaactggacaacataagatgaactggaatctatacagtaggattaaatgaacattatagaactgcagaaatacagtatctgaaatcaaaaactcattggagaccagacacagaaaaagatgggattcatgaactcaagtacagtacaaatgaaaatacccaatttgaagtggcatagat

SEQ ID NO: 171376 - DNA, 546 bp, Homo sapiens
catgcagccttttatatgcctcatcacattatggccagtgattctttatccctcctatcatatacctcctcagaatccccttactgctggcttcatagttcattccttttcctgcaggctcatttggataggctagctgctgagtcgatcagcatcttatagcatggaggcagaattgcagaaggcctatcaggcattaaacagttttgctttctcactggcaaaaatagtcaacactgtgcctctcctcatgcaactttaacatgtacttgacttttaagtatgccatttaggaagctttctttttactatgaatcttatctacttggaattatacttaatttttccaggactgcagatgaataaagagagcttaagaagctactttgctaatgtaatccataactttgctacctgagttaacaaacgttcataacactattacatttattctttctgaaagggatatttctgacattttcaaagtctggaaaacatttataactaatgttgagatcagacagaattccatgtgaggagataatt

SEQ ID NO: 171377 - DNA, 254 bp, Homo sapiens
gcagtggcatgatcttggttcactgcagccttgaactcttgggctcaaatgatcctcttgccttagccttctgagtagctatgactacagacaggtatcaccattcttagctcatttttcattcctttcatagagacaggttctcattccattgctcaggctggttgtgaacacctagtcatgagcaatcctcccaccttagtttccaaaagtgctaggattatagctgtaagccactctacctggctgataaa

SEQ ID NO: 171378 - DNA, 316 bp, Homo sapiens
gcccggtatccaggaaacttacaatcatgacaaaaagtgagggaaagcaaggcacatcgtacatggaggcaggtgagagagagagagagagagagagagagagaggagagagagagagagttaatttaaaagtacttgtactcggccgagacatcctagcaggaggtttgggtgcacatgggggcttcccccactttgaagtgagtcgtcacatctgtattagaccctagctgttgcttaggcaaaaatgatgatttagaagaagatggagagaagaggagagttaatttaaaagtacttgtattcggccggacgt

SEQ ID NO: 171379 - DNA, 346 bp, Homo sapiens
ccaaagtcccagagctttctgatttttgcttcttcttgctaggaaagcaattatcctataataatccttctttacaggtaaaaatattttatggtgcacctgcctcccttgccagtggaatgacagtctccatagacctgtgggccatctgggccctgggccagcctccttgtctcacactagcttgttggggacctgcccttgctggcacccatcattccagctccctcctgttgtaactcctgccccaaatcccaggacttgtcgctgccagctttttcccctgttgttccttgtcttcccacccttctcaggactcaggtcaccaggataggtggacatccaa

SEQ ID NO: 171380 - DNA, 333 bp, Homo sapiens
catggtgagtgttagaggggaaaagggcagggcagtgagagtaaaacaggagtctcaaccttatccagtgactgtacactttccgattgtcaatattgtaagtattcaaaccaaactgattgaaacctggccgggcataactcggtggccgagccagcacctctgagcagggcactggacaggctgagcttcctgccacctgactgggaaactctgtttgaagctcagaggtttccagatctccaatttcaagtcagtaagtggtacacctcagctggcaggtggccccctttatgttatgtagctttccaaagtgttccactgtggaatctg

SEQ ID NO: 171381 - DNA, 781 bp, Homo sapiens
taagtctttaaaaaaaatgcttcatgcaaaataattaagaattagcattaaagccttaatgaatgggtgtcattttctaccagcctaagtttcatcaagaacaaatacaagtatattttgaatttagatacctcctttaatccatttggcatcaactgtttcaaatcatgagaaaaatactaggaaatttaagttttagtaaaactctgtcaagttaactttgaattttatatcaagaagaaactattgagaaaaaaacctcatgcttttacacaatagtatactattttcttaacagcaaacagacatttttctcttacgtaccagctcataatatgtctgtctaaaattgttgggacggatgttttgtcccaaagactttctcagagttgtgcacttagtgttgagccataactactgtctggatgcccagaggaggcacatataattttattattttaaaatagcatctgttagccagccacggtggctcatgcctgtaatcccagcacgtggggaggctgaggcaggcggatcatgaggtcaggagattgagaccatcctggctaacacagtgaaaccccatctctactaaaaatacaaaaaaattagccaggcatggtggcgggcgcctgtactcccagcaactcaggaggctcctacctcccacctcagtaggagaatggtgtgaacccgggaggcggagcttgcagtgagccgagatcgtgccactgtactccagcctgggcaacagagccagactccgtctcaaaaaaaaaaa

SEQ ID NO: 171382 - DNA, 695 bp, Homo sapiens
ttgcaactgcggctctgtgtggagcgttatcaggatttgctcaatgcgtgtgcacagagatgcaaaattgcctttaccagaatcaatcttgggttatgtgtggtccaaagaatgcttctaagccccctgcggtaggagtgagacctggaagatatgggcaatgagacaaaggcccccagaccaccactggggagggggttctattcacaggacgggggagcctgcttgggaaggagcagggacagagctgggctgctctgcatgacacagcgggacagggattggctgggaggagatggagtgagtattcaaaaggcaggaggagggagacagggccgcagacctcagggtgggaggggtatgtggggttgggaggccctgacgggtctctggaaggcgaaggagctggcagggcttccaggttcactgtggagcagctggggtgctcttttgtctgctctgcctgcctccgaggtctctgggtgtctccctggctcactaaagctcgtgtgtggtggatctttgagggggaacttgaaaaagacacaagctttgccactgggacactgcacagggcccccgccagggtcctcaagctcaattcccactcgtgtccacctgcccggccccctctgctcatccccggccttgccaggggcacatttttacctccagtgcagctgcagagggagctg

SEQ ID NO: 171383 - DNA, 203 bp, Homo sapiens
tgatgtggtatctgaattaatttcgaccaccttattaaaggtttgtcctggagaaaagtagaatttgggatgacctttgtaaccccagacggaactgaatttttgaacatgccttagactagctttgaaaaaagtctaacttgttaccaagtcattcttttaaggaagaactgcgattgatctttccctggctgctggtggac

SEQ ID NO: 171384 - DNA, 254 bp, Homo sapiens
ttctcctcgccaccctgtctgtgacaccttactagctagcatcctggggcacggtgttcatgtgaggcagtgctgactctgggggctggggtggtgcaaagataacaagactcaggtcctcctccaaagcacttttaactctcaacaaaataattcatttttaccaactgctgattgcatttcaggcaccatgctaacgacatctcatgcagtatctagacccatccttgccacaaggggagatggtgttattg

SEQ ID NO: 171385 - DNA, 255 bp, Homo sapiens
taagctgaaatcacaaccacttgtcaactgtgtaaacttttatcaattattaacctccctgtgcctcagttttctcatctgtaaaatgggactgataataaattgttataaaattgttgagggactaaatgagttaattcatgtaaagcacttaagacattgctttaccatatggtaggcactaaacacatattaacctctgctattattgactttaatcaataatatttttaccttcttttttggtcacgcaca

SEQ ID NO: 171386 - DNA, 338 bp, Homo sapiens
tgctcattcaattgtttcagttacttacagattctggatattagacctttgttggatgcacaatttgcaaatattctctcccattctgtaggttgtctatttactctgttgatagtttcatttgctgtgcagaagctctttagtttaattaggtcccatctgtcaatttttgtttttgttgcaattgtttttgaggacttagtcataaattctttctcaacattgatatccagaatggtgtttctgaggttttcttctaggattgttatagtttgaggtattacatttaaatcacagtgtaatttgttagtgtaacataactactgtattcttgattc

SEQ ID NO: 171387 - DNA, 210 bp, Homo sapiens
gcctttggatttatggagaaatgactgcatttagcaaaatatgtctgtttttttttaatgacagtcttaagtctgactgattatatttatccccatctctgtgttcttctttctgaaatacacacctctctcttcttttcttttctgcttccattgaaggacttttggcccaagtgggtgtttgtattcattgcaccagccagcccaagt

SEQ ID NO: 171388 - DNA, 278 bp, Homo sapiens
ctgagatcgcaccactgccctccagtctgggcaacagagtgagactcctttaaaaaaaaaaatttaaattaaaagaatatgtattgacactgtagatttgtgacatatcaagattagaagttgaattagtagtgccataataaagttactagataaagggcttatttttgtgatgctaacttgatatgtaccatatatgtttttctcatactggtgcttcttaggatataatatttttagttaggatatgatacctgtgacttttaacatagattcag

SEQ ID NO: 171389 - DNA, 823 bp, Homo sapiens
ccatttaatagctgtagcatctttgaggctgcaaggcttctctttgccccaatttcttcatctataaatgggggtattattaataatagtgctatctcatacattcatatatgtagaatatgtagagtacttagaatttggcacatggtaaggattatgtaaatgttaacttcgattttagaacactgtaatagggtaatatgagctgctatagcacacatagcccatatatcagtgacttgattcactagattatttctcactttgtaaagtctaaaatggatattctcgataggtaggtgcttaccaacccaagtgacactttttactattaagatgttagaatatctacctagaaagtggagaaacttaagctgatcctagcattagtcatatatggcccatatttaggcctagaacaaaaaagctgctaataaagacttacaatataggaatgttttgaattttcaagtagaggtttaggctttataggaggtaactaattacttttaacggggcgaatgaagtaaaagtaagctcagaggcagcaaaacatagaagtaactcaggctagataggaagggaaaattggttcatattaagcacagggagaaagaatacctttgagtgtggagcattgttagtgattgaggtggatcataagtgaatacagcagtaggagttgatgaaagttaaattaatatggctgccggaaaccagtaatacaccatgaaatggatgaatctgagatactagtaacccagtaggaaggatggataaagtgttccacaaagttctgaaggaatagtaacagattcataaa

SEQ ID NO: 171390 - DNA, 541 bp, Homo sapiens
ggggaagccattacatagcattgaagtcaagaaaggcattcctgaggaggttacacttaattaagtaaacaccttaactaagagacacttcagaatatggcagaggggatgcgtgtaaagattgatttgataaacaaaaaggctgaaatgtagaaagcaaaggagagagtgatatgagaggcaggagatctttcatgcaggatcatgaataatttttatatctttctcagcgggaagccattgacgagtttggcgcaagggggtgtaatgatatggtttatctttttttaaaaaaaagtttggctgctttttgtggaattaattagggggcaagattaaaagcaagacaataaattaggataatattgtagtagtcaaggtagaagtggtcggggcttcaattagcatgatgtcagtggagactggggaagagaagttgataggttgaggatatgtttggatgtagagcttacaggacttgatgaactgtacattgagtgtcagaataagaggaatcaaaaggttttgtttagcctgaggt

SEQ ID NO: 171391 - DNA, 686 bp, Homo sapiens
aggtaacagtgcattcagaattagctcacgaagccaacttcagaacctacagaaaagtataagtacaaatgctcaaagacaaatgagacaaatgctcaaagaatgggcccatcctcacaggccctttaggggaggggtcatgacaaaagcaccaggagcacctggatgttgtaacatttgagcatcagaaagacaaatggccgtagagacccaaacacacgaagtcacaggagatccacagaagtgctcaagaaagtcagaaaaaaaggcatttcacgaatcaccattgggaaaggttaactaactactcactttgaaaagtcacagctcaaaggaaaggataaaactatcctgcctttcccagaggcactatatttcagagaaaccaaacagtcccaactgctgagtaaaacaagagtttacagatggattcacagctgaattccgccagacattcaatgaaggaattggtaccaatcctattgaactactccacaaaatagagaaagagggatccttcctaaatattatatgaagcagtttacctaatacaaaaacaggaaggattaccaaaaagaagctacagataattccctgtgaaccaatgaaagttcttacaatatagctagaatcaaagatatgaaagatatccctgacagggtcacccggagaaaagcaaagtgacc

SEQ ID NO: 171392 - DNA, 384 bp, Homo sapiens
cgcgcctatagtcccagctactcaggaggctgaggcagaagaatcgcttgaacctgggaagcggaggttgcagtgagccaagatcgtgccactgcactccagcctggtggcagaacaagacttcgtctcaaaaaaaagataatttactgtttaaacaaaaagcaatgtactgtgggatttataacatatgtaaaacatatgttaacaatagcacaaaggttgggagaaatggaaatccactaatatcagctaaaataataccaccaagaagctaaagagaaaattaaacccaaagcagaaggaaataataatgatgagggcagaaatcaataacaaaggctgggcatgttggctcatgcctgtaatcccagcactttgggaagc

SEQ ID NO: 171393 - DNA, 370 bp, Homo sapiens
tttagattaaggtgatagttttcaaagaacattgaaagggacctgtcatattcagtaaagaagcgaattgaattaaaaacacaaacctgacagaacacagcccatatgagtgtacccacacatgttggtgagctcgattcataaccctgagcccccgagactcacaaagatggcctgaaacagatacaggcaaagggctaccaaagttctcgctttcagggctatcaggtctgaaggaacaggctggctttcttagttttgttttgttttttgtttgtttgggtttttttgttttttgttttgagacagtgttttgctctcgttgcccaggctggagtgcagtggcacgatctaagctcactgcaacctc

SEQ ID NO: 171394 - DNA, 535 bp, Homo sapiens
gaatgaaaataggaagttgcagaattatttatctatatctatctattatatatagatagatggatagtatcaatatttaaaaaattattcccccaatgcaaaacttcagttaatcatgaaaaaacatcaaataaacccacattgagggaatattctacaaaatacttgatgtgtaatcttcaaaattgtcaaggttgtgaaagtcaaggaaagactgagaaactgtcagagattgtcgtattcacagataggagactaaagagatctgataactaaacgcaatgtggtatcctggaacacaaaaaggacattagtgaaaaaactggtgaaactggaataaggtctgaactggaataaggtctgtagttctgttattagtattgtgctactgttaatttcttagttttgaaccagggttacataaattgttaacattaagagaagctgggtgaagtgtatgttgaaactttctatactagctctgcaactcctctgtaaatctaaaattatttcaaaataaaaagctaaaacagaa

SEQ ID NO: 171395 - DNA, 228 bp, Homo sapiens
cagcattaatatataaactcaagttgccagagtctcaaatgtagcatatgcagagtgcagggtaagggtttctcttgccaacagataaaatgcactccaggctcccattggtgttcgcaaatgccagtcaccaaaagtcagctttccccctgaaaagcaagttttgtttttgcacaattaaatggtaccttggtgaaatgagatagagcctttctcataggaagtgat

SEQ ID NO: 171396 - DNA, 458 bp, Homo sapiens
tggtgatccatgctttcaggtatccaaggcatgtagattgggatggctgaccctgcctctgtcacatagcaaagtaccccttgttaggaagacctagtgagtttcagctggtcagagggcccaggtctgttgcacacactgaaatacacctagtcacatggaattagtcgcataccttcagtgatatctgcttaaattttatactgactggtcagatacactcagaaagaaacaggatcctggcatagccttgggcagatccacacagatgcatagttagatagtcctaggcggttcccttcaggcaggtctcctggtcacaggtatcctgccaacttcacccaggcacagccttaggcagaccatgtcagaaggactctgggagatgctgcatgtcagacacccacagctgggtgccctcaggcagagccataccctgagatacatgtggccccaca

SEQ ID NO: 171397 - DNA, 493 bp, Homo sapiens
cactggccttacctggaactttttcttcaaacttcccttcagcctacaaagagtcgtgttacaaaacctctgaatccaaattctgcctccttaccttgtcatgtcttggcatgagtctatgcattagtctcagactgatttgattcatgttagttgtggccacctcatatgtattttcttgtgtacaagaatggagcctagttttataaatgtgataaaatgcactggattttttttttcttttttctggaaggaattttgaaagcttgaactgttgtctcctggagtatgttagagtataggaatgtctcgagatacctgactttgtccatgaacttctgcatatccttgattatcaaatatcacacaccacaactgaaagtatgttttatgatcattcattaatcctctccattgcaaaggctgagtggcacatttaagaggttggggaacatgaactgatgggcacactccttttaacattgcttcatta

SEQ ID NO: 171398 - DNA, 728 bp, Homo sapiens
gatacagtgtctaggctacttggcccttaaaattaatattgactaaatgtttaattgtctgttccattctagacataaagatcccattaattcacaacatttttttccatctcatgtgatgatgtggctaatattattatgctaattatttctagttgcttggtttcaaaaactatgagacccgattcaaatggtgaatgagagtccttggctcctttaggccactagggtgctccattgctctgaatggcatctcagcgtctggttgagtttatccagaataaagtgaaatcacatgagcatgttattctctactcactgaaaaagatcaggaagacagggtcttgacaaaaaatgcagtacatctcagaaatctggagaagaaagtggaagacagccaggccgaattaacgaaaatcagactcaaaatattttttaaaaattcagttttattacattctgatacagtgcatccttagcttataagttataaacaggtactaaaaatgatgtcaacaaaaaagctgtaatgtacagtatttctttgcatatagtaggtggctattaaatagttgtttgaggtaaaatttacctataaaagagcagtttgacatacaaatctatttgatagaactagctcttgtggcatttttacttaataaggatcacataagctaaatggaagtcactattaatttcaaatattttatttgattacataaatattc

SEQ ID NO: 171399 - DNA, 383 bp, Homo sapiens
gaatcttttgtatcagaaagtaaagttctcaaagaatgatagggacatgttataaggacacaggaaccagcataacggggcccccactggccaaatgcagacaatgtgtacatagtaagacaaatgaatgtagataccatcttagccaggtgatgaaacaaactggtatcgcactactcctgctatgatgcagtgagaacccttctgtgatactcccctcaaaaatgaataaatcaaaaggatcacagaaaaacacaaattgcaaggcattctataaaggaactgagctttgtgcagtggcagtatcgtagccagtgaggtttatcggaggcgtgatcactgctaattgaaaacttttctataaaggaactggtctgtagtta

SEQ ID NO: 171400 - DNA, 565 bp, Homo sapiens
ctaatgagaggtgatgttcagctaggaggagtgcttcctctgctaccaccgttgtccccactgggattccaggtgcatcgagaatgcagacagcaaggcttctgtttgtagattggttgtgggaaaaaaaaaccccatactcacaggattcttaagacaaatgcagtggatattttgtgtttgaaaatgttctatttcttctttgattcttccttttctttctggtacttttaatttgttgtgagaagggtgataaagctaataatgcaccaaggaatggaaagtgcttccatctttgcagaggtcctggaaagttaacttttggtctgaagccaaatcccgatgtaggacttgaactcatgacctaatcccagaggcaagaatgttaccagctgaccaacactgaccctcataaaatgtagacatttaaaatactcctttgagtagtcctgttgctgctttctatgttttcttctctctttcagtcgtttccagcagtgttcctggcctccctgttaggagcacagttttaaagatctatttttctcactgtctttccatttgc

SEQ ID NO: 171401 - DNA, 453 bp, Homo sapiens
gggacggacatgtgggcatgtgctgctcaagacctgcagggcagtagcaaatcagtgcagtgtatggaaggagaaggtgctagacgtgcggcctgggcctgactcctccagcccttcatctttgccttcatccttcctcctgcccaacatgcgtccagggcatcacccaccatgcgtggttaatgccagccttcaggggaccacagggcttcttctgtcagccccaggcagcactgtcccagggctgtgaccttgacctctgtggctgccagcggttaggatgcatcccccaccagtctctccccaggaccagggcccaggagatcacctgctgtggggcacaggtggcctcaggtacctggaggcatcgccagcctgatccatgccaggcaggctgcccttcccccactgttaggagaggtagggcacaggagctcgatgctggctgtgaag

SEQ ID NO: 171402 - DNA, 1510 bp, Homo sapiens
  misc_feature (236)..(236): n is a, c, g, or t
tgctggctgtgaagaatgtgtaggcggggctgaggtgagctggcagagggagcaaagcatgagttcaggatgggtccatggaggccaggtccaggtgggagctaggatgatgcccacagctcctgcctgcctgcaggagggagctctgggctgtgcagcgtttggaattgtgagtatgggggctccagcatcagggccacagaagaatgttgcagtcacaggctccatcaggagcngaggcgccggtgccctgacggcagggggcagttgggccttcaggctcctcttcccctgacacaaagcaggccccaggtcgggaagacccgggttcaggtcccgaatgccgctgactggccgtgggactgtggcatgttactggccctcttgaagcctcagtttccccatctctagaatggagctgcaggtcctgcttacctcacagggctgtggtgaggattacacgagatgataaagtacttagcccagggcctgtcacgtagcaggtgttcgttattattccctatctggttccctttcctaccccatcccagcctcatgttccaggaggaaggaccctgcaacccaccccatttctgggacgcaggctttgccgttaggtagacttggactccagcactgactccacactgacttgccgtggactctaggcggtcacctctgcgtcaacttcctcatcaggaatgcagtgtgatgcagtacctattccttggggttgcagtttatgaaatgatctaagtgtttgtcaggggcttagcacagtgcctgacacataggggctcagtaaatgtcagccgtgacactggtgattttgggggagacccagcgctctccacccatgcctgctgtcctgcccctgcagctccctccggcccaggtggtctgctttgagtggggcactatttggggtcataagagcactgccctgacctccctgtcatctgaggcagctggaaactccaataggcagagaccaagagctgagctgtgcagaactctgcttccctaggcacctccaccctgtccatctctcccccaacacccctgtacctggcctgaagctgctcaagacctgcagggcagtagcaaatcagtgcagtgtatggaaggagaaggtgctagacgtgcggcctgggcctgactcctccagcccttcatctttgccttcatccttcctcctgcccaacatgcgtccagggcatcacccaccatgcgtggttaatgccagccttcaggggaccacagggcttcttctgtcagccccaggcagcactgtcccagggctgtgaccttgacctctgtggctgccagcggttaggatgcatcccccaccagtctctccccaggaccagggcccaggagatcacctgctgtggggcacaggtggcctcaggtacctggaggcatcgccagcctgatccatgccaggcaggctgcccttcccccactgttaggagaggtagggcacaggagctcgatgctggctgtgaag

SEQ ID NO: 171403 - DNA, 363 bp, Homo sapiens
ggggtcctggcccctgttgtcagtgcaggtctggggccgcaagctgggctcagccctcaccgctgcccacgggtgcagcggcacctccccccactgactgtggccttttgttttctgggtgacagtagcatcaggcggtgtgtccgggtgactaatctcctccaggctgggcagctgtcacagggcggcctgaccaggcaggcaggaaagctgacaccctggggagggctggcaggccggtgccctgacggcagggggcagttgggccttcaggctcctcttcccctgacacaaagcaggccccaggtcgggaagacccgggttcaggtcccgaatgccgctgactggccgtgggactgtggc

SEQ ID NO: 171404 - DNA, 585 bp, Homo sapiens
ttttcctaccaatgtatggtcacggctccacctaaaagaagtcttcaatatttagcgatcaaatgaatgtcaagatggaatctcagaccctgaactgtaaggatcttctctattctacatgcaaagtactccttatctttctcaggtttctgctttttgtaggaaacacagacaagcattgagagtgtttgggatcaagggtctggaaattgtctgtacagacaatttccttgtttcacgtcttgaagatgacatgaatatagagaagatattttgaaagatttgaagaaaggataccaaggaaatatgacaggtcagcaaatatctctgtcctggttttcttctattttctcctagggagacatgacctgttttcaatcaagcatctctataaaaatgatggtctgtcttttcaccagtggagaagattcagaaaaactataagtagtatgtgttaggaaaacaatagttttgttttcatcttcccaatttaaattatgttacatcactgaatattaatgaagttaagtagctcttcaaattcttgcactgcatttagcttttccctcctgttaactgcctatc

SEQ ID NO: 171405 - DNA, 353 bp, Homo sapiens
ttcaggattcctaaaggctgacaggtctagacaaaggtggggccagagaatgagcccatttcctgtgttctcccagactatttattcctaatacccttcaccatagtcaccccagtacccatgtcttgtgcattcccatgtaggcggcctaggatgtccttgggatatggattatgtattgtctcccctgacacattcactgagggtagagtccatgcctgttttcctttcctttttgtctctctctcagtcccatcccaggctctaggcttctcacccaaaagctctctccctgtctctttgtttcccccatattctggtatgaattctttgggtatctctcacaaactgac

SEQ ID NO: 171406 - DNA, 563 bp, Homo sapiens
gtgaggcacatcattaatttcaatctgcaacattctgatcagtatatactgtcaacatgtatgtttccaagtctagactttttttttgagacagaatctcgctgtcacccaggctgaagggagtgcagtggcatcatcttggctcactgcaacctccacctcccagattcaagagattcttgtgcctcagactcctgaggagctgggattacaaacattgcaccaccactcccggataatttttgtatttttagtagagacggggtttcaccatgttggccaggctggtctcaaactcttggcctcaagcaatccacccaccttggctcccaaagttctgggattacaggcgtgagccaccgcacctggctccaagtctagactttagatgtgcttattctcaaagagaaaaaaatttccagtagagtagcagaggtagctagatagccctggtttaaccctgttagaaccgattaagaatccagcatagaagcaaagtatttaagcatgtgacttatattctcagcaaatgttcccaaaatcaataaatgtctgacctgagt

SEQ ID NO: 171407 - DNA, 730 bp, Homo sapiens
  misc_feature (19)..(19): n is a, c, g, or t
  misc_feature (23)..(24): n is a, c, g, or t
ggccccccacccacgccancttnncggctaggtagcgaggccgggtgtgggcccctctccacactgccacagctttccgcagtggggcctgacatggaggggtgagcccagttctgtgctctgggggaggcctctgcttcagcatgaaccattatagggtgtgtgtgtgtgtgtgtgtgtgtgtgtgtgtagtgtggtatgtgtggtgactgtgtggggtgcagcagctgtgtgggggtggggggagaaattttgtgtatatagatgctgctgctgtgagaagaaggcgggctgtgacacacactcaattgtttatttattgatgctccctcacacacattaaaaacaaaaaaaaaaaaaaaacaacactcagagggctattttagtcgtcggcggctgcaaggaagaagaagagggtacgatagaatagtgcggcactagtggcgatcataggcgtcgtctctccgtcgcacccgatgcttttctgttgctacacgaggagtggagacagcaccgctcgcgcggcctccctcccctatatttacgaaagaccgctcatgtattctactttcttcagaatacacgccaggtggtccaacccccgtgctaaataaagatgatccgccggacgaaacgacaacccccgcccgacgcacaacaccaaacaccccggccctaatacacggccgaggccgatcacatcatttacgatgcaaacactccacaacgg

SEQ ID NO: 171408 - DNA, 324 bp, Homo sapiens
  misc_feature (19)..(19): n is a, c, g, or t
  misc_feature (23)..(24): n is a, c, g, or t
ggccccccacccacgccancttnncggctaggtagcgaggccgggtgtgggcccctctccacactgccacagctttccgcagtggggcctgacatggaggggtgagcccagttctgtgctctgggggaggcctctgcttcagcatgaaccattatagggtgtgtgtgtgtgtgtgtgtgtgtgtgtgtgtagtgtggtatgtgtggtgactgtgtggggtggggtggaattaattttgtgttatgatgttcgtgtgtggaaaagcgggtgctgcacgactacttcaatggtgttattattatgtccatacaagccattaaaaca

SEQ ID NO: 171409 - DNA, 461 bp, Homo sapiens
tttgcttgatataggaagactggggatggtggttttggggagggggagtttttttggggggccatgtgaagtttaggctgttacttttggggaatgttctaggccagaattagagaaataagtcaccattacaaggatggtatttgatgtcatgggcttgaatatggccagggacagagccgtagggcactctagcatttcaaggttgagaaggaatcagcaaaggagattgggaaatggccaaagaagaaaaaaggagaggccaggcgcagtgagtcacggctgtaatcccagcacatggggaggccaaggtgggcagatcacctgagatcagaagttcaagaccagcctggccaacatggcgaaacgctgtctctactaaaaatacaaaaattagctgggcctgtaataccagctacttgggagggtgagacaggagaatcgcttgaacctgggaggcg

SEQ ID NO: 171410 - DNA, 278 bp, Homo sapiens
actcacaaaatataccagatgtaaaatcctatagcatttctcatttcttcattccttcctaaggcgagagccagttttgaactccaagtatcaggacgcagagctgtccaaaccaggagaataattcgcaaatgaatgagccagagcctgatgcatttccattgtgaagaaggatttttatgtcattacacagaaatgtaatggttaaacctgggtattttaaattaaatgcaaaacatgtggcatttgaaattttttaaaaaaccaaacttactgat

SEQ ID NO: 171411 - DNA, 2166 bp, Homo sapiens
  misc_feature (829)..(829): n is a, c, g, or t
aagtatatgagatccttttttaattctacttttaatgatgttcgataataatcttttagctaagccattattcttcctgttttgcatcttcttttcttacttcaatccctgataataaggtcacgtgtcagagatcaaatagtataggtaataggttacctaaataggtatttgcataataggttacctaactaaataggtttttgcctaataggtatgttgattatttcgcttacttgattctttatgagcctttttttccttgcgacgtctttggtattaattgttagtcaagatggatgtagaaattttccatatgggatgtttctctttgaattcatgttgttaaaatgatttcttttggtggagtgctgatcttttttatgattgtttcatatagataagaacagactacaaaaaaatatgcctttcaatcctgaagagtaacctgaactatacactagttttgtgctttaattttcatttgtaatctgccttcaataaagagttaagctagtggaatttatgtcttagcttgttataacacaaacacgaatatttgtctgcttggcattaaagggtaaagatattccatagctgggaatcttaatctgaggtacgtgtaaacattcagggactatatgatctctgagaatttgtatgttgtaagtctttgtggcagtgtatacatttgtgttgcaacttattaacacatacaccgggctttttttttttttttagaagattcgtagctttcatcatattctcaaaaggtttctgtgacccatgagatggtttacagtatggggaagcatcaaagcacttgcanagttgatggttatatgtgtgtgttattatttcagccacccattatcatgtgcttaccaactgcctaacagtgcatacatatgtagaagttttattcttttctcctgttgccatattatacgtctcatttcacagcagaaaaacaactgcatgacagagacaatgtggttcaaaccattttacccttgtattcattgactgctacaaaacaggaacattaaatacctgattgtcaccaaattgggtagtctcagcacttctacactcgtaattgtgctggaaaagtggaatgctagcactaataattagattttggtttggagggttttttatttgtttattcttacttgtataaatttatggggtgcaagtgtagttttatcacatgcatagattgcattgtagtgaagtcaggacttttagggggtccatcacccatgtaatcacgttgtacccattaagtaatctttcatcatccacctccttcccaccttctcaccctttggaatctccattgtctatcattccacactccatgtccatgtatacacattatctagctcccatttataattgagaagatgtactatttgtcttttatgtctgacttgttacacttaaggtaagggctatccatccattttgctgcaaatgacatgatttcattttgttttaatggctgagtaatcattcgttgtatatataccacattttctttattcagtcatctgctgatggacacttaggttgattccatatctttactattgtgaatagtgctgtaataaacacatagtgcaagattttggaaattttacttttgtggcacgttgttggtatttactcaggatctttggatttgcttggctgcatgtatatgaatcagtgtgtttatttactgaaatatgtgcaaaagtcttgtctttggtggattaatttataatataaatccacaaaagtcagattctgctcctaagtatattttacatttttaaatttaatgccagcaagaagttacagtactagaattgccttacccctgagagtatcaatgatcagatcatagtatcaggtgactgggctatagaagatgacttttattacttaacattatgaagttactagggctgatttagaaatcgaggaacactggtgaaaccccgtctctactaaaatacaaaaattagctgggcgtggtggtgggcacctgtagtcccagctactcagaaggctgagtcaggagaattgcttgagcccaggaggcagaggttgcagtgagccgagatcgtgccactgcactccagcctgggcgacagagtgagactccgtctcaaaaaa

SEQ ID NO: 171412 - DNA, 521 bp, Homo sapiens
aagtatatgagatccttttttaattctacttttaatgatgttcgataataatcttttagctaagccattattcttcctgttttgcatcttcttttcttacttcaatccctgataataaggtcacgtgtcagagatcaaatagtataggtaataggttacctaaataggtatttgcataataggttacctaactaaataggtttttgcctaataggtatgttgattatttcgcttacttgattctttatgagcctttttttccttgcgacgtctttggtattaattgttagtcaagatggatgtagaaattttccatatgggatgtttctctttgaattcatgttgttaaaatgatttcttttggtggagtgctgatcttttttatgattgtttcatatagataagaacagactacaaaaaaatatgcctttcaatcctgaagagtaacctgaactatacactagttttgtgctttaattttcatttgtaatctgccttcaataaagagttaagctagtgga

SEQ ID NO: 171413 - DNA, 610 bp, Homo sapiens
ggcacgagggtagagttaacagaaagcaaggctctgtaagatgagccttgcaggcaagagctgaaggttgctccatgaggaaagcagaggcctgagaggaaacgtggttgaacatcaaaaaccaataggtgggttttagtgaatttaactaatgccttccctattgattttgagactagaagaatgtaagcaataaatatcctaagaaaccagagtatgctcagctcagcactgtattaggcctcagggtggatatggaagaaaacaaggccatcgaggttattgaagaaaccagaaaaaggacaggaaaacttaaatattacaaggccttggcccagtgcggtggctcacgcctgtggtcccagcactttgggaggctgaggcgggtggatcacctggggtcgggagtttgagaccagcctggctggtggagcctcgtctctactgggaatgcagaggttagccaggcgtggtggagcatgcctgtggtccagctgctcgggaggctgaggcgggatggtcgcttgggcctgggagacggagattgcggtgggccgggatcgcgccactgcactccagcataagctgcagggtgagactctgtctcaaa

SEQ ID NO: 171414 - DNA, 365 bp, Homo sapiens
taagagacaggttttttagttcagataatgcaatttcttttgcttttgttgattgtacacaaaacactatcagtttagaggagcactgcattttaacttcttatatgctttttaatttcttaattgaaaaaagctctattcttgcatattttgctaagagatcacataaatattgtagcattcatggtcaactctaggcaaaatttcaagatggtgaaattcatccttgatgcgttctcagctctcaattccatctttgtgcccttcagtctctcttccccacctccattcttctcaaccttcctttctcttctcctaatatttctaatgatcttaatctgctcttcagctaccactgaccactc

SEQ ID NO: 171415 - DNA, 519 bp, Homo sapiens
cccacttccacttcctgagtttctgacagtgggtctggagtacaacctgaaaactttcatttctaacaagttcccaagtaatgctgctggtccagcaccacatacttagaaccatttaaaaaataaaagaaaaagaacccatcaaagacaagaccagggtatttatgatgtggcaaaatcttcaccaactatgacacaaaccacacagaggcagggaattttgtctgttctgacactgctgtattcctggtacctagaatggtggctggcatatgctaggtgcttaacacctatctgctaaataaatgggtcagccggccctgtggttgaaactggggccagcgtgggtataggtgagcaaggaaaatagctgcagaagcaccagcaacaaagggaatggctgcttactgttgaactgtcctgaaacggaagcccaacttaatgacaaccacaataatgtaaaacaaattaaacatcacattcccactacccagaaccggggatgggatcctctgatca

SEQ ID NO: 171416 - DNA, 865 bp, Homo sapiens
gcccaaagggctcaattccctttgcataacatgagcaagatgctcagcagagtcctccaaccagaggggcacaccaggaactaactggtaatatgctatcacttcttgtcttgtcttctccctttatttttcctagattcctttcatcttcttagatctgctagaagtagtatgggccgaaccctggtctaaagcagcacatgatacaaaggaactaagtctaaacagacaacttagaaggatttagtccttggcctggcacagtggctcaagcctgtaatcccagcaccttcatgctcagtcagaacagttctagtatttctcacttcactgggaagactcatcttctgttaattccaagtccctgaagctgatttgcgttaagattaaaaggactgtgctcacttcacaatctcaactgagcactactcaagtcacaaaacctgtattattctggatatggccttctcctagtgttcactctttctatgcttcctcatggatctgcttcctgctaggcccaacttctccatttagaagtgttaaatcaagtttagcctaggcaagtttatgcctccttacatcttttaagtttggcctaaagatttatctgtacataatgaactataacctaaatggtggtagaaatagactgtaacctactcttgtgccaatcactgagttttggccactcaaagggggccaactgttccagctgagccataaccaatccagctgtttctgtacctcacttccattttttgttcatcactttcctttttctgtccataaatcttctaccacgtctgcactggagtctctgagcctactgtggctcagaaggctccccaattagtgaactgtt

SEQ ID NO: 171417 - DNA, 457 bp, Homo sapiens
aagcagatgcccaagataaacaaagagaaaaaacactgagaggggtgtagaggagaaggaaaagtgactatcattaacaccatcaccttggtgtagaagagctacccaaaagtatttccagttccctgtctacaggctgaaatgtaaaacctttccaagtagaaggccatctatcccgttatgaaggacgtagggacaccgaagtggcaactccagaatctccacagaataggaactttgggagcactgactatgggtagaaaacacagaggagtaataaataaaactggaaaaacaacaaaaaggaaacctgggggagagaggaggcaggtgttgaggaacttaccttgatgctgcatttgcacaccagcctccctcccaggaaggctgaatcctctccgagaaatctttcggggccagcattatattagagctaaagtatatttcccaccaattt

SEQ ID NO: 171418 - DNA, 360 bp, Homo sapiens
gttgactagtcagggttgatttagatagggttgattttcccattccgtaagtttttctttctgaagaataaaacttccccagatagaattgttttttcttcaaaaatataggatagttgctctagaactttcttatctggagacagtttaactacagttgtatacagacttatgtctatcattcacactcatagctgcctctgtgttcattgctgctgcagctagctcattatagagactgccacctctttctcttactcgactctcccagtgccttctggccactacagctagcttaaaatggcatttcatacaccttggtcaccgggagagtttacttctatctactttttcatcccc

SEQ ID NO: 171419 - DNA, 418 bp, Homo sapiens
agcacattggccacaaaataccatgcagatccccaaggacttcactagagaggaaagcaataatccagcgactgaacccaggtgtctctcaccaaaccctaccctttctggtctctaggccagggcagttcctccaccagtcccgacgtttgcgctacctaagcacgtttggatttaacaggaccatttcaactccaagacaggcaagctgactggtattatttgcaaagggtcaagtggaaaccctagaacagtcattcaagcaaatggctcctagtatctcaaatggggcggtgggaggctggggaaatgccagagagcaagaggaagtaggagaaaagagtgggagagagaggcggaaagacaaagacaagccggcacccagacttggatctgggcaagggatgagggaagggcc

SEQ ID NO: 171420 - DNA, 301 bp, Homo sapiens
gtttaactttgtgatataagttgcagattcttttcctcaggttttcatttctatttttcctgtagtttgtaccttttccatttttatggatatctaaactcaaccttaacttgacaaatggaaccttggatttctatccttcctttaacctccttctcttctagtcttcctcagtgaagaaacagcacctctcatgtgtctctactcatacatagcccaagcccaaaaccaagaagttatccttgcctcctctttccctccctccctgtctctaatccatcctcagtggtattgacttcct

SEQ ID NO: 171421 - DNA, 373 bp, Homo sapiens
ccactggttgcgcagaaacatcaaaggcaactatgatccaaatgtactttataactttgggggcgaatcataaccaaaaacaagcctgcccacttagagagagttaggtggggaacagagggagacaacagagggttgacagggaatcagccagaacactggtgtcagaggattctgtaataaatatgtggtaatacaggcaaagccatagaaggtggggggaaatgcaggcaagaaaaataacactgtgatataataaagaatctgcacactgtccataaagtctggaaattaactttttttaaaaagtgtgtatgtgtgtgtatttgtatacacagtcatcaaggacatcttcactataaaaaaaaaaagt

SEQ ID NO: 171422 - DNA, 404 bp, Homo sapiens
tcccgccttagcttcccgagtagttgggactacagatatgtgcccagctacaagctggctcttttatttttggggcagtttaaccacttggcattgtcaggtcttccctaagcttcccttggtcttttcttccattttgctgtttttttggacattaaataatttattacctctaccaggtgcttggacagaataaagtaaaagagagaatcgttatgttagaaaattaacttgtgcaaggtgacataaaattctctctgctgttgattcatccatgctggctttgccagtggtcatgagggtaaccagtgattcaactgtatgggagggaatctgccctttctgagtggatctcacaaggtgattcctgtgtgatgatgtaaagatgagaacctttctgggaa

SEQ ID NO: 171423 - DNA, 117 bp, Homo sapiens
gatattcaaccctcactgacattttaaatccaggattttatatctgttcccaactttccatgtcaaatgctattgcctttgttcattcatgagttcactcaggaaatgtctaagtat

SEQ ID NO: 171424 - DNA, 229 bp, Homo sapiens
ggcacctgcatcaagtgaggcctcctgggattctggcccaaccaggggaactggtctggacatgcctggttgtcatgttgtgtaggcagccttgttctcctctccaggtcggaggctgcttgagtccttgggtagctgggagcgtgctgatgcatgttcctaacatctccataaggtctaacgtttatagacttcctccctgtgcatttatcactttttttttttgaga

SEQ ID NO: 171425 - DNA, 249 bp, Homo sapiens
cggctggcggcctccggtaacagaaaccgactgatgaggcggaaggtaaggaagatggaagcagagggcagagctgggctctgtctggggagagggcaggagacgagtgttcacgtaccatggaaaggggaagtcacacacatgcgacttggccccgggggtcccgttccccgacactacacaaatatacctgaaagcctcagcgacggggcccaggcaggatggtcctggctgctctgacggcggaag

SEQ ID NO: 171426 - DNA, 567 bp, Homo sapiens
aaggggtcctgggaaggctggcttgggaagagttccgagcctgaagggtacaggtgggtcagcaggtgggaggagctgccatcatccatgatgtgtggaccatgagtttcttctgagagtgaacatttccccaggcaggtgttttgggggaagggaatgtgccctgcaggcaggtgtggccctgggtagctgcatggtcgggtgcatgtggccccaggcagatgcatggtgggtggtgtggccccaggcaggttcatggtgggggagatgtgcatggtggtggggtatgaccccaggcaggtgcatgaccaggtggtgtgactagaaggcttcctccatccttgctggacggggggtcccacactgcctgggccctctctttgggtcacaggcttgctgccccttttgttgccatttctgggcctgtgttagccaaggtgaccttcagcagccaccatcatgcacagagaaggacctctgcgcctctcagagtccctggcctgacaagaagaaactgaagccaaaggcagcccaaacctcggggcaccatgggccccttggcggccg

SEQ ID NO: 171427 - DNA, 420 bp, Homo sapiens
aaacagccagattttcattaatagtagaatggcagcggattacattcatacaatggaatgccatccagcaatgctaatacctacaggtaaccacatggatgaaccacagaggtataatattaaatgcaaaaagcaagatttgtaagaagatgcagtatgatttctgttagacaaagttaaaaggcaagcagacaaaatggaatattgtaaaataataaatagcagcaagggaaccgtcatcaaaaaaggcaggttaatagttggtgttttgggggaaggaagaagattccatcaattaaagatgcatagagggctcctgaatccagcatgtttcattttctgacacagcggtttttgtatgtaatggtgatgttaatgatgataatgattaaagatcttctttaagaatggaatatgttg

SEQ ID NO: 171428 - DNA, 409 bp, Homo sapiens
tggctttctgttgttgttgttaatctgctaagtgagggctggtagggaggtaatcagagggatattttgcacttccagaggttggccttaaaaagagttgagagccactacacttacaaaaggaaagggaagagaggaaaagggagaaacctagtgtggagggagggacagaacagaaaaaaagggagaggaaggaggagtgaaacagagacagaggagggtgcaaaactaagatgggtgttataataactaaagaccccttacccaggcaatagctgcaagagctcagctttagagaatgtgaaggcagagaaagcacacatccttcggaggtgaccagaccagaaggtcaggacctagagccacagctcaatgccaggaggacacacagcctcagtaaagcactcta

SEQ ID NO: 171429 - DNA, 540 bp, Homo sapiens
gtgttaccgcaaatgtttattgtagaaagaatggtttaatctttgtcaatttcgttaaaatgtacaccttattcagagtctgtgttaaatcatcttaataattttttaaagatttagaaacagttgtattttatatattggaattttttatattgttttgattttaatacttgattaaaataaatatttatttgagagcctttattcctagggttttgttaacacttgaattttgatagtttcaagaatatttttaagtagctgggggaagttacatacttgattttctagcactaatggtagtaacaatagcaataaaaataggcctgtaatatcattacagataacaaccaatagaaattccagttttctttcttatcagaaagaggaagcctactaatgtataatgaattcgactgacctaaattgagaaaatcgtcctcatcatggattaccactttctgcagagccagtataacatacactgatcatttctttaattgtactggaactaactttttgtttggtttgagacggagt

SEQ ID NO: 171430 - DNA, 295 bp, Homo sapiens
gtctgaaaaacaaaaggtacagttctttgttagaaatactttaaaacagtaacagaaaactatttttagggtatctccaaaattatatcaccattattctctttttgttagtttcttttgctttagtcctttgctccttttgcctcttcagaaggaactaccaccatcaccaacaaaccaaaacattaaatatacacgcagagcccaactttctacatgtgaaataaaaatataccttgtctcggccgggcgcaatggctcatgcctgtaatcccagcactttgggaggccgagg

SEQ ID NO: 171431 - DNA, 453 bp, Homo sapiens
caggaaacacatagccctgtagaaaatcactggagaagaggatgattggagttcttcatttcttaaaaaacagtttaggttttccctgtctgccctagggcccatgtcttgctggaaaatatgctacttagaaattaaggcctctgggttcaatttttggccccagtgttgacctctgtgtaagcctggcaggatgtctcatttctgggtcaccttttccttgccaacatagtgaggtatgtagaccaaatcattgctaagagccttctaactctaagacactaggtttagtcagccaaaagcatgtgattttcccagatttcccaaactccttgtacctaattgaaagtacacaatgaacttgcaagaatttaagcatccttagatgccagtcttcactttgggtattttcctgcctcctcagtgaaacttgacacctctagtttgtcatta

SEQ ID NO: 171432 - DNA, 159 bp, Homo sapiens
ggaacgttcatctataaatatatgagcagcccagacactgaccatgagtcactggtcaccacagaccacactgggtcaggacagccccagaggaacacagcgcacatgtgaacctctttggggggttctcccgccctcaccaccaagtgccactcctta

SEQ ID NO: 171433 - DNA, 302 bp, Homo sapiens
tagaaattggagaaatgaagaataattttttatcccacataataagtaatttgtgaattgcaagtatttctaaatacttgaagacatccctcacatcccctcttctgattgctgagtgcataatttcctaaagcttttttttttcttttgttttttggagacattgtctcgctctgtcgcccaggccggagtacagtgagctgagatcgcgccactacactccagcctgggtgatagaacgagactccctctcaaaacaaaaaattaataataataaagtaacataaagtaaaaaaaaaaaa

SEQ ID NO: 171434 - DNA, 224 bp, Homo sapiens
agggtcacatggctccagatccctccctgaggggtctcaaactcaagtgacttcaggggccagacaggtaacaaagagtgaatacatctcttgcatgtaggacaatagagagtagtggatatcctggtgaaaaaagctctgcaagttgcatttcttaccacctagcagatatgacctagggaccatgagtttgagacccctggtgcagctctgtctgagctcca

SEQ ID NO: 171435 - DNA, 182 bp, Homo sapiens
ttctactggaccctgcaaggctcaggagagtgcttgacagctcccagaatgagacaatgacctagccagaacattaaggagactacacccgtccttcagactccaaagggaaagctaggacggcagcagagtcatcctaaggtgaggcactccaggataacattttcaatatttttccttaa

SEQ ID NO: 171436 - DNA, 256 bp, Homo sapiens
cttccccagctcccctggctggtgggaggagagaggggatcagttaaggggtccctggcgctgccctgggtccctcttccctccccaaggccacggctcccctcgagggggccctcaccttcagtctctagctacctttccccgctctggctcattcaaacccaggcgtggaaaccctgccggtactatgagcctaggaactgcacctctgcaaataggcccaatattgacctttttttttttttttttttttttt

SEQ ID NO: 171437 - DNA, 479 bp, Homo sapiens
ttggcttatctaaatatcccacattgagtacaattgcttaagactggggtccacttccattaacaagtctatgtgagacaagaatcaataatgactgtgataaaatagcagcagggcactgtggctcatgcctataatcccagcactttgggaggccaaggcaggcggattgcttgagctcaggaggttgagaccagcctgggcaacatggcaaaacgctacctctaccaaaaatacaaaagattatccaggcatggtggcatgctcctgtagtcccagctacttcggaggctgaggtgggaggattgcttgagcctacaaggtgggggtagcagtgagtggagattgagccgctgcactccagcctgggtggcagagtgaggccctgtcttaaaaaataaaataaaatagcagacaagttgcatatttaagtttcatccagagttatgttgttgaatacacatctccatccaaattta

SEQ ID NO: 171438 - DNA, 431 bp, Homo sapiens
attagagggcttggctcccactgggttgcaaaaatagcataggcacacatctaagctccatcttacattgacactccatgaccccacgtgggccaccccagtgtcatggcccagtctggagaagtgaccctgcgaaaaagctgtgtatgccctgtaggtagacttgacccttctgtgcaagaaattttgatgtcctgcgagcacccagaatggtctaggagagagggaacaggctccagtggacatattctcttcgccctgttgactccctcctccatgggaagagacttggcttaaacaagcctagagcaggtctgtttaaggtctggggccctgagtaggaatctacttacccacgtcgaaggtagaattgggaagaagcactgttataaactcaacagaaagtgatactgagtttcattttttttttt

SEQ ID NO: 171439 - DNA, 701 bp, Homo sapiens
ataaccaagggtcgcagtgcatgccctaactatcagactctgacagtttcagggagtgtggctggttattgaatccaaccaataaatgaatgctgttaatgttaacttaatgtatatgcctatgaccttgtatctgagtactggccctgtgtttctgatccctgcagggggtgggcagtagggagtggctaggggatgtggcaacctgtcgctaatttacaaccctcaatcatgaggtaagaattggaaaatcattccatcattccaggatgtccgtccatcattccagggtgtccatttgaccactgagtaagagcccatctctgccctctggagctcccacgtgatccaggaagagaagtatatgaacaagccacaatggtttgaggtttactgagcagaccataaaaggaggtggaagctccgttccatgaaagaacagataaagaggaattaggctcaaaacaccttcttgtgttggttttttccctttctcaactagattttgggttcttggaggataaatgttgtaccttcttttgtctctcctatgacacttagcatgtctggtatcttggagcatacagcaggtgctcaatagttgcttgtgcttactcatttgaatgcctacagggcctgtaacatgccttgcagatgttaggtatttggtttttgttaaataaatgaaattgatattctct

SEQ ID NO: 171440 - DNA, 352 bp, Homo sapiens
tggacacgtgacccaggcttggccaatcacagcattatagagagccctgttgccacaccatttcagcaacaggcatgtgacccaatgagatttaattctggaactttggtcacaactattcagttcagtgaatctctgtttgctgagagtaggatgtaatcgtggcactgctggcagccagcttcccactgcaagcagagatgctgcctgagaatgagaccaagacagagggggaaacagaactgagagatggagacatgaaaccaagtcccagtggcattgcatgagacatcagatccagtcttgcttcaatcttcagtcacattagcaataaattccctctattgcctga

SEQ ID NO: 171441 - DNA, 358 bp, Homo sapiens
agtttacctgtgattactcagaaaatggattcactgatggctacctggacatctataaaaataagtagactttgtacttatttcaggcaaaggcagtgttagacgtgaaagtttctgtctgcattaaccattaccttcctctctatcagacactcattctgtgagaagataattggtgcatgacagtgatttggatattgaagggccttttcattgtgtattgtagagagaaccttatgtgggtggttaatttaagacttctgtgataagcccctattccggaggtggaggaggatgctggacaggctttgctgagacagtcttaaatttcagtcaaagtcctgatagtcacctaatg

SEQ ID NO: 171442 - DNA, 293 bp, Homo sapiens
ttaccctgaacatgaaaacaaatacaacattatttatattgaaagctcatagatgccacctcccccgccttatttgagaaatattgattttccgtgcattatgacctaaagattttactttagttctaataaaaatcttgcattatctgcctttttactgtagatattttagcttcatgtgttttatgttttttgtaatctctccttctcccctcattttaccaagttatacacccccagttactttaatgtcctaaaagttttgtttttatctctttattattattatacct

SEQ ID NO: 171443 - DNA, 368 bp, Homo sapiens
gaggtaagggtgggaatgcttttttagcattgattgatttcccacaattgcagtctgagcaactggaatgtaactctctccattggataagtccatgatagtcctttgcttctttgtgatacatttgacttggaatatagtggcaggttattatttgggtgaaaacactatgctaagtcaatgaaaaatgccaaacctggattctcaagatgaatgctctttcattcatctcagtaaaacaaagcctaaaacaaacactcagatgtgggtgtatatttaacctgtttaatagcaattatgatatgtgtgattaggttcacttccatattttctgtgtaccaccctgtattgttcatagaacttttctt

SEQ ID NO: 171444 - DNA, 502 bp, Homo sapiens
agatagaggggaaccatgcaatgagcattttcaagacagcacacggccagactgagaaaagaggaagaacctggttgaataggcatcatgtgtgacacggttccctgtagctttctggccagtatactttgcattctgtggctgttacttagtgatacaaagcattaaggaattgggagctatcacctgtgaatcagactgatttctactgttacactggcatcaggtctctattgacaattttatagaatcaaattcacgttgcagaactaactttgcaacagatcataccatagtaacaataatagctattaaactttgtgccttggcactgctaaacactgtacatatatcatcctatttagtcttaacataaagccacagggtgcaatggctcacacctgtaatcgcagcactttgggaggctgaggcagacggatatcctgagcccagaagttcaagaccagaccggacaatatggtgaaaccttgtctctatgaaa

SEQ ID NO: 171445 - DNA, 364 bp, Homo sapiens
gcactccagcctgggtgacaaaacaagactccatctcgaaaataaataaataaattaattaattaagtagagctgagcatggtgactcactcctataatgccagcactttgggaggctgaggtgagcagattgcttgagcccaaatgtttgagaccaggctgggcaacatagggacaccctgtctctaaaaaaatacaaaaattaaccaagcgtggtagctcacacctgtggtcccagctactcaggaggctgaagtatgaggatagcttgagcccagaaggtcaaggctgaagtgagctatgattgttgtgctactgcactgtggcgtgggtgacagagcaagaccctgtctcaaaacaaaac

SEQ ID NO: 171446 - DNA, 235 bp, Homo sapiens
gtggacaagctgccgtctacaccttgctttccccatcataaaatggagataacagtgacagtcctgccaggttgctgcgagcgtcggggtgccttctccagctccccctaccctggccaccctgtgttcaccaggaggactgaactcgtggagggcaggggtggcttcccttcctgtccgccatggcctggcctggagtagatgctggaaactgaagtggcagtctctggacccc

SEQ ID NO: 171447 - DNA, 419 bp, Homo sapiens
ctgacactagtgcctcccagggaagtggaaagtgtaaggaaagagtgagtgaaaatttgaaagcagaccattcagtggagtgtgcatggtgagggatagttcttgggcactgagcctggaagaggctggcactcactccatgggcactcctgcctttctcttcttgcctcacacttggtaacagcaggaactggttagggttaggcaccagaaagatgtgactggaagcacctacagtgagtgtgggacttacatatagcttaccatttgcttgtggggtgctccaacctgctgattggtgctttgaagtctacagttaagggtgaaattaaatcccttaaatttattttccttgttttataatgattttcttggttatcaaaataacatattttcatcatagtacaaaatacagaaaa

SEQ ID NO: 171448 - DNA, 155 bp, Homo sapiens
gctccctcctccaaactgccaaaagcttgtggaagtccctgggcttcctaaaggaccaggagggagggctcaacctcacaaagcagggagtctgcaggtgacagacagaaagaacagctcctcctgagcctcagcaggccctgctgaactgtatc

SEQ ID NO: 171449 - DNA, 805 bp, Homo sapiens
tctccagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggctttcccgggagaggttcaagtcagaagatgccccaaagatccacgtggccctgggtggcagcctgttcctcctgaatctggccttcttggtcaatgtggggagtggctcaaaggggtctgatgctgcctgctgggcccggggggctgtcttccactacttcctgctctgtgccttcacctggatgggccttgaagccttccacctctacctgctcgctgtcagggtcttcaacacctacttcgggcactacttcctgaagctgagcctggtgggctggggcctgcccgccctgatggtcatcggcactgggagtgccaacagctacggcctctacaccatccgtgatagggagaaccgcacctctctggagctatgctggttccgtgaagggacaaccatgtacgccctctatatcaccgtccacggctacttcctcatcaccttcctctttggcatggtggtcctggccctggtggtctggaagatcttcaccctgtcccgtgctacagcggtcaaggagcgggggaagaaccggaagaaggtgctcaccctgctgggcctctcgagcctggtgggtgtga

SEQ ID NO: 171450 - DNA, 674 bp, Homo sapiens
tctccagggaccactggagactggtcttctgagggctgctccacggaggtcagacctgaggggaccgtgtgctgctgtgaccacctgacctttttcgccctgctcctgagacccaccttggaccagtccacggtgcatatcctcacacgcatctcccaggcgggctgtggggtctccatgatcttcctggccttcaccattattctttatgcctttctgaggtgagtgatccccacctccccaccatgtctccctcccgccctcaagggaggcagcagggcagggtgggaagcattcaggttgtgcagcctctgaccgttgtcccctccacacgttagtgtcctcatcccaaaatggggttgggggttgaaatgtgtcagagctatttcaggagcaagtggcagaaactcaactcaaattggcttaaacataatagggaatgtgtggttcacgtaactgagaatagcaaatagcaaatagggttcatgtaattgaaaaacccaaggtgcatggacttctggcagggttcgatccagggggtcaaaagaggtccccagaacttggtctccctctacctctcacagctttgctcgccccttgacagtcacatcgggcagctttaccaccctcaggggccctggctgcctcaggatgcatcatagctccttagctgc

SEQ ID NO: 171451 - DNA, 559 bp, Homo sapiens
ttgaccaagtcacaacggctccagaagaaggagcttgggactccatttaggatcctcccaagggaacaggctcgcacaaaaatcctagggccacagagaggggtgtattttattctggaaaaagatgcagtttggcaatgccagcttggccaaatgtcaagtcaacctcatttgtctccatgctcttgtgcagcccctgtgctggcatctcccaccacaagcacctctcttccctggcaatggttgcatcaaaaaacaaacaaacaaaaaaaacctgttggccaggcacagttgctcaggcctgtaatcccaatactttgggaggctgaggcaggcagatcatctaaggtcaggaattcgagacaagcctggccaacatggtgaaaccccgtctctactaaaaatacaaaattagacaggcatggtggtgcgtgcctataatcccagttactcaggaggctgaggcatgagaatcacttgaacccaggaggtggaggttgcaagtgagccgagattgcaccattgcactccagcctgggcaaaaagagcaaaatcctga

SEQ ID NO: 171452 - DNA, 217 bp, Homo sapiens
ttccttctgcttctgcctaacgaagccggctccatcctcccttcctccttcagcatgccaagccagcctgacttggcctttcctgcctacaaatctaggcaaaaataagacaaagcaaccctctaaaaatcatccatcgagattacattactttcaagttgttatttatgaggttggttgctgccactagaataaaattctctgctcagggtcttag

SEQ ID NO: 171453 - DNA, 611 bp, Homo sapiens
aggccggtgttaatcggccgagggtctgtttgtgtatctgtttgtctcatctactagggcaggggctttttctggaagggccggagaataaatatttttggctttgtaagccagaggtcatctctgtccagaccactctgctttgccgttgtagcaagaaagctcccgtgggcgagtgtgcctgtgtttcagtaaaactttatttatggacacaaacgtgaattccgtgcaatttttacattataagacatttttcttcttttgctttttttttcctccaacgactaaaaaatgtcaaaaccattcttagactgcaggctgtacaaaaacaggtggcgggcaggattgaacctgtgggttgtagtttgcaaatacctggctagggtgtgagggccacactacggaaagctatggaaaccatgtcagcctcacgacccctagaatgtacggcagctccttagacgtggtgggtgttgagtggacattccttgttgagtgaatgaatttttttttttttttttgagacagagttttgctctgtggcccaggctggggcgcagtgggctgatctcggctcactgcaacctccacctcccggattcaagcgattc

SEQ ID NO: 171454 - DNA, 465 bp, Homo sapiens
catttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtc

SEQ ID NO: 171455 - DNA, 595 bp, Homo sapiens
agaaatactgtgtagctgcaatgataaaaagtgagagttaatgaagctgtgtgaatggagacaacagacagtacattcaaaagtgagtgagacttttctttgatacaattctcattatttatcattacaataggttcaagaatattctcaggagggtcctaacattccttttaaacaataaattcaaccccaaaccaaaggatcccacaatatatagcagcagatgtatcctaggaaagtcttccaagttgaatgttctacttggcgccttcttaattctggtcattcccaggggatttatttctcactcttgaatcttcagctgcttttgtttttgaagcatacgatgtcacatcggtaatggtaattgactgttgccttcctaaaaatatcttaggcttcgtttcccaaccatatcattttggggataggaagtgccctagattccttaaaatgtaggattctttatagtcagaatggtacacgtggttgtgctaaaaaggtgacgcagcaagtttggtgccgagcgttcaggacacagaaaatgcacagtgtctgtggaaggctgttaggactgaaataattgcataccacc

SEQ ID NO: 171456 - DNA, 561 bp, Homo sapiens
cttgttaaatccaggagacagctgtcatgtgagaatgaaggtccagtgctgctttccagctctccaaggaaaactagaaatccagatttctatattaaatcccctgatagcttgaggctggtaactaattcagaacattagagaactgtaggggcagcaccaaacacaaacatgtgtaggatacaccctgagttactaggttgttacttcaatggagttttctgtttctttgaacttcagaaattataccaagatacatctaattaaaaactcttggctggacgcagtggcttacgcctgtgatcccagcactttgggagtccgaggcaggtggatcacctgaggtcaagagttcatgacgagcctggccaacacggtaaaacctcatctctactaaaaatacaaaaaaaattagttaggcttagtggcgtgcatgcctgtagtcccagctactcagggaggctgaggcaggagaatcccctgaacccaggaggcagaggttggggtgagccgagatcatgccattgcactccaacctgggcaacagagagtaaactctgt

SEQ ID NO: 171457 - DNA, 1028 bp, Homo sapiens
ttttggtgggttttggccggcttctgtaccacaacctgttttagcagtaaggcctttatgacctgtatcttgtgctgacctcttatctcatcctgtggctaagaatgcctaacctcctgggaatgcagcccagcaggtctcagatccatttgacccagcccctattcaagatggagtcgctctggttcatacgcctctgacaatggcgtgtggggtcaagggttaactgagctggttccctttcggcaaggtaatttgatcgtgggttgactttctagtcctgtttccctggtaacctgagaaagttgtctatgctactcgaacaacatggcttatgataaaaataaataatgatggggcttgtggaggcttaaggaataggcttatccttggaggaggctggggaactccccgtctccagctccagtggtccaagggtgtggaagagaaacagccaccacttgagaggctcccaaggaaactgtggtttgtcccacagcacagcaaatgtggctcatggattctgggtcccaaaacagagctccgtgggtcagaccatcccgaggcagaggctggtctcagtgggagcagccgtgcacggctctgcgtgagagctctggtcacccagagccagtccagctcagtaaccaagcaaaccacatgctcttctttcttgaataatattttccacaataacacgccttaaggaaatgccaacgaagcccggcccacaggtcagaaaaataatgaggtcatttaacaatgcagacagcccgagactgaggtagcatttgtggccacattcttggacatgacatgaaaccatcttcttgtatttcagggtctcaagaggccaaagtctccttcatgtgttaattcggagctcagttctgactggctggtggctgctccttccagagttatcagttttggagctgaagcagctcttcagaaagacagtggttttcccaagacagagcaaggctgcagctggttgctaagcaaagggggatcaaaacatctgtctg

SEQ ID NO: 171458 - DNA, 279 bp, Homo sapiens
gagcaagacagagctgctgccttcccggcctcacgcaccctgcccaccagcccctcggaagcatgtgacgacagcagagggtacaccagagacaggacagacacagagagaagacgagagagagggcagctgcccaaataacccctgtgagccccgtggctgaatggcaggtgagatggggcctggcctacactggacagatggggaacctgaagcccgaagaagaaacaagactgactcctccagaaactgcattgtgggttatgggtgtgcaggggc

SEQ ID NO: 171459 - DNA, 215 bp, Homo sapiens
gataggatggcagatggcaacacagagacaggacagacacagagagaagacgagagagagggcagctgcccaaataacccctgtgagccccgtggctgaatggcaggtgagatggggcctggcctacactggacagatggggaacctgaagcccgaagaagaaacaagactgactcctccagaaactgcattgtgggttatgggtgtgcaggggc

SEQ ID NO: 171460 - DNA, 292 bp, Homo sapiens
acaggggcctcccagcagctgcttcagtgggcctggcagggcagtctggaaccaggaaacatgagcctttccaaagtgacttcctaactcccaaagcaataaatcacagtggctgaccatggatacaaagcccatgggctacaagagctcttggacttacagggtctgagagtgaccctagaccctgtcagtccgtgtgctttgggatccccttttaggcagcacatgctaaggaatttgggctttattctggaaagcattagggatccagccaatgattttaatcaagaaa

SEQ ID NO: 171461 - DNA, 983 bp, Homo sapiens
tgatgttatccccaacaccattgtcccatcttacagacaggaaactgagcccagagaggttaagcaacttgcccgaggccatgcacctggtcagtggaggtacctggctggatgcccactgtgatgtcagagccacttagcaccatgtgactaacatgctctgttgtaaagcacaagtggcaccttgtaatccgtgacctggggtctctgagtgctagtggtttcccttttaactgtaagcccatttggcaaggttgtgtgctgggcacccaggagccgggccatctttaaggaccttcctgagatctggagtctgacaggcctgggttcgaatccctcttctatactcactaatcactggggttttctaggccttggtttgcttctctgtaaaatgggcctaatgctgcctacctcagtggcctggcaggagtgaatcagcccgagatctggtggatacttagaaaacatttaccaccttcagaccccctcacccaggcctctaaagctgtggtcctcaaacctcacagtgtccttccctgggaagaaacagccctccccagaagtgctgggtctgcatgcctgggggctttaaacgggattctgatgggaggtgctgcaggaccaccactgcggtaaggtttctgcaaaccttgtacaaatgggagatgttggcatcccccactgtctcttcccagggcccttgctgcttttcctttgtggcatccatcacacttgtaattacttgtttagcatctgtctgcttctctgggctgcgtgtgctggccttgttcatggctgggtccccagcactgagcagcctgcctggggcgtaataagtgtgtgttgggaaaacaaacaaacaggcgcctggctggctgaataaatgctcggatgctcttcagagcagctggactcagtgtccccccaccccaaggcctgggttctgacacaggctctgcggccacacacttcttgtgtga

SEQ ID NO: 171462 - DNA, 443 bp, Homo sapiens
gcttttacaaatatccatacattctctttgttacacaaaattgattatttttctttaaatttacttgagatgaaacatttttaaaagtttctactaaaagtaaaagcattaattgtacaatttcccttatctttatcagtttcgttcctctcatgtgaaaaaaagttataattgatatttttaaaagtggcatgctgtttactttgggacttgaaaaataaaatagctaagttccctgattcattaaatttaatcataggtaaagcacttacttctcaccccatgagtaacagcttatgtcgaatcaccactatcttcctcatacaagcaaggaaagtcactacagctatcttttgcagaattaaacaaaacacatattcttgccaatgtatttctgactcctaattttaatgtattaaaatgcttaaaagctgtttttaaca

SEQ ID NO: 171463 - DNA, 216 bp, Homo sapiens
actattaataatcttgacgttgccaaagtcacccttgttcagggacttagaattttcacaaatcctatgtatgtttatatttgaattatttcataacttttaaaagcaatatagcagttgatcactggacttaagcaacttggttttggctctttctcttactatctgggtggttctactcagcttatttaatgtccctaagacttagctccttca

SEQ ID NO: 171464 - DNA, 349 bp, Homo sapiens
tctgaaatgttgatcaaggtctgagctggctcaaaacctgggaaaagacttcttagactgctgaactatttaaaaagaagcatgccggcacggtggctcacacctgtggtcccacctattcaggaggctgaggcaggagaatcacttgaacctgggatgtggaggttgcagtgcaccgagatcgcgccactgcactccagcctgggaaacagagtgagactccacctcaaaaaaaaaaaaaagtaaataaataaataaataaataaataaataaaaagcagcacattactgcatgtttacctagcatctcagataaagaaatcagagtgaacatgaaatgctaaattag

SEQ ID NO: 171465 - DNA, 143 bp, Homo sapiens
ggtagtggtcatgaatcttcgggttggtctttgataaaaaaaattgcttctttcaaatttagttataaaaactctctcgttccaataatttaaatgtttatcacaggtagtagccaatattctgagcttgaagtttcttctct

SEQ ID NO: 171466 - DNA, 202 bp, Homo sapiens
gggcgacaagagtgaaactctatctcaaaagaaaaaaataatcattggcaataattgctatcctattgattgattgattgattcagagtgtcactctgttgttcaggctggagtgtagtggcttgatcttggctccctacaacctttgcctcttgggttcaaacaattcttatacctcagcctcccaagtagctgggattac

SEQ ID NO: 171467 - DNA, 298 bp, Homo sapiens
tccatcacctcgccatctccaaacattcactcaggtcttctgcaggtgaatactggaatcaaagtttacctttctctacaatttgcaacaaaagaactgtgcaggccaggtgcagtggctcgcacctgtcatcccagcactttgggaggccgaggtagaaggatcacttgaggccaagagtttgagaccagcctgggaaacatggcgaaaccctgtgtctacaaaaaatacaaaactcagctgggcatggtggtgcactgcacaccaatggtcccagctactcgagaggctgagatgg

SEQ ID NO: 171468 - DNA, 230 bp, Homo sapiens
actctagtggatccttatgttatccccaacaccaagcaagataaagaacattttcccctgactccacaaagttcccttgcatgtcatcccggtcatcccaccctccacaaccaggcgatcactattctcatttattttcctcttagatctagactgttgtataaatgaaataatgtaatatgtactctgtgtctgatgtctttaattgaccataatgtgtgagagattaa

SEQ ID NO: 171469 - DNA, 201 bp, Homo sapiens
aaccatgttgctcaggctggtctcgaactcctgacctcgtaatccgcccgcctgtgcctcccaaagtgctgggattacaggcgtgagccaccgcgcctggccaacttgcttacattttaaagtgctttgggttgttgggtcagagtatgctattattattattattattattattattattattattatttattttttttt

SEQ ID NO: 171470 - DNA, 368 bp, Homo sapiens
tggaaaaatgggtttctgagacattttaaattattccttgcttgtctttagaggcaaaattcagataagaaagcttatcaattatacttttgtttctactcaaaaactcatgactgctcactcaaagactccttgttcttatcttaaaacattgtttacagtgtcccagatgaatggcaacaaatcctggggtttggtgtttggatggtacatttccctggggaaagaaataacagtttgagatggaacggggttggggtgggagaatacttctcattctgaggaatatttaattttgccaagatgagcatttctagttcttagtctgttgacgaaaagagctatggtttgtttctggaacttttgat

SEQ ID NO: 171471 - DNA, 184 bp, Homo sapiens
gaaaaaacgaacaaaaatttcctaagtctgcccactcaaaagtcctagaagcagcgacaacccaataacaataaacactcctaggaacatagattgtattctctaaaaaatgcttctggccgggcgctgtggctcacgaggtcaggagttcaagatcagcctggccaatatggtgaaaccccgt

SEQ ID NO: 171472 - DNA, 415 bp, Homo sapiens
gaaactccttgttggctcaactgctcttcacagatgcataattttggagtccatacaccaccctggtcactctctttagaatacactccagttttgtacatttattctattttcaactgtatgttaattttaaagtacagcatgcaacatgaaaattaacatgcacacaatgagaggagctgtgttaggcgaaggagcttattgatgattactttgctttttcaaaaattgtgtttaatgttggcatataccccatcttccatagaaataaagtagggtgttcaggatctaatttcaaatgtagactagtaatctcaaagtgtaatgggacaattatatcccttgttcaggagacaaaattgctcccaaaaccttcttttgttctgttttttcatggcatattttaagcttaaaa

SEQ ID NO: 171473 - DNA, 160 bp, Homo sapiens
aacaaaatctgtattacttttacttattatggctatgtgtataattatatgtctagttttcttttttttaacagttaacttgatattctataccacttgaatatttttaattctggaaaatcagtttttcctagtgctcccttttccaactcttctcact

SEQ ID NO: 171474 - DNA, 245 bp, Homo sapiens
cacttaaatctctccacattttttcaaaacatatgggatataaactatgttctatctttaacttgaaaatccttcaaatttaacatcagtttctgtgttaaaaaacaaaaacaaaaaacaaggctcactgctcaaatgcttaatttgtaaatccttcaaatttagtgtcagtttcaattttaaaaaacaaaaacaaggttcaccactcagacataacttttcacttacctgcgctattctcttct

SEQ ID NO: 171475 - DNA, 220 bp, Homo sapiens
tgacaacaaaggaatggtcaaggcctaacaaacagaaacagcgatgcaaattgcctaggagatggagcggcagtcactggagctggcgttgcccagactttggttggcttcagggtgacagttcaagaaggcagctcctcctgtgggccagtgagcttgctccaagagcagccctttccagctgacgcccagagtgacccaaaggctctcccggaaagtc

SEQ ID NO: 171476 - DNA, 366 bp, Homo sapiens
atttcggcacgaggaccacatgtgcatctcagatacccatggccctattccacttccgtgctgcacttgctagcccctcagcagtaacaaccttcctctgtccacttaacactcaaagactagctccactgatcacctaccccaggccaagtgactgtcacagatgaccacattggcacctggccttatcctccaggttgaataaacaccctaggccccatcaaagtcatcaaaaaatcctggtgattccacagagtgctgaataagcacaaaggaaaaaaaggacagccatttgcctcaaatacacctatgcctctgcatccaccttatatccactcttcccttgaaagtgcactgccaccccca

SEQ ID NO: 171477 - DNA, 194 bp, Homo sapiens
gatattattccctgtgatgggtgtagcaaaagagtaaatgtgaggcaaggcacatttttctttaattctttatcccctcattctccacaccttcaccacataagatagtataagtctattagacttagtgaatcgttgaagtaacttaaggaaataatattttaggaagagggaaaaattaaacataacacagt

SEQ ID NO: 171478 - DNA, 605 bp, Homo sapiens
ccattgtgccacaactcactcagcctgagagatgatcccaaggctgcttgttgaactgtgggaatggttgctcctctgtagcaatccttgagtgaagcccaagggaaggctaaacctcagcccaggcaccgacacccaaactcaaattacccttcccaggttagagcaattggtctcagcttggatacagctcagggcaagcccctgtgcttcacagccttgctctttaggaagtccgtagaggaacccagctccactggtccctcaccagtgtggtctccaagtccttcctggagagccattctccccaggcccaggaagggaaaaaagctcatctggtaactgctggcattagcagagcagataccgggtgagagctctgtctctgcaggctggaggtggagccatgtggttaactgctccccgccaccaagctggctggtcacatttgcagagagaaccttgactttgtcatttgattataggtagaggcattcctaattttcacttgtgatttattattgttcttttcccattaaaataattttcttctaagatgcaaagtactaagtatttgttatagaaaagttatgataatgcaaaca

SEQ ID NO: 171479 - DNA, 233 bp, Homo sapiens
tggcaaagtaagtgcaaagcatgcaaggcgggcagtcaggagccgggggagatccaggactaagcactggcaagaccaggtactacctggagtgtctgatcccagggaggacttagacccttttttaaagggctttcaactgataaaatcaggccacttaggatactctcccttttgattaatgtaaagctaactaagtagggactttaattatatcagcagaatctctttat

SEQ ID NO: 171480 - DNA, 467 bp, Homo sapiens
caattttttatttattttattttttttagtagagtcgaggtcttgctatattgcccaggctggtctcgaactcctgagctcaagccagcctcccatcttggcctcccaaagtgctgggattaaattgtccttccttgctttatgcgcgttcattcagcagatattcaccaactacatggttagtgtcaggtctgtgctaggttcttaagatacagagatgggtgaagcaaggcccctgtctcacttgttggaaacatattattgtatcagtcatttgggctgctagaacagaataccacaaattaggtggattaaacaacaaatctgttttctcgtggatctggaggctgatagtccaagatcaaggtgttggcaggattggcttccgatgtggcctctcttcctagcttgcagccagctggcttttcagttagtctgcgcatgtacactcctggtgcctcttattc

SEQ ID NO: 171481 - DNA, 385 bp, Homo sapiens
tcagctctctgatgacatatgcagtggcaaccaggctcggtggctcatgcctgtaataccagcactttgggaggccgaggtgggtggattacttgaggccaggagtttgagaccagcctggccaacatggtgaaaccctgtctctactaaaaatacaaaaattagctgggtgtggtggcacatgcttgttatcccagctactcaggaggctgaggcaggagattcactagaaccagggaggcagaggttgcagtgagccaagattggggcactgcatttcagctttgggggcagagcgaaactctgtttcaaaaaaacaaaaacaaaaccaatctatattggttctaacctttatctatagacaaaagcattggtttatgaaaac

SEQ ID NO: 171482 - DNA, 379 bp, Homo sapiens
gtgtttcagctgcccattctaagatacatttaaatggatctccaaaaagtcccctagtcaaatatcaagccaggatcttacactgtgattcagaaagaaagaaaaaaaaaattggcctgtaatcccagcaacttgagaggttgaggtgggaaggtcacgtaggccggaagtttgagaccgacctaggcatcttagtgagacactgcctcaacaaaaacatttattaaaaaattagtcaggtgtggtggtgcacacctgtagtcccagctactcaggaggctgaggtgggaagatcatttaagcccaggagtttgaggctgcaatgagccataactgcaccactgcactccagcatgggtgacagagtgagatcctgact

SEQ ID NO: 171483 - DNA, 229 bp, Homo sapiens
cacctgtaaaatggaggaagtaatacctttgttgcactgatatggcaagaaatagaaataaaatgtataaaacaactgggacaaaaacagccctcaatgaatgatagttgttagtttatcaaataattgctttaattattttttcccccggccctttcttagctgagggttcggaaaagcatctgttgctccttgaggttttcttttcttctgccctgaccagagcttc

SEQ ID NO: 171484 - DNA, 474 bp, Homo sapiens
gctatttgctgaaagacacctttggcaggactccaaagagtgggcagaaccacatactaagctatttttcaaagttcaggtgtcttcaggaattgtccataataaagataagtagaatttccttacaatggaatggtgcagaaatctaacaggcagagaaagaggggaaaaaaccttaagcaaaggtgtggcaatataatctctttctctggcattatctttttgctgccagttagattcttttagtcttgcaattcccttatacaggaaatgagaaagatgagtggaaggagacgataagaggagaaatttcagagcaagggcaagtgtgttaaatgaatgactgcctacagtagggtgtgtccaggaatgtctgggggtgtgtttgcatccttagtttatgcaagttatgcaccaaagctttgcatccttagctatgcaagccattttggtggaagtgttgtttctcatact

SEQ ID NO: 171485 - DNA, 556 bp, Homo sapiens
tatttagtatataatatgatacaaactatgaagaacataaaggctatttgtaacatatggtgcccaaatctaaactgggatgaaggcacaagatgtcccagcactgtcctccagtggtgtcctggcctaacaccatcatcctaaatttcagttctaatgccttagcaaatggccagggtgtcaacagaaaagggatggacggcagtgacgacatactgcagtccaagtgaaatttgagtagagagttctaatgtaaatgactattttaaaagacgtttgcagtggccagacatggtggttcacacctataatcacagcattttgggaggccagggcaggatcaattgaggtcaagaggtcgagaccagcctggccaacacagtgaaaccctctccatcataaaaatagaaaaaattaactgggcatggtggtgcacacccgtaaccccagctactcgggaggctgaggcatgattgcttgaacctagaaggtggaggtcgcagtgagccaagattgtgctccagcctggccaatagagcaagactctgtctcaaaa

SEQ ID NO: 171486 - DNA, 528 bp, Homo sapiens
gaggtagaatcactggattgtgggtccttgtgaagacaaaggactgttgaaacctaagtactaaacgacatgaggaggactgataggagagagtgcctgggaaataagaaactacagtcacaggaagactaaagcttggtgagcactagtctaacatgaccatgacagaggaagaataaatgacagtgtcaccaagaaaacagaggtctaagaactgagagggtggggcattcaaaataacctgacaggggttgacaagtttttttttttttttttttaacacaaagggccacagagtaaataatattaagctttgtagaccaaaaggtaaaatcaaggatactgtatacaaactcatataagagagaaaacaatttccacaaaaattttattaatgaaattcaaactatgataataataatgcataacttttcaccatacagttctactaatgaaaacgctggaattctcttttatagggcttcaaaattagcattccctatcattaaaatcaattgtaaatgtatg

SEQ ID NO: 171487 - DNA, 520 bp, Homo sapiens
gatcacctgagcccaaaagatggaggctgcagtgagctatgattttaccactgcattccagcctgggtgacagagtgagaccctgtctcaaaaaaaaaagaagtagcttgtcctgccctctcccaagcaactgtcaacttgcttggaaccagtgttcccattgctctggaggttctatgctgaggctggtgtgatcatgagttatcgaagatcccatgctccaggttcacgtttcctgaataatgctgcttagtaagtcatttcctatgtcatcctcccataccccgccgagctttgttttttgtttgatgaatggaaagactgcatgaacagaagcagcatgggaaaagatacacgtatgttatttggggctggcccccctctgcctggccgctggtagtcacccttgtggggacacctgaatcccagttcagaaagcactggcatcctaggtactcgcgaaaggtacctagagtgaacgtggcaaggctgggcctcggagccacaggacactgtcatc

SEQ ID NO: 171488 - DNA, 524 bp, Homo sapiens
tcaggtcctgcggccactctagtcattcatttgcccaaccctgactgaatacctcctccaagccaggccttgttcagggcactgggcagagcacgctgagcagaacagacaaatcaccctgcactcaaggagcttatcacttccaggtgaggaagatagacaacaaatacatcaaaaaaggaaaattgcagtatgtcaagcagtggtaactgccaatgaaaaaaaataaataaataaagtgggcgagggggaataagatgttggaaagagtgaccagaactgtaagcggcgtgaccagggaagccttccttcagaaggagcctactgagtaaagaccggaagaaagtgaggaaacccctgagcagacatgtaggggcagatgttcttagtagaagaaaaacaagggcagagaccctaaggcatgtgcccagcaggtctgaagaagagcaacaaggccaaccaagggatgttttcaaaggactccttttcctgctctattagtgatggactagggagtagcatgg

SEQ ID NO: 171489 - DNA, 673 bp, Homo sapiens
gcaaatgaaaccccctcccccagagttacaggacagcagcttcccctgttaggaattaagtcaggagtcaaacctgagacgggctaacagacctcactgcaggtggaacaaatgaaaccccctcccccagagttacaggacacatttttaggtcttagacttcaatatttaaaatatttgtctctggaatttgaaaataatatgtatgccttgtttactggattaaaaggctaatcacttattcatctgattagtaatcaaagtgtctaaaatttatttaatacttgatgttactttgttttatataaatgtgtatttctacgatagttttagtgtcatctaatattattttcaatgttgtaatttttatttatatgaatctttgtgttatacatcttaatgtcactggtattaaaactatatgtgcaaatagcttgaaatagcacctaacacatcatggattctatgtaaatattcaccactctatttcatcacattttaaccaattcatactattcttcatttgctaacattttatttgtcctcattcaaatttgtgttggtgtcctgtctacatattaataaaagagaggaggtaggcccagacttccatctcgattaaatactaagacattttcctagttctatttatacacaacattacatttgtctc

SEQ ID NO: 171490 - DNA, 244 bp, Homo sapiens
gattacaagcgcccaccaccacacccagctaatttttgtgtttttagtagagatgaggttttgccatgttggccaggctggtgttgaactcctgacctcaggtgatctgccccctcagcctctcaaagtactgagattacaggcatgagccaccatgcccagcctctgccctgtttttatcagtttacctttatgactgactgaggaagtcctgaagttgcagctgctccacttctgagtgatc

SEQ ID NO: 171491 - DNA, 358 bp, Homo sapiens
tgagaatcagtatttttacatgcctactacacataacacttgttctaatacagggtatttcttcatagttgcattagaatttgagactttttttttggttcctggccagagacaatttatgcaatttactgtgaaactaaatggagctggacaaaaaaaaaaaaaaagttcacttaaacttgccaagaattgccgcttgggggtatacaagtttgggcatttgcttaggactgttgctctgaattccttgagggaagggggaatctggatgcagtttcagctagaaacagatttgtttgctaataattgtggccgtgatagtgtgatgagtgagatcttttttcacttgtccacctct

SEQ ID NO: 171492 - DNA, 346 bp, Homo sapiens
ttgaccagctccctcactccaaaatcataccaattccagtatcaatctctcataagctttatcctgctgttttacccaaaccagacctctgtggcttctacctaatgtttttctttgagacggagcctctctctgttgcccaggctagagtgcagtgatgtgatctcggttcactacaacctccgcctcctgggttcaagcaattctcctgcctcagcctcccgagtagctgggattacaggcaccggccaccatgcccggctaatttttgtatttttagtagagacagggtttcaccatgttggccaggctggtctctaactcctgacctcaggcgatccgcctg

SEQ ID NO: 171493 - DNA, 799 bp, Homo sapiens
tcagtggtgcaatgatagctcattatcacctcaaacttctggctcaagccatccctccgcctcagcctcctgagtagctaggactgcaggtgggcaccatcatgcctagctaattgttagatcctttttttttatgttctgcattttttcagttatttttacatatttctctcttgatccatgcagttataggatatatccttaattttagaaagtaaggacttttcgaccaggcgtggcggctcatgcctataatcccagcactttgggaggccgaggtgggcagatcacttgaggtcaggagttccagtccagcctggctaacatagtgaaaccccgtctccactaaaaaataaaaaatcagcccggcatggctgtgggcgcctgtaatcccagctactcaggaggctgaagtagaattgcttgaacctgggaggcagaggttgcagtgagccgagatggtgccattgcactccagcctgggtgacaagagcgaaactgcatctcagaaacaaagatgcctagctttcaccttgttgatgtttttctaaattttggaataataaatttatataggaatactgcaagaatagtccatttttttctgatgtcccaacatcaccaaatgtatccatcacaagtaggaatacatggaaacattaatgccagccactaaccattcatgtttacccagtagtcccaataatagctttgtcacacaaaaacatgattatgttggctgggcacagtggctcctgtaatcctagcattttgggagcccaaggcaggagttcaagac

SEQ ID NO: 171494 - DNA, 391 bp, Homo sapiens
  misc_feature (333)..(333): n is a, c, g, or t
ctcattttcctcagtctcattggacgacttcttactgtggtgctagagtgagcctctgcccaggtcagctcataactgttgctgtgagaccacagactttaggagaactggaagtttaggatttcttcagacctctctttcactttttccagcattggcacaagctgactagttaaggttctgcatttagaggtaggtggattaggaacccagaacaggctgctggaagtaattctctggttgtcacaccttatttagctataagtgttcaatgtgaaccaaagccttatgaagattgttagccttttaccctgtttctccctcgtcctcccnagagtgctgggattataggcgtgagccaccacgcccggcctttacctcaattttttta

SEQ ID NO: 171495 - DNA, 172 bp, Homo sapiens
cacagccgcccgggcagctgcaaacaccggagcatactcacatactccggggtgcacactgacgcgcatcccccgggtctccctccattttccatccccttccccagctccctcctgtcgccccagtcccctctccatcctcatcccgttccccatccccggcgcgcggccg

SEQ ID NO: 171496 - DNA, 284 bp, Homo sapiens
gagacatacattacaatcattcataaaaactgtttttaaaaaaaactttaaaaaaaaaagcaaaaaagtattttatttttaaattcaggagatattaacagtaaaaacaaaaatatgaaggggaaggatatacactaacttcacatagcagatactcctagaaagaaagaaaaaatggaataagaaaaaagttatccagtgagctttacctctatgttttacagtatttgggtagaggcagtttagcccacagtatgagaagattactatctgttaaatatgga

SEQ ID NO: 171497 - DNA, 259 bp, Homo sapiens
catttttttggttaaaagaagatttattcgaaatcagcctggacaacatggtgaaaccccatctctactagaaatacaaaaattagccaggcttggtggtgggcgcgtgtaatcccagctgttcaggaggctgaggcaggagaatcgcttgaacccgggaggcggaggttccagtgaactgagatcgcgccattgcactccagcctgggcaacaggagtgaaactcctattgcccaggagttttgagagtgaaactctc

SEQ ID NO: 171498 - DNA, 764 bp, Homo sapiens
gcagtgagctgagaagatcacgctactgcactccagcctggacgagcgaaactccgtcaaaaaaaaaaaaaaaaaaaaaagacctgtccaggctcaagtgctccttcctcctcagtcgctgagactacagggcgtgccgctacacctggctaattttgtgtcttttttgtagagatgggggttttgtcatgttgtccaggctgtccttgaactcctggggtgaagcaatttgcctcctcagcctcccaaagtgctggggttacaggtgtgagccaatgagcctgcctactgttattttaatggcataaacatcacctccagagcttagaaaggagagaaagaaacttaggcaattgatgtggagctctttattaaagaaaccagctgttagtttacccttcagcaccttgaatgaagtgtgaatttctgttagtaaaatgaaatacctcttttcaaccagaagatggggctggactcccttggaaagaaactgcagaggctcttttcgggaaccggtttcctgtgctcgctttgcctgtagtttctgtcactagtacccagctgtggtcactagtacatcagaaatcacacagcagctccaaaaatatactgatgcctccacccagaaattctggttccataggtctggggtgtcctctaggtaagtgattctcaaactctactgcacattggaatcattgggacacttagcactccaagcccacactgaaggaatcagcatgccggcgaagaagccaccagcc

SEQ ID NO: 171499 - DNA, 330 bp, Homo sapiens
tgaagtgagtaagtgacttatcaaaggtcatacagctaataagtgacagccagaatttaagcccagacagctgagttcttaacagcattattatatacactaatgaaaacatttattttccagaaaggacattaggttcttctttccagtctcccactgtaaacctccttatcccatgaccttgcctcttttcaataggatgtctgctccccaggggctcttcaaggaaggagctcttgaggactccaggacttaccctcatgctttttcctgctagcagagtctgagatctccaccaaggctcattcccagtcactgctgataactttt

SEQ ID NO: 171500 - DNA, 156 bp, Homo sapiens
tggtttggacatattaacctcttcgggtctgtttcctcatctgtaaaatgaggtagaaattagatgaatgcaagtaaggaatttacatcaatgtcttagctattcagaatgaatcacagcattctgaacttggcagaaaacaacataaagagccag

SEQ ID NO: 171501 - DNA, 249 bp, Homo sapiens
catagaaggaggtggcagctgtctggggcttcccagacagcaagcaggagaaaacccgtgcacagacactccatgtgcatcttcatgggtttcagttttgccttccactagatacctttacagcaggggaggattttattatttgtcccctacactttgccaactcctaacaggggctgggagactgacagggtgacccaggtcaccacgggggagatttctgctcagggagtagcggtaggaggaggc

SEQ ID NO: 171502 - DNA, 615 bp, Homo sapiens
accccggatcgctatcgcccaacaccaacacaccggtatgaaaagtgtgtacaccatttataaccaattagaaaatgtatgaggaaatagactctcatccacaatagctgcgagaagtaaatattatctagaaataagattaacaagagaaatgtaaggcctatataaataaaaggataaatctatgctagagggtataaaagaaacacaaaaatagaggtatgccatgtataagacccaacataataaatagttctaccaaattaatttataaattcaaagcaatttcatataaccacagtaaagctttttaaatggatgtaataacctgattataacattaatctgagagtcatcaggcataaagcaattttgattacatctcaaaacaatccatggtgttggggataacatcacgtgatgttatccccaacactcatcactgatgataccagcactttacaaataaattgtttcaccatgggaacttaaggccataccactcagctgcccaaagcaaacacagcccaaggcagtgaagcttcatggggaggcagaaggatccagccaagcagcaattagtgaccagagctgtggtggtgttgggcgaggaga

SEQ ID NO: 171503 - DNA, 359 bp, Homo sapiens
tgggagcacaggaaaatagcacagggtagctgttcaatgtagaagccaaactcagaagattagcagaggacaggttgataatcaaggtccaaactcaatatttgaaaagaatagtagaatagtgcaaaccttcagcaagttgactaggaggaaaacaagaaacagcacaaacactgatggtggaagcaagcaaagccggggatggagcggatttgacaaccgttgagaacaccgtgttcaacgtacacaatgcattcgaagtcctagatgaaatggacagttttctaggaaaatataaatcaccaacatatgctcatgatgtagtggcagatgtgagagtctggaaaccagagggggga

SEQ ID NO: 171504 - DNA, 250 bp, Homo sapiens
ccctcctctcccggagagggagcaccgccgagagtttccgttccctttgccattcccttccccctccttttcttttattttcgagagaatttcttcttggcttattggtttaatttgatttttaaaattttgggttgcttttgtgtatgtgtgctttttttttctttcctcattttatttgcatccagagcatggcgggctgcgggctgtcggaagacaccctcttctcttccttcttttacaactacgg

SEQ ID NO: 171505 - DNA, 198 bp, Homo sapiens
cttttccaacaacacgcattaatatatacaaattttacttaaatatgcctgaaatttaagaacaactctaaatgactattaaaaatatccacacattaaacttttggtttagtagtaaccccgatcttttttttttttttggggtcccggacccgaattcggaaaccggggcaaaagtggtccctggtgtaaattggc

SEQ ID NO: 171506 - DNA, 536 bp, Homo sapiens
tgcctcagccttcctaagtgctgggattacagacgtgaaccactgcgcctggctgacaactagtatctttgaaattgcaatgcatcttacaattgatgtgatcagaaagaatagtgtcatagtttaaatggcagttttttaattgataagcagtttttattgttaggcaataaaataacagtgcgtcttagaattgatgacatattaaagttgataaaatacaataatgctaattatttattttctattcaagttgtaagaaaatttatgaatatctgttgtccttgtagtgagtccatcccctgtcctctttaaactgtctgggccgatttcagtgattctgttttgcttcacccaaaccaggcttatatgcccatcaacccagaattgctctcacaattgtgtatactttttgctcctcatttagaaggaccagggattggcagtagttgctcctatcttctccccatcttcttccactcttccctctacaaatctttataggctcatgtcccctggtgggcctgtgtggcaga

SEQ ID NO: 171507 - DNA, 289 bp, Homo sapiens
tgcccaccctccttcctacctcgagtgaagagacaggggcaggtggccagccaggggggtgttcagtgacctcacgggtccagcatgcacagggcctggccccacagcccagcacccctccccacctggccttcacagtttcttctgcacctggtgacaggtgacattcacctgcacgacactcccgcgaacctggtgacggactggcagctcggtgaattccagctgagtgcctgtgattccacccccttacctcccactcaagtgacaatgtaagcgtgacctcgaa

SEQ ID NO: 171508 - DNA, 587 bp, Homo sapiens
cacgggaagtgagggttaaagggtcagtttgatccaggtagaagctttttggcaggaataccttgtagttgatgctgtgaactcacagtgcattccctgggggctgcaaggtcaggttgtcctacgattcatgatggtgagttttaccatttgttaaggaatgactaccagatccctctactgcagagtttattttcttcttatgaatattaagcatctgagaggtggcatgctgcatggtaatttgtttcctaataagcttccaccctatggttttagaggcttcactttgatcaggtatttcattggttattgcaaagtcatggttgtctaattgttccctcttttacatttattagttggcattcttcttaaagaaaagtgtttttgtctttctttttttagtagacagagtcagtgatttatatttatttagtgtattgtcaattcagtcattatcttttgggtgttgaaatcatcccggatttagccagggagggctcttctgactggctccggtcccccagggacagacccctcggcctctgttgtgccctcctgcacctgcctgccttttgctttcctac

SEQ ID NO: 171509 - DNA, 329 bp, Homo sapiens
gagttgtatgaatcatgtgagagaaatttatgacagtcataattagtgcaggagtaaaggaaataaagaaaacggaccaaaaaatttttacaaggtaggaaaaacagggcgtggggagttagagaaaataaagggactagtactactcctgggtttctgttctgaaactaggtaaatagtgaaactttttgctgacacagagaatacaataagaaaaatagattacagtaacagatgacaggtaactgcgaccaactaagtgacacatattactatattccatttttaattatagttactcatgtaattatcctattctgtacatcatt

SEQ ID NO: 171510 - DNA, 404 bp, Homo sapiens
agaatagccctcaagtttcctgaatcctgcaccctctaggagcaactacaactgtgaaatcaagctttgattaatgtcagaaatacgctggatttgttaccagctaggaacttggaagtaacaggaacttgcttctgaaactggaagtttggctctggatggcctgatctttgtagctgtttctgcccaaatggattctcatctcatttccttatattaaaggaatttgtgtcttttgcttgggtctgtgggtatttttgctagcattgtgtagtagtcaagagaataggacatgagcaagggtatctgcatttgaaactggctctgccactttctaactgtataatcgtgggcaacttcacttctgttcttcaatttcctctcttttctgaaatgagggtatt

SEQ ID NO: 171511 - DNA, 165 bp, Homo sapiens
aagtaacagtgaatatgagaaacacgaactgtgcggttttgttggtgtgcagggaaagtgaggcggagaagtggaaagtaggggcggggctgccttatggcacagctctgcttatgctattctctgggaaatcttcccgtggctcccagctaacttagcatccag

SEQ ID NO: 171512 - DNA, 672 bp, Homo sapiens
gttttttggttggttggttggttggttgttggttttttgtttgtttgtttttaaatataatttcatattgggtaaaacaaaaggttttccttaacttgtttagaattgtttaggaaaatactagttaggaatctgattttttttctcccccatggatttgtggttagcatgtttgtactctaatattcatgctacattttcatgtttaccaatataaaaaccttttttgtaattatttatatggagtcctgctttgagttaacatcatagaggaacgctttttttcagcaaaattgttttaaattaatgtttctaaagtgtataaaaatggttgggtggattaaaagcaattcagtttcacatgaaccatttgtccacatggaaataaatatgcagcacaattacacggcagaaggtacgaaaaggtgttgctgaaatcatgagaaaatgtaatacaggcggacgtcagtctccacaataaatttgcatatgtccttttttgggggcaaatacagtcatcattttaaatgaagtcgaagagttatttctgtaaacaaaacaaaagtcctccttgtcatactagacagcaaggaagcaaaaattgttagggtcatgtcaaaaagactcaggagtcaatttgaagaggttctgaccagacaataaatataataa

SEQ ID NO: 171513 - DNA, 496 bp, Homo sapiens
ttccacccatattcacaccataaacaaaaattaaagtacatgaacctaaatgttaaaccaaaacctataaaaattttagaaaaaaatcataggagaaagcctttttgactttgaattaggcagatttcttagataataataccaaaagtacaatccataaagaataaattgacaaattgtacttcatcaaaattaagaacagtatcttcaaaagatattgttaagagaatgtaataaatttgctatggtttaaatgtcccctccaaaactctggtgaaatttaatcgccatcgtaacattattaagaggcaatactgttacaatattacagtattaagagatggaacttttatcaggtgataggttataagggctctgctgtcattaatggattaatgccatcatcgcaggagtgggttccttataaaggaataaatcaggctgagagtggtggcacgcacctggagtcccagctactcaggaggctaaggcagga

SEQ ID NO: 171514 - DNA, 305 bp, Homo sapiens
cttgcctgagtacagacaggttttcctgactctaaaattcaagctattaaccgcagtctctccaactttaacattcaaatttcccattgtgaatgtctgaaaaatgcttacagttctttttttattattattatactttaagttttagggtacatgtgcacaacgtgcaggtttgtcacatatatatacatgtgtcatgttggtgtgctgcacccattaactcgtcatttaacattaggtgtatctcctaatgctatccctcccctgtacccccaatgcttacagttctagagtgaccaaaaaaa

SEQ ID NO: 171515 - DNA, 632 bp, Homo sapiens
gttactgcactgctgtaatttagttcgaaatgggactgcatgatcgatacctccacctttgttctctttgcttataatgcactagactcttgctctggctttcaggctccataccaatttggaactaatagaattttcaactctcaatggacattttaccaataatggtagtttaatgggaatagcattgaatctgtaaattgctttgagctgtatggctatttttacaatattgattcttctatccagcagcatggaatgttttccatttgttttgtcatctctgatttcattgagcagtggtttgtagttttccttgtagagatctttcacctccctagttagctgtattcctaggtattttattctaaaatagttgtttgccagtctgagaggacaatctgttaatccttaggaaagtaagatggtaaagccaggaaatggtgagaaatttagaacgctccaatttaaagttatacaaacattaacactttttctatagaggatcaaattgggatctcattaagatggcatttgccatgttaggaatgggtcaattgaacatttagatcatcagtttcaaaatcatccaagtatttaagagtagaaacagatgttgtgcatgtgtataa

SEQ ID NO: 171516 - DNA, 411 bp, Homo sapiens
tatcatgaggaatggaagtcagccatactgttgctccaacatattttccacttcttgctctgcaaattcccaaaacatgttcatagggcccttataaatcccttcttttaatctcaacaacttatttgcccctaagaatgaattagctatcagttatttacaccttacttggtatttacgcattttattatctctctccaatatttgaagtttaggtggtgctcattgagacgtaaagcctttccagttatattgaagcaaggtcttaagagggacagaaattcttcacggaatgtacaaaaatggtaccatctggatggctccctaatttgccaacaaataggcacaatgttatactagagggccagagttcctaagatatgatggcaagtatccttccttaagaactga

SEQ ID NO: 171517 - DNA, 130 bp, Homo sapiens
tttatccatcagggctcttttagtaccaaaaaacagaaaacctgactccaatgaacttaaatgaaactgaaaggtccaaggatagatttttaacttcaagcacaccttgatccaggagctcaagcaatgg

SEQ ID NO: 171518 - DNA, 198 bp, Homo sapiens
accaatgaagattaggacttttgtgacctggaggataggatacttagtgagcaagttttaactgttggggaagagaagaattcaagtgggctgttggtggttctgagatgtaggggccaagtacaaagactagggtgagacctctaggagctaaaggcagcctgaggctggcataaattaagttaaaccattgttagg

SEQ ID NO: 171519 - DNA, 352 bp, Homo sapiens
aaccccatctctactaaaaacacaaaaatcagccaggtgtggtggcgggcgcctgtaatcccagctactccagagtctgaggcaggagaatcgcttgaacctgggaggcagaggttgcagtgagccaagatcaagccactgcactctagcttgggtgacagagtgagactccatctcaaaaaacaaacaaaaaacacagctcattccctagattaaaattccttaaaggatgctctgcgattgggtgtcagcctctctcctattatcatcttttacaccttctcctctgctttctatgctccaagaactaagtcttttgtctgttccttgaacatgcctagctcattcctgt

SEQ ID NO: 171520 - DNA, 406 bp, Homo sapiens
ctcccctaagaagctctgtagtaaacatttgaaattttcctgcctttttaacgtgtagattttttcatagctctggtgtcactttgacaaaatttgaatatcagttgtatcactaaggtattgctcacctctaaactcacgtaatatgcctgaacatatttttttacttagtttactatggtgggtataagattgaatatatggtagtttgtttttactccctcttatagaatttactttctgaaatactagcagactttaaaataagatgttcttatatcgtatttactgattctccattaaactcttaatccttagctatccaatatgtacatatctaaaagaaatatataaatttattgtaaattggtttatatgttaaaatcacagattatttatataatgg

SEQ ID NO: 171521 - DNA, 641 bp, Homo sapiens
ttattcctgagagacacagataacaagggcaattgaaaccatttgcaagatcttccacagacctccaccaaaggctcacaatatgcgaacatgggactgaagagagccctcctctgtggtgcagtgctggaggaagggagcagcttctacaatgggaaaaatacgaagccccaaccagatccttctcttctagggaacaaaaactggaagggactagtggaggaacagcaagcccagttacccgcaaggcacaagtgaatgcgggggagtgaaagaaaaaaaaactctaccactgtaggggaaggaaacagtgttggacccagggtcttataccaaagacattagagatcttactaatgtctctaataccactgaggcaagagcagagaaactcttttccagataacaccgacaaagataaaaattgcagtctggcctagaggagcaagattactgatagagtcccactcatgaggccaaggcacataagccaaacgctgagaactgatcaggaaaattcagaaacaccttcccacatgccaactaccaatctaagcacaaagtaacacgagagaaatttgaagccaatggcgcacttaaggtaccctctgcaacaacaaaacagaaactcagcttaactc

SEQ ID NO: 171522 - DNA, 390 bp, Homo sapiens
gcagtgagctgagattgcgccacttcactccagcctcagtggcagagtgaaactccatctcaaaaaaaaaaaatggatctcttatccgtctgtgagataagagatcctggccgggcgcggtggctcatgcctgtaatcccagcgctttgggaggccaaggcgggcagatcacgaggtcaggagatcgagaccatcctggctaacacggtgaaaccccatctctactaaaaatacaaaaaattagccgggcatggtggtgggcgcctgtggttccagctactcgggaggctaaggcaggagaatggcgtgaacccgggaggcggagcttgcagtgagccgagatcacgccactgcactccagcctgggcaacagaacaagattccgtctca

SEQ ID NO: 171523 - DNA, 691 bp, Homo sapiens
aagtccacagcagcgcagcagccaggggtcattagccagtccatcttgcaaagtcatcagtctcaaagactggttcttaaacaagtgagcccagcccttttcccggcactaaacttctagctgatgaagagctcctggccattgggtacagggatccccgcaaggctcaggcgacgctctgatgccagaatactgagaggggaattcaaaatgaacacctaaccagaaccatcctgcccatggactctttcagccacagtcacaattgatgactagttctaagaagaaatggctcttgaactgttccggggagtggaggatgagacgacttttgagttcttaagtggggcttgaatgttacttttggagcaaaagtagtccaggaggtacctctcaaaaaatggctggagctagatactccctgctttgcaaactgcaacacgccctggctgacgagtccagtctgctcatatacagctctttcttatctaacattttacctaacaattttcttttccacatttgcaaggatggctccctttttacttgttgacaggggttgtgcaggctggagagttggtgtcttagctgcccattaaccttgttggaaaacacactcacttcacttgtatcaaagagttgctggaataactgatgaaagaatgcaagaaataaatagttattcatagga

SEQ ID NO: 171524 - DNA, 305 bp, Homo sapiens
cctcatcttgaatacttccaagacaggaaaatactgcctttcatggtggctatgtcatgactggatgatagaaagttgtttccagtggaaatctgtgcttctgcaatttctacacttttatttaggttctgcctttcgaagtcatacaaaataaatttactctttctattccatataatagtactttatatatttgacaagttttctgaggtcccctttctttttattagcttccagcctcttagcatttttgacattcctatctatgatgcttaacgcttctaagtgtgtgtgtgtgtgtgtgt

SEQ ID NO: 171525 - DNA, 132 bp, Homo sapiens
ctaactgagcataattgcgctccaaatgtactattccagtgcagcaatcctgtctgtagcaatagggaccagtcacacagcctgaatacaaaaagatagggggctcactaacaaggttgcctattctggtca

SEQ ID NO: 171526 - DNA, 390 bp, Homo sapiens
tcctagccagtgttttgacctcaaagacatcaaaaactgtcctatcgactgctgtcatttggctcaggagcccaaggtcactgtttgtttggatgttgtgtaatcatgagagtaaagtcatcatcagtatcatgtaattaatatattatttaagcagtcatttcaaggggaataatttgatgtggaaagataaaaataactctggttcttccattaattcattaattcattcagcgtaccaagtacttggctcactgccaggcactggcatgcagagacctgtgcattttattcagcatcctaagatgtttcagaaaccaattgtttttcctgaaaatcagattatatttcccaactcttactcctttctctgagcctcaatgttcctaa

SEQ ID NO: 171527 - DNA, 430 bp, Homo sapiens
ccagtctctaggtctaaggaatggctctgagcttactgttccacctgtacctgtatgatcagcgccgtcaaatgaaggaactcaggagccctcttcaccacctccttcctccagccttaccttaggggactgcttgaagactagcgagcattccctttccgtgacatcacgtgcctccacccctcaactccagtggctggaacaggaggctaagcatctcttgggcagctagtatttaaagctctttgctcatttctatatgtgtgtcttctccccagagaaaaagatggcaaatcatcatggaagagggatgagagattgaagaactagagttaaaattggggtttggagagggttacagcttaaggaaacttgagaaacgacctcttagaatagaatcctaggattgactaaaaagcatttgcccaga

SEQ ID NO: 171528 - DNA, 301 bp, Homo sapiens
gacagagcagagtggtgctggtggcaaggagaacagagggagaagcacagcagggaggacacctggggatctggagtgctagagagtggggatgagggtataacagggaagagagaatgtaacagggagagcagaggaggcgctgagatgggagaagaggcggaaatatttgtgttaggggaaactgaagaatggagagaccaatatgagagaaacagaattgtttattttaggtacgcactggctcagtggattcatatccaaaaagctgagcactgaacaaagacagagcagggttttt

SEQ ID NO: 171529 - DNA, 346 bp, Homo sapiens
actccaggatcttcccctccatacatgcatcagcttctctccttcctcacataggacagcctggccctgtccagcccaggggcttccagccctattccagctcactcagccaagaaagggctcatcagaaaccagagatgttagaaggcagagggcagtataaatgataaccaacatttttttggtcacctttacaaattgctgctcctgtgtgcagccttatggcttctcgtggcccatcacacacagaagtgtcacagataacacttcatgtcagtatcacacaaactgacctgtcttccctgtgagtctcttctctaagcaggtcacctgcagaggtggggca

SEQ ID NO: 171530 - DNA, 437 bp, Homo sapiens
  misc_feature (430)..(432): n is a, c, g, or t
cagccttgacttcctgggctcaggcgattttcccatctcagtcttccaagtagctgggactacaggcacttgccaccgtccccggctaatatttttatttttttgtagagatagagtcttgctacattgcctaggctagtctcaaactgctggactcaagccatcctcccacctcaggagttctgggatcacaggcatgagccaccatacctagcctagaactgtcactttcttatgcctctttgctttctctttacttccattatgggaacatcattctccataaagaaataaggtttttttcccttcataagtattactgcctacagaagcgataagcagagaacagagctgcagggagggcagatgttaggttttccgctggggtctgttctgttagtgccctgcttaaaatgctccaaaacatccnnnaaccc

SEQ ID NO: 171531 - DNA, 394 bp, Homo sapiens
ttaggagagtggagagagcaggcagaggtcagagtacacatggtgaaaaaagagaaaagctgctcagcctcatgggtgtgcctgttggggtggagctcttgcaggtgtcaagactgatggttggaacaactgaatgatgagagtgggaggagaagggcagaaatacacagaaaaaccctatgttgtggttctgggcttcctggcaccttcagagctgtgtggctggggaagagagcctggaaaaacaccatcgtggccatccctctgtctccaggcaggaggtcttaaaaccattttatatttcactcatttgtttaattctctcctaaaatgctccacagcttctctagggttcccctcaccaccctgacaaataaataaatcattaagttga

SEQ ID NO: 171532 - DNA, 527 bp, Homo sapiens
attacacaagtccagttatacactttatttttcaatgtacaattattttttactacagatcgttttgtgattgtaatatatcaaagtataattcatatgtttctgagtcctgaatgaatacttaaaaaaaatgtttcatatttgtctttgaacatgtagtgtcttgtcctgcaaacacatacggacttttcatttttatttacatgaagttaaatatataaatgtattgctctaaaaataaaccgttaggtgtaagaaaattacagagcaagcaatagtgtttgtgtgagagtttgtacctattttccaaagaaaagatcaatattggaacaaagaagattcttttataaggtggataatttactagaaatctagaaacctaaaacattgtgaaatcaaatctatatttctttggatttaattactgtaaaatctaattgttgagactctccccatgtaaattgttttcatttgttactcatattacagctataatttacttgtttcttcttttgtttttactttat

SEQ ID NO: 171533 - DNA, 230 bp, Homo sapiens
gcggtcgaccagacaaccagtgtgccaggtgccacggaaatagtgccatcctcagagctgtctccccccgggtttaggcacttagtccccaaatcacaaactcctagaactggaagagccctattagaaatccggaccagcccattgccctttctctctaaggcagtgactctcagcttgggaggagatgatgacagtcttggacagggttagagcagggtagctagagg

SEQ ID NO: 171534 - DNA, 327 bp, Homo sapiens
agtaaacaggccattccagcacagtaagtattgtgataaaagatgtacagagggctgagaaagctcctaaggtcaggaaaagggtattacagtgcctttagaaactactggaagctcagtgtggctgaagcacggaagtcaagaggaatagagtgggaaaagaaggggctggaggtctaaaggctgcagtgggccatatcaccaagagccttgtgcagtatgtgcagaagtacaaacacagagggcagtgggaaactaactaatgctttaatccaggttgtgacatgatataatgacctggtggctttatggagaataataggttac

SEQ ID NO: 171535 - DNA, 485 bp, Homo sapiens
tgtgattggaacagttctccagaggaggagtattcttcccagaaggaatgaaggtcctgtggaggcccaaggagcagatccggccaccttatcctgtgtgaggagctctggaatgcattgctgctttccaggatagctcccaagcagggagaatccccttccactgcccaatcatggacagcatacagaatgactgcaacagctgggcacatcaaaggatactgtgtagttgtccatgacctcatatggctataggtattttataaacaacatgggaagatggctgctgagggggaaggaatcttttctgatgtgcacagttcatgtttctttgcttggcatagccaaacaccagtggatggtatcatctgtgctgtgaacagattctgattttgaactccatgctcttctagagaggaacagtccaaggaccacagtctggcctggcttttcttggtgcatggggcttcctgcacatacatgct

SEQ ID NO: 171536 - DNA, 413 bp, Homo sapiens
agaggagtcaaatggctttgaaatataattggaggtatagtctttaggacatggttataaataggatgtgtgggtatgaggaataatcaaagatgatttctaagtttccagcttcagcaactgaatggattgaatacctatctctcaagagttagggttactgtgaggaattcagactataatatttatacatcacccagcaccagggccagtacattaggtgagtggctataaacaggaggcttcctcaccattactgcattactcttcccccaagaaaccctcacacagagcaggtttaatgacttctctgtcctcatttttcactcacctccatcacacagaatccaggactattctcttcacttttttcccacacagtttgcctactcaaatactcaggggaaaaaaaa

SEQ ID NO: 171537 - DNA, 452 bp, Homo sapiens
caaggcccccaaggtccactcctgctagatctggtgtggaaatagaggagggagtgaaaatctggggggggctgaccatgtcagccacaccaagctaggggagcctcagccacgtccacaccaccttctgtggccactcctggagacatggattaaaggttgatgcaggtgtgtctgtgttagaaggcgtttcaagatgtgactttagctgtaagaggcaggatatgtaagtccttgcatcccctttagaaagccgggttgtgactcctactgcctcaggggtgccttggccctcctggtcttgcccaggctgggatcttcctggatgcagctttcacatcatagatagtctgcatacacaagaccatttgcaaaggacatactgaagattaagtcatatattctatcgagaccatcctggctaacgtggtgaaaccctgtctctactaaaa

SEQ ID NO: 171538 - DNA, 341 bp, Homo sapiens
ggtcaggctggtctcaaactcctgaccttgtgatctgccctcctcggcctcccaaagtgctgggattacagacgtgagccaccgcacctgaccttagtttttttctgacgtggtcctcttcttttatctctaagacttatgattgctaagacaacaaaagataccatcgttactggccaaccttggaatttggtcttgggaaatggaggcctgtagtttgtaacccataagaagagactgaaggggcctaagtgcagatgagaatccctggtgatagaacagacaagaactggagatcaatgccaatagtttgtgatgaacgtcttggggttcctgtgtga

SEQ ID NO: 171539 - DNA, 320 bp, Homo sapiens
agtttcaaaggacatggagtaaatatcttggcaataggaaaaaggttaaaggctttggtgagagactggatgggggcagagcatgaggaatggatgtgaagcaggtgccatcaactgagagcgaatacagaagatgcaggtacatcaggacaaggagatgcagaaaggaagagccagcaccaaacacagtacctgcaatgtaagttttcaaccaatgctgcaagaattaatgagaaagaggcaaaagtatgtttcctcctccttactatctcataatcccatgtagtttaataaatataagtactagccaggtatcttcc

SEQ ID NO: 171540 - DNA, 241 bp, Homo sapiens
gagtgtgtatgtgtgtatttgtgactgtgtattagtgtgtgtgaatgtgtgtatgaatatgtgtgaatgtacatatgtgaatatacatgtatgggtgaattcatatgtgtatgaatgtgtgtgtgtgaatgtgtgtgttcatgtgtatgtgtctatgaatatgtgtgtggttgtggatgtgtgaatgcatgtgtttgagcgtgtggatgtgtgtgtgaatgcatgtgtgtatgagtgtgtg

SEQ ID NO: 171541 - DNA, 757 bp, Homo sapiens
acagacccgccccggcagcccggcccaccccaaatcatgtgtgtgtgctggggggtgggggctagtggggcagaggataagcaggctggaagagccgactcctacggctgcgatccaagaggtgcctgcaacagttgccccccgacttctgtcgcccccatggaggcaaacaagtctggaacagggaatgggggtctgggagagaagatgaaaagactgaggatcagagaggtgagcagtagctttcccaaaggcccagagccaagaagcgttgaagcttaaaagcacgccgcggcagggaagatcaagcaagccctgcgcctatctgcagcttgatctctctgtactgagccatggagctccttcttggaggcgtgaaatgctccccatccttcaggagacaacagcaacagccagccactccttgtccagtcagcaatgctggaatacctctgcagctcacagtccaacgcccacagccttcgagtcagtttcttgatattcggcaatgcactggactcctgatcccatcagctcctggctgaaggtgggccaacccttccccatttccttcaattcaaacatttcctcatgtccctcagtgccaagccctgtgctgggagctgaggacccagaggtgagctagatctaaaatctgacctcaaggagctaacagtctgagaggaagactggagtggataaaaataccttggtaatttatcacttaataaatatccaataaatgctattatgtgcc

SEQ ID NO: 171542 - DNA, 216 bp, Homo sapiens
aaaaagagctcacaattctgtcctccctggaagctacaattcaatcatcctcttccaaacgtccaaatcccagcttcagtgaggctatctcacacagcaacctgcctgggagtgacctgcatgcaaaacttcaagagtttgagggaaacttgagggaaacttgcagaaaccagcttgccaaggaaaaacgctcccagtgcgttcaatgaaaaagca

SEQ ID NO: 171543 - DNA, 496 bp, Homo sapiens
tgagccaccacgcccagccataaacctacttctcttaacccaataacctcatatcagctgttgtactatagtagctctcttgttatttgaggggatggggggagtgtagccagcgcagcccacctgagggtaattgttctctactttttaacctactttttcatacttcctaaatgcagcctctggtttttaacccattatgtacatctttcatgatctcatcagtcaatccagaatttgaaatatttactattgagtttcttactttactgcaaaatttagcatttgtttttgtgccttattttatttttcaaattttacttcagccaacactattgatcctttctcttctaactcagttatagtcaaaccactaactgattaaggggaaaaaacagaagcttgattgtgatgtttcattttgcaaattaactaaaacctaagaaaatcctgggtatcccttgaaattacagtaaaatcttagtaaagatcttcg

SEQ ID NO: 171544 - DNA, 580 bp, Homo sapiens
gatccctatgggtcctcctagccctaaacatctcgagtacaagtatcagaacccgtactgcatgggtacaatgaaggtgttacgatgagcaccttttaaaattttgttttatttggtgttcagtttttataacaattttcttctgatgtaataggtgagataaggttttacaactagattcctcagtaggagtatttcctatatatcaatgaaaagaatggagaggggaaataaaacagctatggtgcccaacaagaacactacatggccaaaagcattccacagcgagcgcgcgctacgataggagagaatcattggaaaggaaactagatttccaccattttattctttttcctttcttatcctctcctacagagaaaagcccagttttaatcttcacttaatccccaaagagatagcaaaagccacagcaatccttacacatttttttttgttataaagaaatggacaaaatattgacaaggcactgtttttccacacatatcaccaatcttatttagcactgtggatgccgttttgcaaatgtcacccaccatcagccctcgctccgctgcggccg

SEQ ID NO: 171545 - DNA, 480 bp, Homo sapiens
tattaaaaggaaacaccttgggcttctaatgaagacaccagaagggccacccaccaggagctagggcaacactcctgtggggaggacagaacggaagccgtcatcactccaaaacaaaaccctggtagggtctcactgggctgctgttacgctggaccctgccaaaagaaaacacagccctgtgaagaaacatcagcaccagcttctaccatctgtcatttacaacgtccagcatccatttaaaaatgacaggctgggcgtggtggctcatgcctgcaatcccagcactttgggaggccgaggcaggtggatcatctgaggtcaggagttcgagaccagcctggccaacatggcgaaacccgtctccactaaaaatacaaaaattagcgaggcgtggtggcgtgcatctgtaatcccagctacttgggaggctgaggcaggagaatcacttgaacctgggaggcagaggttgcagtaagc

SEQ ID NO: 171546 - DNA, 267 bp, Homo sapiens
cggcacgagggctacctctcctgccgggctctggggtcaggcttccctcccccaactcccgccagatgccactctgtaaaccctgaagctgtgctcccacgctgcactgcaccgcgcacatgaattccccgaggaatttcttaatgcgctgattcagattcaaccgtgggggtggcccgagaccctgcatttctaatcagctccaaggaatgcgagaccacgctttgagtagtagcatctaaaacatgatataaatgtaggtcatga

SEQ ID NO: 171547 - DNA, 665 bp, Homo sapiens
tatgtgtgtagagctgatttagtattcccttagtatctttttcatgtctgcagggtctttaatggtgtctcctatttaattcctggtattggtaatttgtgttgtttttttttcttggtcagtcttgctagagttttgtcaattgcattgacttttacaaagagtcagcttattgtttcactgattttctctgttgtttttctgtttcctgttcattttttcccactcatatgtttattattttcttccttctgcttgctttgggtttgtttgggtctccttttgctagcttcttgaggtaggaacttagaatttgatttgagattgttcttcttttctaatatatgctataaatttcatgaacacttgaaaagaatgtgaattctgctgtagtacagtggaggaaggttctacaactatcactttgatcttgttgattgggtatattactgagttctgtatccttgctgattttcctgtcctattctatcaattgtggagaaaggtttgttaaagttgtattcagttataagtgtggatttatgtcttctttcttcagttctatccatttttgcttcatgtattttgctcctctgttgtttggtacacgtttagaataactatgtcttcttggtggagtcctctcttacattatgtaatgttct

SEQ ID NO: 171548 - DNA, 390 bp, Homo sapiens
gctggcgtcgcggtggtccacgtgggcatctctgttggtcagcgtttccatgccttggtagcaggctccaagcccttccctgccctgtgtgtttggcatcttgggttggccgccataccgtatcacctctgtcataggcagtgtagtctttgggtctctggaggactttaaacgcttccttagttgaacctcagagtcagtttggcctctcccttgcccagggaggaaaccccctctttccagccttccagccaatgaacagatggtcagtctcgcaatgtgggcagaatggagacaggaaattccacctccgtgccctagcaccagcagtgtaaggagtgtccaccgtgagccagatgctgggggagagtcaccagggctgacaggcca

SEQ ID NO: 171549 - DNA, 677 bp, Homo sapiens
ttgccaagatcagacagcttggttagataataatgccacacaagaaatcaaatctgttatttacagcccagtggttgtttgcttcttcacagcccacccttcctcctttgaagtgtacgacacacctagatttcttcttggagtgatatagtggaattcctcaaattcttctcataactttaaaagaatgtggtatttgtattagtctgctcaggctgccatgacagaataccatagactgggtagctgaaacaacagaaatgtattttcttacagttctggaagctggaagtccaaaatcaaggtgccagcaaggttggcttctggtgaggcctctctccctggcttgtagacagcaaccttttcactgtgtcttcacatgatctttcctgtatgtgtgcagactcctggtgtctcttcctctttttataagggcaccagtcctattggattacggccacatctttatgaccttatttaccttaattacctccttaaaggccctatctccaaatatagtcaatcatattggagttatagctttatcatatgaattcaatccataacagtattcatcttcaggtccttaaaacacttcttaaatcatttggtgtttttttttaatttaaagaaatatccaggtagagaagattataaataagtttccttatgcttat

SEQ ID NO: 171550 - DNA, 329 bp, Homo sapiens
aagtctcacctaccagactccaccctgtcaccacaggaaaccaaaatatcaggctatggctggaacccaagtgctgaaacacttccgaaagcaaggggtctgttgtctctgaatgttgggtgataacaaccccatccccgccttgccatcaatagatttgtttgaagtccttccaatcaaaatccacccttccagtgcttaccaacctgtccttcctaatccttaaaagctgccccaaaccccatattggggagacagatttgagctggactcctgtcttcttgtttgtcgacttgcaataaaggtttgcttttctcaaaaacctggtg

SEQ ID NO: 171551 - DNA, 432 bp, Homo sapiens
taggcgtgacctatgggaagctcacattcctgactcttttggcatatgccttccagagacagcagtcacatcaactggaaaagaagacaacactctaaaaacaacatctatgaaagaatgcctctgaaactgtgtccacttctccccttcacccctgctcctggctcagaaactatcaacagtcagctttgtctgccagtcaagctcccatccatagatgggcactgagcccgccccacacattggcctggtcgcctctttccttgttttccctggcatgagtttcctagggctgctgcaggaaacaccacagctgcatggcttaaagcaacacgaatgtgctctctcacacttctggatgacagaagcctgaagccaaggtgccagcaggccacactccctctgaaagtctaggagactcctcctttgagt

SEQ ID NO: 171552 - DNA, 305 bp, Homo sapiens
agtaacatcagcaccacctgggaacatagaaatgcagattttcagccccactccagacctactgaatctgaaactctggtggggcctagagtctgtgttttaaaaccatctaggtgactctgatgcaccccgaagcttgagaaccactgtctacaagtacatttcatgactcaatcgctggttaaggctgctgacctcggcctttgtagttgatgagtcattaacattgaggccttaactttcctggccatctgctttccttggtgatatttattcaaaacaggtgacatttattcaaaaactat

SEQ ID NO: 171553 - DNA, 642 bp, Homo sapiens
cgaatcctggctccattactttcttacagtgtggtttggggcaagttacctaccttatccaagcctgtttgttcatctgtaaggtagggtgatagcaccttgcagaattacaggattagagataatacccataacatacctcacattgggcctggaaagtacccagtgtgtgctatcttcatctcttcacctctaatccttagtgcagtgctgtgctcagtaggtacactataaatactggttcagcaggttagggaacaaattactccccatgcccaggtagttttcattttaaaagcagaactaatgaggcccaggtctaacccaaagaaaaaggcctaacaatgggatctgagaccctgtgtaggacgggagtacagtgagaagcttggggcatgtgtgttggatctccttagtagaagcccacatcctgcccatgcagggtgaaaatgacccacagttgtcctgatcctgaagcccctccttggttcccatgaggagagcaggaaatggaagggaaacaaggttgacagctcctgggccctctggacttcctgccatcccaatgcccatggctccctgagctgggccccaggaataggtaaggacagagaggcaacagcaacaatgaatcatgttgga

SEQ ID NO: 171554 - DNA, 477 bp, Homo sapiens
tcaagtgttattttgctagaaatctgaacagcagattcattaagctatcactataagcagaaccttttctacggttcagtccaagagacttctcagagcccaaatatcgtttatatccccttcctgggcatctgtgccatgaagaaggtataaggggagaggaactcacatttcctaagcacttaccatgtgccaaatcctctaaatacactgaatcctcacaataagactgtgagagggggattttttaaaaacccattttacagatgaagaaatgggctcataaaggttcaggatcccccaaccaagtgtcagagcaaagatgagattccagacctttctgactcccaaccattggctggggctgaaatgcttccgttgccagaagggagcattccccctgaccgcccagttcaccacgctcctaccacagcccactgcactctccctggttcacatcacccaagtacattccca

SEQ ID NO: 171555 - DNA, 231 bp, Homo sapiens
ctgatttgcattattgatttggataatgaagaacagatgaaacttggtgctaatatacatacattttatacttttattcatgttcagcaaatctagcatatgcagatattcagcacatgctaattcggttgctggggtccataatattccaatctaggggttggtaaactatggcccatcggccaaatctgatctgtcatctgtttttgcatggcatgcaaactaagcatg

SEQ ID NO: 171556 - DNA, 143 bp, Homo sapiens
gtgtttcttactatgacaatctagtacacagatgaaacaatttttaaagggctactatttatttaaagtacactacagaacactgaactacacaaaaggttattacatttcatgtaatactcctatgattttccaccatgctt

SEQ ID NO: 171557 - DNA, 772 bp, Homo sapiens
  misc_feature (111)..(111): n is a, c, g, or t
  misc_feature (130)..(130): n is a, c, g, or t
atgtgtacaattctggccaacggcggaagctatgctgttcaagaccttctctcggaaagtggtggtggtgtccctaatgaggaagatggaagaagaggctggagtgagganggaagtagagggagatgangtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgcatggtcacctgtcagccatgaagctgaatctctgggggtgcagggcacccccgaaaaacaacaaggaaacagggctgtcggagtggggctgactgcgggaagggtggtggggggaaggtgcacacaggtgcgagggga

SEQ ID NO: 171558 - DNA, 398 bp, Homo sapiens
ctgcacacagcaggcattcaataaccactcgctgtttaaccctcatcatggcaggaaaataagccgtggctgggtgctcagagcctggaatagcatgtatgggggtggggcagggagggcacagagccacgtggagccagggccctaacgagaaacaggcctcagcactgaggagaaattgattaccctgcctctcagtaccaggccttctctccagagctcctgcaagagacacagacctagggtggaggccccagcctgagcctcttcagggctatccagcccctagtccccagcatggaagctaatgagtgtatttataacccaccttgtcccaaaaagaattacaagcatttttcaaaaagggaagcaataccgtaagaggaagtaaatttaga

SEQ ID NO: 171559 - DNA, 221 bp, Homo sapiens
tatgcagttaactacttctgttatccttgaccatctcagtccggccaaaaacccaaaagtaaatgaaaaaagacttctgaaaatggaggaaattagtcttcagaaagccctttccttttttctggaactgccactatcaagtcagatcctgctgctttaggttgttaatgttaccagctaagtatctttttttcccctataacctcataacaccacacact

SEQ ID NO: 171560 - DNA, 556 bp, Homo sapiens
tataatgtatattagatattaatagaatacaagagatcaaatgttgtctactccattgatatgcactgagtaaaatacagggacaaattatttacaaagaagtggggtggcataatggatggataggtggtccaccttgataactacgcatctacgcctattgaactgagtatgaaaaactcatctcagagcagaactagaatgctcgtgcgctcgagatagtgacatcatctcgagtaggactgcccgttactaagatatatctagatacttggaggaatcctctacaatcccatgtagtatgcactcgctcagcaagtcactaggattatattttgattgcagtgaataaccatggactaatataactcattgattaattgcaatattaaatgcaatcagacaatgctgagtgtggtggcagatataaattttccaggtaacacacaagattaggcttctgcttttaggtaagatactatgcctggaggatgaaagatacacagaagtaaaagatgtggtccctgcaccaactctatgaccttatcaagacatt

SEQ ID NO: 171561 - DNA, 326 bp, Homo sapiens
tatctgacgaggtcgtctcctggttcttttctgacctgtcagttttctttactcgcgtatttttctctgtttaagttttaaatataggtacttcttagatatgacaccaaaagtataaataacaacagaaaaaatagataaactgggtatcatcaaaattttaaattattgtgtttttcttttcttttctttttttttttttttgagatggagtctcgctctgtcatccaggctggagtgcagtggcgcgatctcagcttactgcaagctccgcctccagggttcacgccattctcctgcctcagcctcccaagtagctgggacta

SEQ ID NO: 171562 - DNA, 373 bp, Homo sapiens
gcagccccacaggagcccaggttgcatactccaatgagatcacaactaagtcagggttcaaagagaataagccccactcttcaaagagtgggaggagtgagggggtctctgggggcctcacacatcattactcccagctttgtgtggtttgggaggccaatgtgaatgtatgcggggaaggtaatgaattttgagacccagagaacaagctcgtttgagcagtcttgattgatgatcctatgtagatccaacttggctttaccatgtcctggtctttggtgcagactgggttctccctgtggaacaatcgtgcattgctctgtaaagcactacctaggattgagatgctttaggcacatcttaggaatagatt

SEQ ID NO: 171563 - DNA, 695 bp, Homo sapiens
cagatcacagcaagctattccagcacaagattcctcattttaagaccagcttaaaaacaaacatagatgatggtatcccctgggcaggagaggaggcctgggattcctacccctggcacatatgtttcacaagagtttcccacacatggcagatataaccaccatctatacaaacccagagaggctctgagaagcctacaagagccagagaaccagagagtgtagagaaacttggagtagggagaggaaggggcctagcacttggagccacctctttcttttccctcaccaaaacccatcagcaatgacacctcaaccccctcctgagcagggtgaggccctgcaacatcaatgtgtctccagaccactctcctttggaagaggtaatgaaaaaggggctgatttgagtcgtccaagagttcctgatacctgactttgggaaggacgaccacgtaacctatcctgactctggatttacttgtttgctttgcgtgggttgttattggaattaatctgcatcatctaagaatacagtcattgaactgggtggggtggtatctataaatgctaagagtgacaggaccaaggaggccaagaataatattgaccattaatccacatttactgctatggaaagatggccagaatatggtactgattgagaataaggaggttctcaaaaaagcttgaaaagt

SEQ ID NO: 171564 - DNA, 670 bp, Homo sapiens
gagacagggtcttgctctgtcgctcaggctgatgagcaatggagcaatctctgctcagtgcaacctctacctcccaggcccaagagatcctcccacctcagcctctcacttacctggggctacaagtgtataccaccatgcccagctaatttttgtattttttgtggtagagatggggttttgccatgttgcccaggctggccctgaacttatgggctcaagtgatcttcccacctcatcatcccaaagtgctgggattacaggcatgagccacagcacccaacctttttacacagtattaaatgcccaaataatttacttctaatgacagagtttatttaaaaatttaaattttaaaatgctcagaggaaggtctgtctttattatgtatgacatcacctgcaattgaaagtatctctggtcttttaactttttgatagaagtggtttcttgaggctgcaggccaggacttggatgtcaacaacatgagtgttgccattcatgcagccatcagaatcaacctctgaactcatttccatggaacctgtttgcgaacttgaaaatctacgcacatgcataaggctccagaaaagcattcttgatgaatcagaataggtacagaggaagaaattttttagttgttcaaatcaaagactgaagttccatctct

SEQ ID NO: 171565 - DNA, 255 bp, Homo sapiens
cctccttaattcctttcttcttcttatacagggacttgggagtccacatgtgctagatggtgtagccacaggatggagaagagtagctgacctatactgaacatttcaatgagtgaaaaataaacctgtgctgtgttaagcttctgttccatttcagaatatttccatcgctacaggattgatctcttacctggctcatccttaccaatgaaggctcttcatattttttattctactgagatatttgtaattagt

SEQ ID NO: 171566 - DNA, 156 bp, Homo sapiens
aggctttagaaactcctctgtgtgtattaagtccctgcgaatactcttgcacacctgtccagtagacatgcccagccaagagaacatgccagcataaaagtgctgccaggcttgcctatcagtgctaccaagccatttgttttgcacttccaagaa

SEQ ID NO: 171567 - DNA, 458 bp, Homo sapiens
cacgggtagcatcctctgtgacatcctgtgaggttacagcatgtgagcatccagaccactttgtgaaattagaactaaaaccaaaaaggctggttggcccagtgacaccaatgacagtcccacatccatctacatttcaagttcctgggaggattcttttttgctgagtgtgctatagagtgagatttaatctttagagttcatctagcagcacctctgtttccacctgacatactcaatatctgtgcttaggccagagacacaaataagaggcagctagtacaaaaccctcttccccatctgccttcatcatagatgaacatcaaggcctctgccctgccatgtctggagatgatagagaagcctggtagattttaaatatttattgatttacaccctttccccagcagttgaataatgattattgacagaagcactggggacatatcagttttaca

SEQ ID NO: 171568 - DNA, 378 bp, Homo sapiens
ctgcccactgccaaagtgaccctgacctcaagtcagttcatgacactctgggcaagaccttccagtgtgtccccagctcagggagagctgagaccctgtcattcgcccctggtgccatcagaccgcgcccctccccggcttggggccctgggatgtgtgctgtgctgtggcgcatggctgatctcgtgttgtacagcagtttattgcccagtgccacctcccctgccacaccctatttaaaacacagcccccctgacctcagcacatccatcctctcttattggtatctttctctagagtgctgattttcatctaatacaccatgtacttcactcacctattacttcctttctcccccaccatgtaagtttcatggag

SEQ ID NO: 171569 - DNA, 483 bp, Homo sapiens
aaccccgtctctactaaaaatacaaaaattatctggacatggtggcaggtgcctgtaatcccagctactcgggaagctgaggcaggagtcacttgaacctgggaagtggaggttgcagtgagctgagatcctgccattgtactctagcctgggcgacagggtgagactcaaaaaaaaaaaaaaatacagtgaaccacaaaaactttagatacgataaaaagatgactttccccccaaccttattctttccttcttattgctgttgagttttaatcccagattcagatccagtggaaaggaaagtaatttctcagagcgaaggaggatgaggattccaagggaggacgaggaggagttgatgcaccaccttttctgttagaaggaggggcaggaagaacactgagaaggcagaagcaggaagcagtgctaaaaagtttagaatttgggaacttttcagatcccagattctgggcttagaaatac

SEQ ID NO: 171570 - DNA, 460 bp, Homo sapiens
ggttgactccaaccagtgggcactccatcccatggcttccaaaatcctgcagctatcctgccctatacacaaagagcccagatccaggccccacacacttgatattggggccagactcttccacctgtgaaacctcacaggttcctgcagggagtggagacacacagaacctagctcccctggagcctgcaagacttgggccaccagaatcccagtaggtccctgaaccattgtcccccagtaagtctgcagagctgtgaaatgcagacaataacccttccctgcctgaaagagcacttttctggggagcccatgggagtcaggagcaaaagcatctgtcaaacaagtagatacccagagagtcacgtgaaatcatttctatgcctctgacagacgcttcttgagcgaagtttctgccctgagcccgcctgaccccttaggctgggctcagtaccctacc

SEQ ID NO: 171571 - DNA, 399 bp, Homo sapiens
gcaacttcatatattaaggactatggcaactgtaaccttacaaaacatatttcttaaataattagagtttgaaagtcacaattacacgtttatgcatggactacagaatagatgtgttaggcatggaaacaacattattcttgtacatcttcatcagagctcttgactaacttaggtgcattgtcagtgagctgttatcttgcgagacaaatggacagttatttctgggagaacataaaatcttttacctgcattatttgtgaaaaaggaatcagtatatgaaggtagccagttgcccagacataagattttttgacgaaggcaggcaaccttctgcacttaaagagcctgccccaaacttaccatcttctttcactatagtcggtggtctgtggatct

SEQ ID NO: 171572 - DNA, 780 bp, Homo sapiens
tagccaggcatggtggcgcatgcctgtagtcttagctacttgggaggcgaaggcaggggaatcgcttgaacccaggaggcagaggttgcagtgagccaagactgcaccactgcactccagcctgagcaacagagtgagactctatctcaaaaaaaataataataataattaattaaatgaagaataaataaataatatacattgttcattcattaacattgaactcacagccaacggcactacagcactcacgcctgaatggagtttatttaatgcatgtattttctctgtaagacacatcacagacttcttggacttgtgaatgctaagcagcacttcagcactatgcttgggggttaatttaaatggcaaaacaaccaacaaacagtacaaaaacaggaaaagcatggcattaaatagaccacaaaaaggatacctgactattgtatgagagctgaaaaagaaggcagaatatcatcctgttcaaactcaaattctttgacactctgcgcaaacacatgactatgaaagtgctgtgagtactgatttgggggttacaaaaaatagtaggtgagttcacaaatacaaaagctgaaaacaaggaggatcgactgtattttcgtagacaatctaatctcagaagatttcagttcagacaaaaatcatgataattactgtattacaaaagggcactagataggggggaaagagtaaaaatcacaattaaaacaaaggttcaaaattctgcagcaaccatatccagttacactttaatatgtt

SEQ ID NO: 171573 - DNA, 480 bp, Homo sapiens
ctggattcccactctgccctcaggagaccttgagaaggggtgtgagaaatgaatactgacatgcagaccaagggccgctaggcagtgtgtatattaattattcttgaagattagtgtatttctttttttagattaagaaaatgtgaattcccaaaattgtctttctataccttattttggagttcactactataaatttaatagcaaactacacttttcaatactcagattatctttatcatgatatgttgaggtagatattaaaattaatgtctcggccaggcacgatggctcacacctgtaatcccaaagtgctgggattacaggcgtgagccactgcgcccccgcccaggagctcttttcttatgacatataaattatgacatttatattctttatatgactttatgttctcttcttatgacatttaaattctttaagtagtttgttggtccaataaactagacgttgtataatcta

SEQ ID NO: 171574 - DNA, 664 bp, Homo sapiens
ggtttcaccatgttggccaggctggtctcgaactcctgacctcaggtgatccgcccacctcggcctcccaaagtggtgggattacaggcgtaagccactgtgcccggccgcctggctagttttttgtattttttgtagagacggggtcttgctgtgttgcccgggctggtcttgaactcctgggctcaagtgatcctcttgcctgggccgcccaaagggctgggatcacaggtgtgagccactgtgcccggtccggagagtctgttaagtgtggcctcctagttgatgggcctaagccaagccctgagtccaggctgaggtctggcctgggagagttgctttggcgtcctcagctcataggtggcctttagccacctatggatccaggtgagcccacggattgggctggggcacacgtgacaaggattggccaggaagaggaagaagaatgtggaagggagaccgagcagaggctgtcagcaagggaggcactggccggagggagggggtgttccggaagcaagaggcagaggtgacggcagccaccgcgggtggaggggacctttgggctcatgtgacctctgccaggtgcttttcatgggtgtacaggtcttgacccctttgatattctcaacaacctctgagtgtcgacacagttgtaccc

SEQ ID NO: 171575 - DNA, 202 bp, Homo sapiens
aggtgaaacaacagacgcacgtctaggaatttcttcacaggtaacatcaaggacttggaaaggtgtagtcacacactacttacctctgcattgtttatagtacagaaaaacagaaagtaactgaaatgtccagcattagaagattcatcaaacaaattctggtttgttcattcagtgaaacgccacgtggcgtctgtgaagg

SEQ ID NO: 171576 - DNA, 173 bp, Homo sapiens
tatatattctagatattaaacccatacagctatatgatttgcaaatatttgctttcatttttctgggttatttttactctgttgatacacaaaagtttttaattttgatggagtccaatttatcttttttttccttttgttgcctgtgctttttgtgttagtctaaggaatca

SEQ ID NO: 171577 - DNA, 596 bp, Homo sapiens
taaactctttgcttggtttctccctatttggtctagagtggagtgagtttgtgtgtgtatctgtgaatgtactcatccttttttgtaaaaatggaagtggatagaaaatgaaatagagaattctttcccaatttatttctacttctctccttcattttctatgttgaactaagaaaaaaacattgtaatgccatcacatatgtatatatgtatttttcctgtgtcttcttttaaaaaatatttaagatctacagagatagacgtaaaaacaattttaaaacatcaggaaatgggagtaaaatgaaaatcatcacgaaaaaaggcaacgtagaaagtagttaagagctaagattccaggactttgttccaacctggctcccttcttttctcagctacacaactttgggcaaataattttgtgcataaaacaaagtttgtgttaagtacttatttgtggcattttccactcgtggcatcatatcagcactcaataagtttcagattttggagcattttgaattatggattttcagatggggatgctcagcctgtagctatatgaagtaggtaatgattttatcaccattttgcaaaca

SEQ ID NO: 171578 - DNA, 205 bp, Homo sapiens
ctctttaagggatgtcatggggagaggggagggtgaagaaaatcaccagtaaaactattgatcatttttgtctcgggttaacacccctctctgcgggcctcacacttgcgtgttgtctccactctggctttgcagaagtgcggagctcctgtcctgcaggtattgtggtcgtcagacccttctggagatgtcgagtgggccaggg

SEQ ID NO: 171579 - DNA, 574 bp, Homo sapiens
tactatatgccaattgtgatgctcaatttcacttgtcaaaatcttgaactaacctaaaaatagatatagccaaactaacacaaacaaacaatgagctgataagacagtgtagaacagtgatcacaaaaaggggagaaattaggtgagtactatgactgtcccagcttactgctttctgcttggagaacttacaggataaagtgtagggagagagaacttgaacagagcctagtagtctccctgagttgagaagacagttgaaaattctggaagaccaaaacaactaaaatttgcaaggcagagcactgaagagaagaaaggcgcatggagacaagaactgcacagaaagagactaaacatattgccttccagtcttcaggtgaatacttatcaatagatggatataagtcaactacccaaggccagggaaacaaccatcttgtgttagtccatttgcattgctataaagaaatacctgagggtgggtaatttataaagaaaagaggtttatttggccacagttctgcaagctacacaagcatggcgccagcatctgcttcttgtgagggcttca

SEQ ID NO: 171580 - DNA, 333 bp, Homo sapiens
ttcgattatgtttatttatttagatacagggtttcactctgttgccctggctggagttcagtggtgattatggctccctaaagcctttatcttctgggctcaagcattcctcccacctcagcctcccaagtaggtaggactgcagctgtgtacaaccacatctgactgtttttaaatttttttctttcttcttcttcttctttttttttttttatttatctgggtaaagaggagttttgctatgttgcccaggctggtctcaaactcttggactcaagtgatcctcccacctcggcctcccaaagatctgggattataagcatgagccaccac

SEQ ID NO: 171581 - DNA, 913 bp, Homo sapiens
atgtcgtagcgcatggcccagaatggaacctgaaaatgccaagatgaaaatgcccacgttcagcactccaggagccaaaggggaaggtccagatgttcatatgactctacccaaaggagatatcagtatttcagggcccaaggtcaatgtggaagccccagatgtcaacttggagggtctggggggaaaacttaaaggccccgatgttaagctgcctgatatgagtgtcaagacaccaaagatctccatgcctgatgtagatttgcacgtgaaaggtacaaaggtgaagggagagtatgatgtaactgtaccaaagctggaaggagaactcaaaggcccaaaagtggacattgatgccccagatgtggatgttcatggcccagactggcacttgaagatgcccaagatgaaaatgcccaaattcagtgtgccagggttcaaagcagagggcccagaagtggatgtgaacctgcccaaggctgatgtggacatttccgggcccaagatagatgttactgctcctgatgtgagcattgaggaaccagaagggaaattgaaagggcccaagtttaagatgcctgagatgaacatcaaagtccccaagatctccatgcctgatgtggacttacatctgaaaggccctaacgtaaagggagaatatgatgtcacaatgccaaaggttgaaagtgagattaaagttcctgatgttgaacttaaaagtgccaaaatggacattgatgtcccagatgtggaggttcaaggcccagactggcacctgaagatgcccaagatgaaaatgcccaagttcagcatgcctggcttcaaagcagagggcccagaagtggatgtgaacctgcccaaggctgatgtggacatctcaggacccaaggtgggtgttgaagttccagatgtg

SEQ ID NO: 171582 - DNA, 429 bp, Homo sapiens
aaggctgataccaatgataggaagcactggcttccgaagcgtttccagcatccccaaacagctccttaaacccaatcctatgttgcaattcccaaaactgtgtctccaacctagacttctgaatcaccaatgcttgacccccgaccacacctaggtgtcccagcaactcaaactaaacatgatcaaagctacattcatcttctaaaactactccttggtctcagtgatgccatcacctttagtcgcttatgttagaaatttgagaattgtcaacaattctcttcttttacatcttcaaatccaacccatcaccaagaccaggattccccttgtgaagtgcggctcctaccttccagttctcatccccactcccatcatcgggcccaaacccccatcctctctctctcatggacactgcagcagcctccc

SEQ ID NO: 171583 - DNA, 386 bp, Homo sapiens
ctgagaccgggtcttgctgtcccccaggctggactgcagtggaacgttcatggctcactgcagcctcaagctcatcgcacccggctgactaaaacaaaaaacaaaaaacaaaaaaaaatttttttttgtttaatttgtagagatggtgtctccttgtgttgtcctggctggtctcaaacttctggcctccaacaatcctcttgccttggcccgcaaatgctgggattataggcgtaagccactgtgcccagccacatgtagcatttcttcatacacctatctataggtttgtagccctaaacaatatactattattttttgcatgttttcaaatgttatataaataatatcatactctacaaggactatgtatgttgtttctatac

SEQ ID NO: 171584 - DNA, 257 bp, Homo sapiens
catacctcagtccttaatggggtaggccacacgtgtggtgcagctcaagtctgtacagcacgactttaggctggaaagagctctctcccaggcacccaggtatgcattcattctaccgagagagaagcatcctgacacacagccctgtccttacctctaagcatcctttggagtgccataacctgggaaagattcttactgatttcttttttgtttgttttttgaggtagggtctcactctattgcccaggctgtag

SEQ ID NO: 171585 - DNA, 533 bp, Homo sapiens
agataagaaagtttaatcactaagcaaactgcaaagcactgaaagcactgcttcttaccctaaatgaagcccactctgctgtgggaacaaattaatatatattatgtatggaaacccaatccccacaaagtcctcaagaattaagcatcaggaactattaaccatatgttagttatcctgacagactgttccatgggcctggtctgagggagtttgggacagaaataagtgcaagaaaacatttgtctatgaccccagatcaagtccccgatcttgctcggttctatccaaataagcgattttcatcaaaatgatgcttctcttttccttctgtgcttgcctcccagtgaacactctagggtcacggaaatgactccagactctcttacaattggcaataagacaagttaaattacatgagtgtctcaatccctttctgtaaacagggaagaaacagtaccaatatcatgaagtttcaagtatcaaatggagcatgcaatgtgtttatcacagtatctggtatacagcaatgg

SEQ ID NO: 171586 - DNA, 240 bp, Homo sapiens
cgaactcctgggctcaagccatcctcccacctcagcctcccaggtagctgggactacaggcatgagccacaggcctggtttatatctttaaggtaaggttagatctaaattgagcctttacttgaagtcagactgatctgcatcagcaccatatgttatgtttacttttttttttctttcaatgaaaatgggcctgaggagattggtttgtatacggtacataaactggcatttaagatg

SEQ ID NO: 171587 - DNA, 423 bp, Homo sapiens
  misc_feature (157)..(157): n is a, c, g, or t
cccctgcacacgccgagtgtccacacccagctacagatactagctttagaagatgaatgggaaaagttagtttggatcatgttgtagattgttttaatatttgagggatagtttttaagtttggtgactcggcgtgtgcacaacaacttcgtccacnagatctgacttgaagaagtgtatggtcattcggcgtgtgcatgcacacgccgagtatccaaacgccgcatatcctggtggacgaagttgttgcgcaacaacttcgtccactgtgatttcctgttctgtttggtctggtcactcggcgtgtgcagcaacaacttcgtccacactgatctgcaacaacttcgtccattacgatctgatttcaagaagtatatggagactcggcgtgtgcagtgtggccctcgcgtgtgcggtccggct

SEQ ID NO: 171588 - DNA, 512 bp, Homo sapiens
cattaacacccctaaacatctttgcagaaaattcaaaaacatggccttccggaaatatttgctgctagacaaatgtaaaagccctaaagtgcctataccaaggggaaatgagaacagtcaacatcctcatgtccctccagaaagtgtcatcagcttcaggcccacgggcacccagctacctgcaagccaccttcgcaccaagctgcgggctctgaaatgcactcagcggaagatgaccctgagtcctgtgcagcaagacagcagttaactttatccccagaacttcctgcatgaaactagctaagataaagagccaactcgagtcctcagaacacactgtgagggcaccaggctgtgtagaccacccactcggtgccaacttcacccccacttccgttgaggcaggcatgtttattggaagtgtaacacgtttttggttgggggacattgagtgcttttgagtgattttcattagagtataaggtatcttgattaaagcatttagttaaaat

SEQ ID NO: 171589 - DNA, 193 bp, Homo sapiens
tgactcctctccccacaccctgcctccaaacgcatcagcaaattctgtgtgtgctgcccgcaagacatagcagcacccttaccatatgcaccaccaccaccacctccggcttcttgccaacatcctgttccaagcctccataatctctcacttggatagttacaatagcctcttttttttttttttttttttt

SEQ ID NO: 171590 - DNA, 431 bp, Homo sapiens
gcgagccggtaccccgaagtgcccaaatgtaaagcttcttcaaaagaataactcatatattttgacactcaccatgttgctagcctgaatgcgtggaagacaaaaacacacaaatcaagtctcttacatttctggaggcacaatatttaacatctgctctgagtttaaatgttaattaaataaagactaatctcctctcacatatctacagtaatctatcacttgcccacacataccaactatctggaaagctacagggtgaaaaaagccagtaaagtgagatatcccaaagaagtaaagtccatcacttggcttctatgaagctcaagagaaaaagaaagtacagaactgagagggagtataagaaaaaattctagacgccaggtgcagtggcacacacctgcagtcccagctatttgggcggctgaaac

SEQ ID NO: 171591 - DNA, 418 bp, Homo sapiens
ggaatctttaaaagattcaatatatgccaaatgtaaagcttcttcaaaagaataactcatatattttgacactcaccatgttgctagcctgaatgcgtggaagacaaaaacacacaaatcaagtctcttacatttctggaggcacaatatttaacatctgctctgagtttaaatgttaattaaataaagactaatctcctctcacatatctacagtaatctatcacttgcccacacataccaactatctggaaagctacagggtgaaaaaagccagtaaagtgagatatcccaaagaagtaaagtccatcacttggcttctatgaagctcaagagaaaaagaaagtacagaactgagagggagtataagaaaaaattctagacgccaggtgcagtggcacacacctgcagtcccagct

SEQ ID NO: 171592 - DNA, 224 bp, Homo sapiens
ggatcttaactaatttctgatcaaataaataaaataaaaacagtcactcaggctgacaagggtaagggaaatgtggtccgcccccaccaccttaacatcttgctatgaaaggacgtttcatgatgataacgtttaaagacatccgtaaggcgatggcttttatctgactggaagttagcaaaacattagagatgactgaagtgagtcgctgctgggtatgtcca

SEQ ID NO: 171593 - DNA, 540 bp, Homo sapiens
gacatcgagaggccaccgtcatcgtcttccatcgaaaggcgtttaaaagcagtcacggccatgcgcggtggctcaggcctgtgatcccagcactttgggaggccgaggcgggcggatcatttgaggtcaggagttcgagaccagcctggcaaaacatggtgaaatccggtatctaataaaaatgaaaaattagtcgggggtagttgcgggcgcctgtaatcccagctacttgggaggctgaggcaggagaatcgcttgaccccaggaggcagaggttgcagtgagcccaggtggcgccaccgcaccccagcctggacgacagagcgagactccatctcaaataaataaaataaaaacagtcactcaggctgacaagggtaagggaaatgtggtccgcccccaccaccttaacatcttgctatgaaaggacgtttcatgatgataacgtttaaagacatccgtaaggcgatggcttttatctgactggaagttagcaaaacattagagatgactgaagtgagtcgctgctgggtatgtcca

SEQ ID NO: 171594 - DNA, 797 bp, Homo sapiens
accgcacgacacaaacaaaaatagagcaggtaagaggccgcggttgtaatcggcagatgctctttgtagctaacagtgaagatttacctcgttctgctcagaggccttgctgtggagctccactgccatgtacccagtagggtttgacatttcattagccatgcaacatggatatgtattgggcagcagactgtgtttcgtgaactgcagtgatgtatacatcttatagatgcaaagtattttggggtatattatcctaagggaagataaagatgatattaagaactgctgtttcacggggcccttacctgtgaccctctttgctgaagaatatttaaccccacacagcacttcaaagaagctgtcttggaagtctgtctcaggagcaccctgtcttcttaattctccaagcggatgctccatttcaattgctttgtgacttcttcttctttgtttttttaaatattatgctgctttaacagtggagctgaattttctggaaaatgcttcttggctggggccactacctcctttcctatctttacatctatgtgtatgttgactttttaaaattctgagtgatccagggtatgacctagggaatgaactagctatgaaatactcagggttaggaatcctagcacttgtctccaggactctgaaaaggaacggcttcctcattccttgtcctcgatacagtggcacattggcacacctagaatccactcagtactccagtggaccagtgctgttgaagatttgaggacttgttaaagagcactgggtcatatggaaaa

SEQ ID NO: 171595 - DNA, 710 bp, Homo sapiens
ccgagggcagttaagagttagccagctatggccggacacagtggctcatgcctgtaattccagcacttcgggaggccgaggcgggcggatcacgaggtcaggaaatcgagagcatcctggctaacatggtgaaaccctgtctctactgaaaatacaaaaaattagccgggcgtggtggcgggcgcctgtaggcccagctactcaggaggctgaagcaagagagtggcgtgaacccaggaggcggggcttgcagtgagccgagatcgcaccactgtactccagcctgggcgacagagcaagactctgtctcaaaaaaaaaaaaaaaaaaaaaagccagctatgaagtgatggaaacacattccaggaagagaagattgtttgaagggagtacagagggatggcaaagcatgacatatttagggaatgacagatagcctagtatggttggagaaatggaggctcatggatgagtggcaggatgggatcctaaatatggagactgtggtcagattacaagagacttcctgtgccaagatgaggagttgaaacttcctgctgaaggccacagagagccatggcagggaacacttcctaaataacaatgtggttttggagcacagcaacctcattgctttggcaaagtctccaataagtgtgatgaaatcttctaggatgaagactgaaaatgatgcactcagctttcttctgga

SEQ ID NO: 171596 - DNA, 198 bp, Homo sapiens
ggagagaactaggagaggcaccatttccaaagatattgtcaggggtttaatagaattgatgaaggacaccaattcttagattccagacaacaacaaactgaggaaaatacgttttttaaagaattgatatctagatacattgtagtatacaagaaagggaagaattaaaaaataaccagaggaaaaaaagactactca

SEQ ID NO: 171597 - DNA, 560 bp, Homo sapiens
gacaataggcgacagacagctgtgtgcattgtcacaacctccctgtggggtaagaggattatcccctctttttaaatgaggaagccagggttcaaagaggttgaataatctactcaaggccacactagatctagcccagctagatcatagtgggctggaaacctaaccaaggtctgatagtcaacccatgaaaccagggattcccaaaccatgctcatccattcagtcatgtcgcctgttttgactgggcgcctgctacatgccaggtgctttttcttttctttctctttttttgttttttgttttttgagacagagtctcactctgtcgccaggctggagtgcagtggtgagatcttggctccctgcaacctccgcctcctgggttcaagcgattttcctgcctcagcctcccaagtagctgagactacaggcacccgccaccacgtccgtctctactaaaggtaccaaaaatagccaggcatggtgacgggcactgtgatcccagctacttgggaggctgaggcaggagaatcacttgaacttggagggtggaggttg

SEQ ID NO: 171598 - DNA, 188 bp, Homo sapiens
atctaaaatcccctttttatgcaagagatatctcagatcagtgaggcatgcctgcagctgaagtccacactctgtggggacctcatcccattggactgatagacgtggcttggtcatacaagccagagacagtgagcgacagttttgccagaaaggatattttgctgacttccacagttatcccctga

SEQ ID NO: 171599 - DNA, 621 bp, Homo sapiens
tctgctggagttctaaaagacccagcacatacccacattccttccatcttatcactgacatctcgactcattttctcccagctaaatgccctgtttttctgctttgcaccgttattggttgggcaagagtgtcctctcagtaatatttcgtgattaagcacatggcatctcaaatgcatgacagtcaaactgtacttttgtggatgagcttagaagacaaccatgatttcatgatttcactgttctggtggggaaatattttccaaggtccaaatactatcgtactagtgaacttttacaataaacttctgtgtcagctggtgactttctaaatttcttcagggcgcaaggtggaaggaaaatttagctacgactgaccagccaaggtgtgatactgaacatttgggggtaacactgagctcttgaaaataccattaatagtcaaagcaatagcaagaccactgtctacaactgttaatttggttgaagagaatatacatggctctacttccctatggctcaaatatgtaagaaaaagatggacgcatgcttacacacacacatacaaacacactctctctctctctatcaattagcttgcaacacatttttggatatatc

SEQ ID NO: 171600 - DNA, 233 bp, Homo sapiens
tagatccattcttctttccctgttcctattcctgattcgttttttaaagaaaagtattcagtcttttcattaatattgcagcgacttcagcacttccccgcccctcccccagactcctactgtccttgaatgaggaaactgagagaatactgattgagctggtgaatggaaacgttcctttcctgaaaatggaatgctttacaaaaaattgcattccacaaaaaaacactcaa

SEQ ID NO: 171601 - DNA, 481 bp, Homo sapiens
ttgagcactttcaggtggggaacgcacaccccctccagtcaaaatcaccagcaaccacccactctaaggctcagccaaggtctgctccttcctgcataaagccatatccatgcacaccgcctctgacagagaaaagggaggaagcatctacaatacggtctgaagccacccacatgcaaaaagttggctgtgacatcatactgtacacaggtccatgctggaaacccacctgtccagtaagaaaatgactacagaataggagactcactgaatgaagtaattcatttttgacacttgctaacaggaaaaactactatgacatattggaatgttaggtgaaaaagcagggtatttaagatatacacaacacaatcaaaactattcaacacagtgaagactagaggaaaagttgcaaaaagcaatgcagttacttgaaggaaaagaatccatgtactttttttctaaatatgaatgcccttat

SEQ ID NO: 171602 - DNA, 714 bp, Homo sapiens
caggttcaatcgattctcctgcctcagcctcccgagtagctgggactacaggcgcgcgccaccgtgcccggctaatctttgtatttttagtacagatggagtttcaccacgttggccaggatggtctcaatctcttgacctcatgatccgcccacctcagcctcccaaattgctgggattacaggcgtgagccaccgcacctggcctagattacttctaatacctaacacaatgtaaaatgccatgtagtaaataatcatactgtattgtttagagaataatgacaagaaaaatgtctgtacaccttcagtacagagataaccatcataggcctgactacattttccatccacagttggttgactctgagggcatggagggctgactgtacctgagccacctcttctttaatatttcacatcactcttttcctcacaggacccattttccattttaattcttccacatatttttatcctaaggagatatttttatgtttgaaaatcttattgattatgctatatacttgtctacaacaaaaagtatatataaattgaaatctgaaatttttatttcctgtgagaccaagtgttagaaaacattcttctgggcttacttatcattacaactgtcagaacacaactaatcaaacacaaatatattacaaagtttgaataataattattagtcatgaaagtgtcactcattagtcat

SEQ ID NO: 171603 - DNA, 397 bp, Homo sapiens
cctccccagctccaccctccttgcccaggaagtttctgcgatccatagaaccctctattattacctgctcttccccttcatccggtccaagggagtcagcccttgccttaaatatttctttgaatttcctgccaagaacaccagcgctttgtctttctctgtcatgggaaaactattttaaattccctgtttaactggtcataaacgtctagagaatgtaccacgcgttttgctggagaagcacaaaagagtttcatccacctctgcatatttggttcatcgtccacctcttaggggaggttttccaggatagtagtcatgcgtatgtatcctgaagccagaatgcttggttccaatccggtttttcctacaataaatgtgtgattcaggtaaaata

SEQ ID NO: 171604 - DNA, 167 bp, Homo sapiens
caatcaagggagtcttttaaaaagcagataagttctttcttttctccctgcttaaagtgctttagtaactttttcttgtactcagaacaaaatccagactccttgcctatggggtatgatgtgattcattccctccccagcgacttcctctctttcccttctcctca

SEQ ID NO: 171605 - DNA, 401 bp, Homo sapiens
cttctcttaaaacatgtgatttagaaaatagggaaaagtaaaaattttacaggcagctcactaattgagatgaatgtgaagattaactttataaagctccgttgcattttctgggtcaccgtgtgtgtgtatgtgtgtgggtgtgtagttgggatgctagatagatgccatgccagttgcagaatcctattgacccacagaatgtgggagatatatccaaatccatatacatatctatatctgtacacacacacatatatatacatatataaagtattgttgtacaagagcactatggttggtctcttcagaatctgtgtcatttcatattttcagaaagaatacattttaatcaattttctaaaaattgaagttatgtttttagtgttgttcaagcatat

SEQ ID NO: 171606 - DNA, 357 bp, Homo sapiens
agttgcatgacctttgctacagtctcattttggaacattttcataactctaaaagtaaactctatgattattttatcatcactaagaatattcacctccagcctgacaacaagtagtttactttgtgtttgcatatatttgtttgttttgaacatttcataaaaattgaatcatgtaaataatataaataagaataaaataaaccattcttgtgtaaaaaaaaaatagacaaacaatagttattcacttttatattctcacttgatctacaacaaaaaatttatataataaaatctcttgggggggggcggggcccaaattccccttttagggggggtttttaaaataaatgggccg

SEQ ID NO: 171607 - DNA, 278 bp, Homo sapiens
cgactctacaggatcccggcagctatccggttcaattgtgtgggtgtgcacatgtgcatatctgtggggggcgcattcaatcgtgtgggtgtccacgtgtgcatatctgcgggtgtgtgcattcgattgtacgggtgtgcatgtgtgtctgtgggtgtatgcacattcaattgtgtgggtgtgcacgtgtgcatatctgcgggggggtgtgcattcgattgtgtggatgtgcacatgtgcgtatctgtgggtgtatgcatattgaaccggatagcttg

SEQ ID NO: 171608 - DNA, 760 bp, Homo sapiens
cccgcaagtcgaccggcggcaaggccccgaggaagcagctggctaccaaagcggcccgcaagagcgcgccggccacgggcggggtgaagaagccgcaccgctaccggccggcaccgtggctctgcgggagatccggcgctaccagaagtctacggagctgctgatccgcaagctgcccttccagcggctggtacgcgagatcgcgcaggactttaagacggacctgcgcttccagagctcggccgtgacggcgctggcgctgcaggaggccagcgaggcctacctggtggggctgttcgaagacacgaacctgtgcgccatccatgccaagcgcgtgaccatcatgcccaaggacatccagttggtcagccgcatccgcggggagagggcctaagcgaaatccgctcctgctcccaagaagggctccaaaaaggctgttacgagagtgcagaagaaggacggcgagaagcgcaagcgcagccgcaaggagagctactccgtttacgtgtaggaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgtgagatccagacggccgtgcgcctgctgctgcccggggagctggccaagcacgccgtgtccgagggcaccaaggcggtcaccaagtacaccagctcgaag

SEQ ID NO: 171609 - DNA, 534 bp, Homo sapiens
  misc_feature (49)..(49): n is a, c, g, or t
  misc_feature (67)..(67): n is a, c, g, or t
  misc_feature (70)..(70): n is a, c, g, or t
  misc_feature (81)..(81): n is a, c, g, or t
tgttggggcgtcaggggcaggcaatggtgtttaagggcccaggtgacanagcacagtgcaaagtggnagnagaggcatttntcctgtttctcctagaacacagcagaaccacttggcaggcctgctgagcagcagcagtgaagtgtcaggaaggtgcctcctcctggcaagcatggcagcagtgacagtagccaggggtcctccccaaatatcttgtcaagagaacgtgggcatctatgagagacctcctctaggcacagcttcaggggcaggacaggaagatgttggtggtccttggccagatgcttcctataataatgaaaagcctgaatggttgggcagctggcagactgtggcctgcatcttatctgtgcgccatccatgccaagcgcgtgaccatcatgcccaaggacatccagttggtcagccgcatccgcggggagagggcctaaggtatatttttaagtggtcgatctaaaggatcttttcagagccactgccgttttcatcaagagcagctgtaccggctctcca

SEQ ID NO: 171610 - DNA, 419 bp, Homo sapiens
tggggaagttatttgcactttctctggagcaattttgggattccgtttaacaagatcttgctttacatctctgagtaattgatgtaaatttgatctgtaggagtggccagaagaatatcatccataaaatgaatgatatacgcagtgggaaacatattttgagactcctttaatgctcttcctacaaaatggtgacataatgtaggactgttaagcatgccttcaagtaaaacttgccattgatagcaagaaacaggttctctatgattaatagaaggcatagagaaggcaaattgaggcttatgcttctcgtgtaatggtataataaagaaacaatccttaaaatctattactacaagaggccagtctcttggaatggccgccggggaaggtaaaccttgctgtaatgcacccattgg

SEQ ID NO: 171611 - DNA, 385 bp, Homo sapiens
cctgggtctggagcgtggggtcaaggcagggcagggcacctacaggagcagggacagagctgcagtccagcagcagtggagcccaggcaggctgggggcagggtgcagaggcagccaccacagaagcacagcccctggacatggggtctggctgggaacgagctggaggccccctagattcggggggcgggggtgccatttgcagagacagggaaggggtcggcttagggctgccaaggaggcgcgggctgggacccgttgctagtgtgatggcctcccagctgccgccccctcattgcccatgtcaccgcaaggcctgtcctgccccgggtatggcgccgtcccttggcgtccttgcagttcacccgggaccacaagatggcgt

SEQ ID NO: 171612 - DNA, 605 bp, Homo sapiens
  misc_feature (130)..(130): n is a, c, g, or t
cttgaggctaggaggttgaggctgtagtgagccatgatcatgccaccacactcagcctgggagacagagtgagaccctgtcttgaaaataaaataaaataaaaaaaaaaaaaaaaaaaaaaaaaaaaaangggggggggtgttaaagacaataaatctattttaatgcttcatttaataccatattttgttagatattttggtcttttgaaatcatcggcaaaatattggtgttgtttatttgaaaattttgatccctggaatctctggatcagactttgagaaatacgaaatactcttcaaatctatcatccgactcttcttactgtgtcatgtaattatgctaatttttcacatttgtaaggatgataagaatgaaaaaaactgatttcggtgctaaaaaattatgttactaaaagacacaggtttgtgtgtaaatatgccaatggatagttgaaattaatcgttctgccttgttagtttttttgtagttgtagacttctcagtactactgtgtataagtcttaccacttgtcaacctcacttttttctttaaaattaatgtgtaaaaatggaaatctctaagtaaaaagcattaccagtttt

SEQ ID NO: 171613 - DNA, 374 bp, Homo sapiens
tgtttgccacttagttgctgaagagacatcagcatatggcttatttatgaactcatagtttgctttgaattgggaaagaaatttttaaaagagattaaacattaccttctttgtccaaataagccttaccaaattatcacatctaatgtgttttcttttgtaacaaaagatttaatgcacaaagcatttagtcacaccagccattactaagaatagcttggtcagttgcctgagaagttccttaccccatgcagtcgatcctccttattcacagatttcacattggtgaattcatctgcttgataaaacgtattttaaccccaaaaccaatacacagagcacttccacagtcattttcagacatgcacagagaa

SEQ ID NO: 171614 - DNA, 315 bp, Homo sapiens
gggaccttaaaaaatgcacttatttatgaaatacagatactgcttcctatgtacaggccaggtacaattttaaacatgtttttataaataataagtcaatcacagttggcaggataatggaataggaggccccctgctcatatacccacacagcaagaagcatttggcagccatccactgatagaagtgcctcagtgggagctttgggatctagggagcagatgttaaaattctggtataggccaaaaccaaggaggctcattttaatagggcaggcccacacttgggtggcaattttgctgactatggagtaag

SEQ ID NO: 171615 - DNA, 474 bp, Homo sapiens
tgaattattgatgagccactgaaagcaaatgtctctccttaagcgatttatttacctattcacagtcattgctattgagcagaacagagaccgtagcatggctaatccatacttggcgctagcctcgaagtgtccagccagcagtgtggacctgcagggcacaatgtcactggggagctcactcacctcagcattggccgcaccccttaaaccagccaccagggcctctgaagactgcattgtgtggacctctcagcttggccttcaggttgaaggctgacggctgaggaaaaggctttgtggaattttctaaaggcagaggttcaggccccaccccgggcctcggaattttctaaatgcagaggctcaggccccaccctgggcctcccgcttccctccagggctgacatctgccctctcagtcagcaaaacctccctccagctctgctgtgccagggtaggagccagggatct

SEQ ID NO: 171616 - DNA, 470 bp, Homo sapiens
agctacaaacttgcaagatttaaaaaaaaaaaaatcaaaacatggtttcacaatgatgatagaagcttacccctcactccagataatttagtactagctgggtgccgtggagcatgcctgtaattccagcactttggaactacaagcatgaactaccacgcctggctaatttttgcattttttgtagagatggggttttgccatgttgcccaggctggtctcgaattcctgggctcaagccatctgctggcctcagcctcccaaactactgagattacaggcgtgagccaccctgcctggcccaaccttccttttttaatcaaatgggtagcagatgggtttaacaccatctgtgaacagtccttactgatataaagtgttacatcatttaaaaaaaaaattcttgggaaggtttcttagatacatgggaaggtttctagatgctgctcttctgtggatcagtttggaca

SEQ ID NO: 171617 - DNA, 446 bp, Homo sapiens
tcaaaccatagtggtccccctgactataaaatattccctctcattcaggatccaagatcagagtatctgagaaacattgccatggtagagaagggataacacctttttggaggagcacatgagttgatcaggtggccagcaaatgttgtgtcttgtgatgtggaatattactgggaaacttttaagacaaaccgtaagccagatatattgtttcaaaaaactactggtatcatagcctgtttctcattttttacctttgcatacaactcatggaaactaatggctaaattttgctgtgtaccaaatgattccagttagttaaaacagatcgttttatgggtcagtaggttggctggtcagttgtgggtatggctagttcagcccatctctgtggactgcagatggttccactgaggctggatggtctcaaatggactcactcacct

SEQ ID NO: 171618 - DNA, 872 bp, Homo sapiens
tgggacccacaagaggacagtgggggtcttgggtacagagtgagtccactgggtccagagagggcaaaggggccagcaactagaggacatggaggttaaggcagccttggacaaatgcaatggagtgcacatctgtgcatggggcacaggaaccagtgcctgggggacagacacacacagccttgtgcaagcgcacatgagttcatgcccacgggaccacgaagaaacacagcttcacaagttgaaggttcaccagctgtgccatgcacacaggacactcaggccaccccccaggggcaggcctggcccaggagccctgggcagccaccaggcggccacctggcaggggtaggggagccaaggagacaagaacacccccaacagctctgtccttcctccttgattcccagcacaaagtgctgcggagcccttagctgggcctcctgagtgctcagtgtcagctgtggctccacctgtgggacatcagatgaatcactcatcctttccatgcctcacttttctgctctgtataatgggataccaatcacacagtaccatgagtggaaaaaaaaccaaaagaaacaaagaatcagtcgaaaaacaacacacgaccaaaaaaaaaaaacacccagggcggggcatatattgggggcggggcgagaacaacgcgtaatataacgcggccaaggggtaacacgtgtgtgtccggacccacttttttcgcaaaacgcgggagaaaccagggggggcccccataggaggagataacaatcgaacacggggactcgttaatagcgcgcagacgacccgcgaatacagtagtagagagaattgtgacaaacagctctcaactatatcaaagcacgctgtga

SEQ ID NO: 171619 - DNA, 393 bp, Homo sapiens
aagaaggcagccagcaaggatggtcttgggatgtagtgtgatggtagagctgggctttaataataaccatttggagagctcttactgtgtgccgggaattgttccaattgctttcatgtattaactcatttaatcatctctaagggataggtaggttgccctcatgaagcttaccttctgaggtgaattttctccaaacatatattaaaatgaactatgttgtactagctcaagaatagacaaacagattaaattactagaaactaagtagagtccaaaaagataccctgtgtatgtgtatgtatacatagtgcatgaaaatgtgacgtttcagattgtttctgttatgtctattcataactagttaccttatgaatttatgactactgtgtg

SEQ ID NO: 171620 - DNA, 538 bp, Homo sapiens
ataaaagattcacttttatttggttgactaaggttggctttgttcctggaaatgcagttgaaagttccccattatgattttaactcttctcagaagcaaagcacactttgataaatagccaccaaaaattttcatggagatacaataacaccacttatcagtgaatctcaattcaagatgttatggaggaatagatttgctttgattctgtctgcttctttgggttttttaataattcaaatatctggccacattccagagattctcagaaaaatcttaaatgaagccatggtatgtgttgtttttgaaaaaatgaggccaggtgcggtgtcacgcctgtaatcccagcactttgggaggccgaggtgcgcagatcaagaggtcaggagttcgataccagcctggtcagaatggtgaaactccgcctgtactaaaaatacaaaaattagctggatatggtggaggtgtctgtagtcccagctactcaacaggctgaggcaggagaatcacttgaacctgggaggcagaggttgcagtg

SEQ ID NO: 171621 - DNA, 188 bp, Homo sapiens
cagaggattaccctacgagcgcattcctagaactggtgtggttcttcctacgagcgccacctcaagtgctaagagatcacttattaaattaaaaggatttccaagagtcagggacgtctctcccagcctgggggtgtccttcccaaactgctacattcccaagtaaattaagaagtcccagccctgaa

SEQ ID NO: 171622 - DNA, 638 bp, Homo sapiens
cacagtgttcaaaattttatgaaaagtaattgatctaacgtgcctctgatactagatgtggtactgccttctccctggtctgttgatttatccttgaatctagactcaaaggatatcacctttgagaattaattggcttaagcctttagctttaagtctaaagactcaaaataatgacttttttttttttttgcgatggagtttcactcttgtcaccagttgtcacccaggctgaagtgcaatggcatgatctcggctcactgccacctccacgtcctgggttcaagcaattttcctgcctcagcctcccaagtagctgggaatacaggtgcacaccaccacaccgggctaatttttgtatttttagtagagatggggtttcaccatgttggccaggatggtcttgaactcctgatctcaggtgatctgcccacctcggcgtccccaagtactgggattacaggcgtgagccaccgtgcccggccaaaataatgacttttaaattgtatatcagtttgattacaatagtaaattattctattagaaataatagaaatgtttattaatagggaattgataaaataaaataatatcgtatgcgagtaaaatgctgtgtgcccatttaaatgatgtggaaa

SEQ ID NO: 171623 - DNA, 296 bp, Homo sapiens
atctctaccgccaattaaatccccaaactttgctgattaaccattgaaacaatccttttaatccgtccattttttcactttgattttttcattgctaactctctatgtgaagccacctcacctttttctcagaatgtcagctataatggcctagctgatctcccagtcattccaggcttgcatctgcccaaactaccctccactctaccccgtgctgttttctaaatgacaaattttatcctgttgcttcccaacttcaaactcctcaatgacttgcaaatgccttcaagcatata

SEQ ID NO: 171624 - DNA, 250 bp, Homo sapiens
acacctgtagtctcagcactttgggaggccaaggcaggtagatcgcttgagcccagaagttccagaccagtctgagtgacatggtgaaaccctgtcactactaaacaatgaaaaagttatctgggcatggtggcttgcacctgtatctccagctacttgggaagctgaaatgggaggatcacctaagtctgggaggttaaggctgcaatgaaccatgattgcaccactgcactccagcctgggcaacaga

SEQ ID NO: 171625 - DNA, 176 bp, Homo sapiens
tgatgggtgattttgagactatccaaggtatcaccatatcagtgtcatagaaacccttctgggaagccttcaatggtggaggaagctcccttcctgatttcctaattctggaaaccactggtctttgggtgattctctatcttcctgaccatcaacctttggcagtgcactgtgtc

SEQ ID NO: 171626 - DNA, 643 bp, Homo sapiens
acctctgaaatagtaaagaggaagaggagcatgagcagagatgcagtggcagagaagaagtcactgttggtgttttatggcttttaccttttcttggggaaatgggagacagagtaagcccggtcagtggtgggccaagaagccctacacatggtaatgctccaatagctcccggggggaagtgagtaaggaaacctgcttaaaataaatataagggtctttgaacagctccaaaggtccagctgggagcagcatttgtaactccatagagaaaccatttggtaaggtcacatgatttttcactggaggcatcgggtaggatgggagaaaggggcagttggcttgatctatcatgggagactgaaaagacagagagtgaagcagagattccagggtcaaagggtgagaagtggcagtgagagagtacctgcaatgactatgggattggggacaggtaaggacaaggtccagggactggtcctatagatcagaggcaaggtgttggatgggtcattgatgtgaatgttagagttcccagaatgatggcagaaaggaaaaatcctggtgaaatattagggagccacttagatgtccccaaaatatggtgaaaagcatgagatgagggtggcccagtataagcaag

SEQ ID NO: 171627 - DNA, 5475 bp, Homo sapiens
  misc_feature (1620)..(1620): n is a, c, g, or t
  misc_feature (2517)..(2517): n is a, c, g, or t
  misc_feature (2670)..(2670): n is a, c, g, or t
  misc_feature (3016)..(3016): n is a, c, g, or t
  misc_feature (3039)..(3039): n is a, c, g, or t
  misc_feature (3128)..(3128): n is a, c, g, or t
  misc_feature (3294)..(3294): n is a, c, g, or t
  misc_feature (3796)..(3796): n is a, c, g, or t
  misc_feature (4026)..(4026): n is a, c, g, or t
  misc_feature (5286)..(5286): n is a, c, g, or t
  misc_feature (5422)..(5422): n is a, c, g, or t
cggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcncgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggntggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggantggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggngcgggtggaggtgcggctgccangggacttgctgcaggtgtattggggaactatgtcctccaccgtcaccttcgacacactcttggcaggacctccctacccaccgctggangtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccntattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctnccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgnggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaagggcaggctggcgctgagggcaggagacgtggtcatggtttacgggcccatggatgaccaaggattctattatggagagttgggcggccacaggggcctggttcctgcccacctgctggatcacatgtccctccatggacactgagcaagcatccttgcccaggtagtggcctctggctgctcacaccctgccagaggagaagcaagcgttcagaccctcacaccagcacccctcctcaccaccataagtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccncaccactccatgtgcgtccctccagaagctgtgtgctcaatggaagaggatgaccatccccgatagaggacgatcggtcttcagtcaagagtataagagtagctgcgctcccctgctagaacctccaaacgagctntcagaatgttatttttctgtcttatgtccaacccctcattaaaatgttcatag

SEQ ID NO: 171628 - DNA, 5228 bp, Homo sapiens
  misc_feature (1620)..(1620): n is a, c, g, or t
  misc_feature (2517)..(2517): n is a, c, g, or t
  misc_feature (2670)..(2670): n is a, c, g, or t
  misc_feature (3016)..(3016): n is a, c, g, or t
  misc_feature (3039)..(3039): n is a, c, g, or t
  misc_feature (3128)..(3128): n is a, c, g, or t
  misc_feature (3294)..(3294): n is a, c, g, or t
  misc_feature (3796)..(3796): n is a, c, g, or t
  misc_feature (4026)..(4026): n is a, c, g, or t
  misc_feature (5039)..(5039): n is a, c, g, or t
  misc_feature (5175)..(5175): n is a, c, g, or t
cggaacggcggcgcttcgctgcccgggagcgccagctgcgtgaggaggccgagcgggagcggcggcagctggctgaccgtctgcgctccaagtgggaggcacagcgcagccgggagttgcggcagctgcaagaggagatgcagcgggaacgcgaggccgagatccggcagctgctgcgctggaaggaggccgagcagcggcagctgcagcagctgctgcaccgggagcgcgatggcgtggtgcgccaagcccgggagctgcagcgccagctggccgaggagctggtgaaccgcggccactgtagccgcccgggggcgtccgaggtttccgcggcgcagtgccgctgtcgcctgcaggaagtgttggcgcagcttcgctggcagactgacggcgagcaggcggcgcgcatccgctatctgcaggcggcgctggaggtggagcgccagctcttcctcaagtacatcctggcgcacttccgcgggcacccggctttgtcgggatcaccggacccccaagctgtgcattccttggaagaaccgctgccccagacctccagcggctcttgccacgcccccaaacccgcctgccaactcggatctctagacagcctgagtgctgaagtcggtgtgcgctcccgctcgctaggcctggtgtcctctgcgtgctccagctccccagacggcctgctctccacgcacgccagctcccttgattgcttcgcacctgcgtgttcccgctcgcttgacagcacccggagcctccccaaggcctccaaatccgaggagcggccctcctcaccagacacctccacccctggctcccggaggctctcgccgccaccatcgccactcccgccgccaccaccaccgtcagcccacaggaaactcagcaacccgcggggaggagaaggctctgagagccagccctgcgaagtcctgactccctcacccccgggcctgggccaccacgagctgataaagctgaactggctgctggccaaggcgttgtgggtgctggcgcgccgctgttataccctgcaagaggagaacaagcagctgcggcgtgcaggctgcccctaccaggcagacgagaaggtgaagcggctcaaggtaaagcgcgcggagctgaccgggctcgcgcggcgcctagctgaccgcgcccgcgagctgcaggagaccaacctccgggccgtgagcgcgcctatacccggcgagagttgcgccggcctggagctgtgccaagtctttgcccgccagcgcgctcgggacctgtcggagcaggcgagcgcgccgctggccaaggacaagcagatcgaagagctgcggcaggagtgccacctcctgcaggcgcgtgtcgcctcgggtccctgcagcgacctgcatactggaaggggcggcccctgcacccagtggctcaacgtcagagacttagaccgcctgcagcgcgagtcccagcgggaagtgctgcgcctgcagaggcagttgatgcttcagcagggcaacggtggcgcttggcccgaggcgggcggccagagcgcaacctgcgaggaggtgcgacggcagatgctggcgctggagcgcgagctggaccagcggcggcgcgagtgccaggagctgggcncgcaggcggccccggcgcggcgacgtggcgaggaggccgagacacagctgcaggcggcgctgctcaaaaacgcctggctggcggaggagaatgggcggctgcaggccaagaccgactgggtgcggaaggtggaggctgagaatagcgaagtgcgcggccacctgggccgcgcgtgtcaagagcgcgatgcctccggcttgatcgccgaacagctgctgcagcaggcggcgcgcgggcaggacaggcagcagcagctgcaacgcgacccgcagaaggccctgtgtgacctccatccttcctggaaggagatacaggcgctccagtgtcggcctggtcaccctcctgaacagccctgggagaccagtcaaatgccggagtcccaagttaaaggtagcagaaggcccaagttccacgcacggcctgaagactacgcagtgtcacagcccaacagagacatacaggagaaaagggaagcctccctcgaggagagcccagttgcccttggggagtcagccagtgtcccccaagtttcagagacagtccctgccagccaacctctgtccaagaaaaccagctcccagtcaaactcctcctctgaggggtcgatgtgggccaccgtgccgtcctcccctactctggacagggacacagccagtgaggtggatgacctggagcctgacagcgtgtccctggccctggaaatggggggctcggcggctcctgctgcccccaagctcaagatcttcatggctcagtataactacaacccatttgaggggcccaatgatcaccctgagggtgagctgcccctcacagctggggactacatatatatcttcggggacatggatgaggatggcttctatgagggggagcttgacgatggccggcgggggntggtgccctccaacttcgtggagcagattccggacagctacatcccaggctgcctgcctgccaaatcccctgatcttggccccagtcaactcccagcggggcaggatgaagctctggaggaagacagcttattatctgggaaagcccagggantggtggacagagggctgtgccagatggtcagggtgggctccaagacagaagtagcaacagagatcctggataccaagacggaagcctgccagctgggcttgctgcagagcatggggaagcagggcctctccagaccccttctggggaccaaaggggtgctccgtatggctcccatgcagctacacctgcagaatgtcacagccacatcagccaacatcacctgggtctacagcagccaccgccacccccatgtggtatatcttgatgaccgagagcatgccctgaccccagcgggcgtgagctgctacaccttccagggcctgtgccccggcacgcactaccgggngcgggtggaggtgcggctgccangggacttgctgcaggtgtattggggaactatgtcctccaccgtcaccttcgacacactcttggcaggacctccctacccaccgctggangtgctggtggagcgccatgcctcgccaggtgtcctggtggtcagctggctccctgtgaccattgactcagctgggtcctccaatggagtccaggtcaccggttatgctgtgtatgcagatgggcttaaggtttgtgaggtcgccgatgccactgctgggagcaccntattggaattctcccagctacaggtgcccctcacgtggcagaaggtctcagtgagaaccatgtcactctgtggtgagtccctggattcagtgcctgctcagatccccgaggacttcttcatgtgtcaccgatggccagagactccaccctttagctacacttgtggcgacccatccacctacagagtcaccttccccgtctgcccccagaagctgtcactggctcctccgagtgccaaggccagcccccacaaccctggaagctgcggggagccccaggccaagttcctagaagcattctttgaagaacccccaaggaggcaatccccagtgtccaacctgggctcagaaggagaatgtccgagttcaggggctggcagccaagcccaggagcttgcagaggcctgggagggctgtagaaaggacctgctctttcagaagagtccccagaaccacaggccaccttcagtcagtgaccagcctggggagaaggaaaattgctnccagcacatgggcaccagcaaaagccctgctccaggattcatccatctacgcaccgagtgtgggcccaggaaagaaccgtgtcaggaaaaggctgcccttgagagggtacttcggcaaaagcaagatgcccaagggttcacacctccccagctgggcgccagccaacagtatgcatctgacttccataacgttttgaaggaggagcaggaggcactgtgcttggatctgnggggcacagagaggcgagaggagaggagggagcctgagccccacagcaggcaaggacaagctctgggggtgaagagagggtgccagctccatgagcccagctcggcactgtgtccagctccatccgccaaagtcatcaagatgcccaggggtggcccccaacagctggggacgggggccaacactccagccagggtctttgtggccctctctgattacaaccccctggtgatgtctgccaacctcaaggctgcagaggaggagctggtcttccagaaaaggcagttgctaagagtgtggggctctcaggacacccatgatttctacctcagcgagtgcaacaggcaagtgggcaatatccccgggcgcctagtggctgagatggaggtggggacagagcagactgataggaggtggcgttctccggcccaagggcacctgccttctgtggcccacctcgaggactttcaggggctcaccatcccccagggttcctccctggtgctccaggggaactccaagagactcccactgtggactccaaagatcatgatagcagctctggactatgatcctggggatgggcaaatggggggccaggggaaggtagcatgtgctccaagtgccactgtgttaaactgatggtagtccttaagcgtcccctaggctctgaaagtagcaggacttaagcctgagttatttgcaaaagcaaacacaacaagccaacccctgagagtctgagaagccatttcaaagttgctgataactatggcaggtatacggagaagcgcctttttctgtggccaatgtgtgttttctctgggaggttaaggttatctgtccattgccttgtacgaaagtctcaagaaaagtctacatcttaaaaaagaaaaagcaatctgagtgttatttttgggatgtgagggtgatctggctgcgacatgtgtcaccccattgatcatcagggttgattcggctgatctggctgactaggcgggtatccccttcctcccncaccactccatgtgcgtccctccagaagctgtgtgctcaatggaagaggatgaccatccccgatagaggacgatcggtcttcagtcaagagtataagagtagctgcgctcccctgctagaacctccaaacgagctntcagaatgttatttttctgtcttatgtccaacccctcattaaaatgttcatag

SEQ ID NO: 171629 - DNA, 770 bp, Homo sapiens
gcacagcttccagacccttttggggatcttgctcctggaggcagagcggagcctgcggagagcgacaggcacccgcttccaggtcctcggagccgcgcttgtgggggctgggggtcccctgctgcccattgactacctccaccccgagcgtccgtgcgttctggtggcagcagacggcaggcggctatccgcggagcaggaaggcgacagaacttcctatgtccttgcgtggggtcatgggcaggcgtgtctgttgtggagtttcgtttgtttgttgttgttctaacccaggacctggaagccccttctctgatcagcgccttcttccagctttgaatgcggcagggcccaggcggggcggggacgcctctgctcctcctgggacctaaatcacaggagtccttggccacgttcagccataagacattattcacttgggctgcgaaactcctggcaactattaggcaggggaggcccagcccctgttgggacagagacgtagtagtcatgtgtcacccgtagggctttcacaaggtaggtgggtttcatgtccacggagagatcagggtggagatatgtacataggtctatatctatagatataacgccaagagtgacaaatagtcagcagtgaactttcctgggacgcatcatctgggtctctaggtcatcaacgacatctcaaggtggtctggttaacgtccaggaaaatgtccccaagggaagttgcatttaaattaaacgaccagacgaaagaaaactatatttcc

SEQ ID NO: 171630 - DNA, 1784 bp, Homo sapiens
gcacggcggcagctcctcacctggatttagaagagctggcgtccccgcccgcccaagcctttaaactctcgtctgccagaacccgccaactctccaggcttagggccagtttccgcgattctaagagtaattgcgtgggcacctgtgctggggccaggcgcaaagaagggagttggtctgcgcgaagatcgtcaacctgctaacagaccgcacatgcactttgcaccgaccatctacgtctcagtctggaggttgcgcactttggctgctgacgcgctggtggtgcctattaatcatttaccagtccagagccgcgccagttaatggctgtgccgtgcggtgctcccacatcctggcctctcctctccacggtcgcctgtgcccgggcaccccggagctgcaaactgcagagcccaggcaaccgctgggctgtgcgccccgccggcgccggtaggagccgcgctccccgcagcggttgcgctctacccggaggcgctgggcggctgtgggctgcaggcaagcggtcgggtggggagggagggcgcaggcggcgggtgcgcgaggagaaagccccagccctggcagccccactggcccccctcagctgggatgttccccaatggcaccgcctcctctccttcctcctctcctagccccagcccgggcagctgcggcgaaggcggcggcagcaggggccccggggccggcgctgcggacggcatggaggagccaggcgaaatgcgtcccagaacgggaccttgagcgagggccagggcagcgccatcctgatctctttcatctactccgtggtgtgcctggtggggctgtgtgggaactctatggtcatctacgtgatcctgcgctatgccaagatgaagacggccaccaacatctacatcctaaatctggccattgctgatgagctgctcatgctcagcgtgcccttcctagtcacctccacgttgttgcgccactggcccttcggtgcgctgctctgccgcctcgtgctcagcgtggacgcggtcaacatgttcaccagcatctactgtctgactgtgctcagcgtggaccgctacgtggccgtggtgcatcccatcaaggcggcccgctaccgccggcccaccgtggccaaggtagtaaacctgggcgtgtgggtgctatcgctgctcgtcatcctgcccatcgtggtcttctctcgcaccgcggccaacagcgacggcacggtggcttgcaacatgctcatgccagagcccgctcaacgctggctggtgggcttcgtgttgtacacatttctcatgggcttcctgctgcccgtgggggctatctgcctgtgctacgtgctcatcattgctaagatgcgcatggtggccctcaaggccggctggcagcagcgcaagcgctcggagcgcaagatcaccttaatggtgatgatggtggtgatggtgtttgtcatctgctggatgcctttctacgtggtgcagctggtcaacgtgtttgctgagcaggacgacgccacggtgagtcagctgtcggtcatcctcggctatgccaacagctgcgccaaccccatcctctatggctttctctcagacaacttcaagcgctctttccaacgcatcctatgcctcagctggatggacaacgccgcggaggagccggttgactattacgccaccgcgctcaagagccgtgcctacagtgtggaagacttccaacctgagaacctggagtccggcggcgtcttccgtaatggcacctgcacgtcccggatcacgacgctctga

SEQ ID NO: 171631 - DNA, 387 bp, Homo sapiens
aaccaagttataaaatgttgtcagaaggagagttatatggtaaacagaagccaccccctaatattgaggttaatattcaactggtttatttaatagcaggagagaaactcacttcagtgttcatggatgtcaatttgagattctgagatattcagtcactctgacttgatgaatatccccaattctggatcatgatttttctataccattccctaacatgtggctcagaggcctaagctaagtttcttaggccacacactgtccactgactaccctttgtctagtgctgagttgagtagagccataacacactcccatctctcctcaagagaatgcatttgtaagactgttaattctgtaaccaaggggcagagttgaaaacagcta

SEQ ID NO: 171632 - DNA, 729 bp, Homo sapiens
ggtgacttgctcctccttgccttccaccatgattgtgaggcctccccagccacatggaactaccagccaacacttacggaaaatagaacctacgttgaaatattgggggctggtttcctctatacaagaggagtcatgaatatttatgaaaggagaaatcgcacatgcacagcaaggcaatttacttctatagaagggtgcgccctcacagatggagcaatggatgacctgcctgcagaaggagctacccactgaaggtctcttctctgctgagagctggacactcattgggatgaactgcctgtggaaaggagctacccactttgggtctctagagagctgttctgttgctcagtgaagctcctgtgcatcttgctcaccctccaattgtctgcatacttcattcttcctggacatgggacaagaactcaggaccaaatggtgggactgaaagagctatgacacaaacagggctcaagatttaacagccaacaacaaaacaaaataaagcaaaataaatgtcagaatgtgtgagctatcagatcattggcctgtggatattcaagtctgaactgaatttgaattgtctcttttcggggaaatgatgcacattgtatcatgtcaggcaataattttctgtatatgttatggatagtctgtactgtatgtgtgtggtggggatggtatgaatgcatgtgctggctgggaagtaaagcgatgaactgcaac

SEQ ID NO: 171633 - DNA, 911 bp, Homo sapiens
ggtgacttgctcctccttgccttccaccatgattgtgaggcctccccagccacatggaactaccagccaacacttacggaaaatagaacctacgttgaaatattgggggctggtttcctctatacaagaggagtcatgaatatttatgaaaggagaaatcgcacatgcacagcaaggcaatttacttctatagaagggtgcgccctcacagatggagcaatgaatgtgaattcgaattgttgcagaatgtcaaaggagaactcttcctgctgtctcagaatttcagctggagctacagagatcaaagagaggttgttaaatacccactaatttgaaagcgagttgacaggccagctgtgcagaacatgctaaggggtaaccccaaaagacagataagcctttgtctatgacgtgcctcaagccaatacaaggagaaaaaagaagagcaataaaggaaagaccatgaggatgggtttctgtgagaagagctgtagatttttcctttcttctccataccttgagccaagttgggaggttgtaaaaatcctctgacagagcttgggtgtgcttcctgccaggaggaagactaacctggaacaagcgggtggggagagaccttcagagaatttggactccctacagtcgggggcacagggttttgtgttgacttgcacttgtagaagtccgatgccagccgggcgcggtggctcacgcctgtaatcctagcactttgggaggctgaggcgggtggatcacgaggtcaggagatcgagaccattctggctaacactgtgaaaccccgtctctactaaaaaaaaatgcaaattagccaggtgttggtggcggcgcctggtatcccagttacccggaaggctgaggcaggagaatggcgtgaacccgggaagcggagc

SEQ ID NO: 171634 - DNA, 630 bp, Homo sapiens
ctgttaactcctcaccgtcagcctccgagaccatgatcattctccctcctgaaacaatgaaagcatggctttgagaagaggcgtaccacctgaggttctgtggccaggacatggcagactgggactagagctggacattttgccccaaggtgatggatcccatcctgagccttatacacttgaggaattttctctaccttcctcacacagaagccacttgctcacttgtgttccatcttgtgtgcttgagctgacatgtgcatacaccacctgttatgggctgaagtgtgtccctgccccaaatttagatgttgaagtcctcactctcagcaccttagaacctaaccatgtttgaagaaaaaatcttctgagaggtaattaagctacaatgaaggcttcagggtgggccttaatccaatgtgactggtgtgcttataagaagaggaaatttggacccatggaaagacaacagaagcatacacagacagagggacaccgcgtgaagacactgtgaaaaggtggccatctgcaagccatggggagaagccttgagagaaactagccctgccaatgccttgattttggactgctagcctctataactgtgagaaaataaatctctgttgttta

SEQ ID NO: 171635 - DNA, 195 bp, Homo sapiens
aggtcccccagatatctcagggtatgcaaacaacagcccagctttctgtgtctagattgtgctcgctggtgggtcacgtgtgggtggctggagtcctagggaaaccccacccacttctctgccctccagcggggcagccaggacgtgaggtctggtccttgagttctgtgtcctctctcacttcaccgctccggt

SEQ ID NO: 171636 - DNA, 383 bp, Homo sapiens
catctttcaaggctcagatcaaagttacctctcttgaagccttcctcaattcctctgaacagaattattcaacttttcttttttgttatcatcatacttctttcatagagacaattttgctgtaattatttttctcatctatcccctgactgggcaaaaggcctatacaatacaagaatggtgatatattcttagtttctgtcccagaactttgcacacaaatgtctctccctcaacaaatatttgaatgaatgaatgatcaaacagagttagattccatcataaggtcacactctccacaaatacaatcatctggtaagtaagaaatcttgtaggacatgctagactcttgtacggcaggggattgaaggagacactgttta

SEQ ID NO: 171637 - DNA, 248 bp, Homo sapiens
aagatgcaaacaatacaaaatagatcaatgtgtcctcagttccattgtccttttcaaggataattactgtgagcagtttgtatgtatttctagtctctatgtttagataacagggccttatttatttattctgcaacttgctttttttttccacttaacagtatattttggtaacttttccatgtcagtaactttttcttttcttttttttctttctttttttttgagatggagtttcgctcttgttg

SEQ ID NO: 171638 - DNA, 203 bp, Homo sapiens
agttccttgtatctctgattttctcctagtccattggctcgcattcgtagtatgccattttccaccctgcaagtaacccatctctatcaaatgtctagaaaaggtagtatttttgagaaatcttaaacatttatagtttggaaaataatttctgtagaaacctgaagaaattactggaaaattctggcattctaaacagaatg

SEQ ID NO: 171639 - DNA, 127 bp, Homo sapiens
gggttgttgcaaagagttcatctaaagaaaactcaacaaatgtgcacttaactttcagaaattgcaggattaataggcatctaattcagtatcaaagaaagtgggcagattaaccccaccatactct

SEQ ID NO: 171640 - DNA, 358 bp, Homo sapiens
ccatgttacccaggctggtctcaaactcctgagctcaagtgatagccccgccttggcctctaaaaggggtgggattacatgtgtgagacactgtgcccagcctcattttatttttaaacaaaatcttcaaaaattgtcctgatttaataagaaaatacaacatcctaaaacatgatattaatatttaccatctttagttgtacagattctttatttctttgtaaagaacattattaggtcttcataagaaatgaaatattgctctttatgagtttaatgcacataagtaatctataattctgtatgaaacttttacaatcccttaagaaatgtcctgcaaatttgataatatcaaatt

SEQ ID NO: 171641 - DNA, 251 bp, Homo sapiens
ttatggtctgtatctaggagacttgcacctctccatttatttgccagggacacctgtccagcacacgtcaaggaatgaggcagtgattgagcggctttggagtctctcttctttccctaacatgggcaggcagaaggaagttcccaaggggcccctcagagggaatctggcagctccaacccaccagcttggctgccatcgtcagcagaagaggacaatcgcataacaccacacacttcctccaggccaca

SEQ ID NO: 171642 - DNA, 978 bp, Homo sapiens
ctccccctcatgagagaaacaaaatgaaatgcaaacatgctttgaaagagcacagtcttgtcctgtccctctgcatcccctctcctcatttctaatgaaaaaaatagtcttccctttccctggttccttcaacagtctcttccttaggttatttttttcctctctcctttcctactccatccagacttccccctgcctaatcttaaagagatgaattggaagaatatgcagtcgtgtcagaaggatgccattgtcagttcacacaggcagacactaataggataaagtattatctgacttcctttaagtccagaaattaagtcttcttgcaatggcaatagattataacttataaccactgtggctggcaggctgcagaaacaggctgttagtatctgaggcctcagctccatttctgggcctattgtgagggatgcactcagcattcctccaaacacagctgcatgatccagggaactggcacttggctcctggatggaactgcctctgtggagagctgcctataactcattcagttcacctgccgtgggagaagctgtctgaatggtcttaatgaacctggatgagtgggcaggtaaagggaggaagccagggtcttgaagactgggaagaagtagcccgaggcaaggaaaccaaactttgcacagggaacacttagtgtgtgaaagctcttctcagtcatccttgctgactcattgagcaggtagtaacttatctagtgactaaatcagcaccagcttagagacacagggaaatgagggttgagaccttaaaggaactgtaaaagagactacaaattaaggagttgccctggagaggaaatatcatgagaaatgttaggaagaaagagccatcattcttcaaaatggagggcctcatgcaggatttcctaggtcctgttatggcagatgagtgtactcaaatggggaatatgggacaggaaacctgatacaataa

SEQ ID NO: 171643 - DNA, 444 bp, Homo sapiens
ctccctgtggagtcaggactcattactctgctgtctttgatgtgtgacaacaggcaccaactatcgccaactagagaagctcaccagagctctgatgttggaagtttttattggggcctcagcatgtagacatgattgactggttggtggattaactgtctacatggttaatcttagtgtccaggtcagctgatactgcgtgaccaaaagctcctaccccgaatcccttgattagtatttctggcatagcaagcccccatcagaaacaaagacattcctcttagaggtaatatagattacctttcagcaccagagggcaaaggccagactactttttaggcaagtacacattctttactacatcccacccatccgtccccgacagggagctggccagaaatggagccctcctgttaaattgtctgggcctgtctttgaggcgca

SEQ ID NO: 171644 - DNA, 202 bp, Homo sapiens
tctctctctctctctctctgtctctctctctcactctctctcaaagatcccctcttcacttcattgggtttgggcacttcatgccatgccaccttcctcctgttgcacggacaaagtcctgcttgggttctaaagcccgcactaggtttatcctctgtgtggatgcccttctcaccttactttgacactctacccaaggctg

SEQ ID NO: 171645 - DNA, 460 bp, Homo sapiens
ctccaaggcacttacaatacagccgacataatacaataacagtatcagtaaacttcctgtatgaccttcattatcttcaataaatttttaaaaaagcttttcaaatccattatataattatttcccattgattttactaaaattctattgattactctatctccatttactcaacttccaaatcatttcctttcctttattcattaagttgaattaacataagttctttacatgattcaagtctataagaagtcgaagggtatgttttttaaagtgcatttttttcattttattaagcaaacaacacatttaaaatcatttcaggacgaggaatggtggctcatgcctgtaatccaagcaattggggggggccaaggtgtgggaactgcttgagcccatgagttcaagaacagcctgggaagtatagcaagactccaccatctctttaggaaaaaaaaaa

SEQ ID NO: 171646 - DNA, 525 bp, Homo sapiens
tgtcattcctgggcttcctttcagatcctttgcttcctccgtctcttttggttttgtctcttttggttttcccctgtttaaggacatcttccaggacctttgctagaaaaggtgaatatatcaagcagataaaatctgaggtcttttatatctgaaaatgctttattctatctttacaactacaagaaatgtgatagttattggctggaaatcattctactctcagatatttctaaactaaacttcattgatgtataatttacatacaataaaatgcacccattttaagttcaacaaattttgtacagttcaacaaattttgagaaaggtataaacccaggactttccactcaaatcaagaaaacagaatatttctatcacctctaaaatttccttcatgttccttggctatcaatcttcctaactcaggcaaacaatgatcagacttctattactacagattagttttgcctgtttgagagcttaaaaaaaatctgaatatatatggcttttttcacttagcat

SEQ ID NO: 171647 - DNA, 215 bp, Homo sapiens
agccattactcgaaaagggtacgttatacctcacatgaccgacagacgaggaagaaacaatcagtttagtcaaaaagaggtatttagaaaatgttctttggccctatagccacccttctcatgttttccagcttttcagtcttggcactgctattccatgataaatatgatcattttcaccttaaacaaacacttgcttgtgcaggaaaagggaa

SEQ ID NO: 171648 - DNA, 333 bp, Homo sapiens
aacaggcatgtggaggtagatggaaaggcattccaaattggagaaaagcttgagcaaggcaaggaggcatgacgtgttcatggtattattgcaaattgtattttaaaacttcattcctgtttgttcctagtatatagaagtataattggtttttgtatattgaccttgtatccagcaacctagctaaattcacttatttctaatagcttgcttgtagatttttttggatattttacacataatgataatctaaataatttccattctgtttctcttttccaatcataatacattttatttttcttacattatagcactagtacaggccagtac

SEQ ID NO: 171649 - DNA, 787 bp, Homo sapiens
ctaattacataggggactatatgataaaagatacgatgttcatgtacaactattatctactatggagtttatatcactttcaagtgcctctgcaaactgttttttagcagggagaaaataagaataaaaatgggaaaatggaaatccaaagatctgattcctttaaagatgctgcaatagaagtagccactgccaggtctgcatctcctggtgcaatcagataatccatctatctagattggatagatacttgaggaggaataattcaaggtaatttccgttacaccactatccatgttttctcaagggaaaaacatgtatttgcttcttttgattaacatgttagtggctgcaactaaaacatcaagtggtcggccgagcagaggttttcctgctggttttacaaaatcagtacagcgggccacctctcagcatcagcttcgcctggatttacaagtaaactcttcagtatggctgaacagggtatgtgggtgtgtgtatattggtagctgtatggaaactggattgctctaataataaacacatttcattccctgcattgagggtgctggatccttgctaaagatccttttttccacttagttccataaatattccggggaagcatggcctagtgtgagttgtcagaatgagaacctgttgtgatatttcatcagcacccactcacagtgcacttactctcctttacctgtaacttacaccttctctgtaccctctggaattaaaccgaagagaaaggatgaaaacaagatgatatgtcagaaaa

SEQ ID NO: 171650 - DNA, 431 bp, Homo sapiens
tctgaggctcagccctcctcggagcccaccatctcgaggctcctggactgtaagggacccctgcagtccccagagcagaggccagcaggggctgagactatgaggcaagcagcccatcgacccaggcctccttaggaccagcccagccacccagcaagcgaaagagcagcagcagagagcagagccggagataaaggaccacagcggaccactggggatcacccccagcagctcctgaagcctctggccgggctgaggggttgcgacagacggccagacccacagacactgacagacacacaacgacaccgatgcacacagctgcacgacactgacacactcagatacaaccagggacagcatcacatactgccacagccctgcaatacagacacccacacacacacacacaaacaactggcaactctgaa

SEQ ID NO: 171651 - DNA, 667 bp, Homo sapiens
gatcctccctcctcagcctcccaaagcagtgggattataggcatgagccttcatgcccagcctgattatccttttgcaggctgctgttttttccacttcatatcaggaatgtctttcctctgtcaaaaaatagagtatggctcagcagtccctaacctttttggcaccagggactggtttcatggaagacagtttttccacagaccgtttcggggcatgatttcaggatgaaactgttcaactttagatcatcaggcactacttagattctcataaggaatgtgcagcctagatcctgcgcatgtgcagttcacaatggggtttgcgctcccgtgagaatctaatgcagccgctaatctgacaggaggcggatctcagtggtaatgaccacttgaccacccctcacctcctgctgtgcagcttggttcctagcagaccacagactccgtgatccaggagttggggacccctgatctacctttttcttttttttttaaattttgtaattaaaaagtcttttttagacagagtctcgctgtgtcacccaggctggagtgcagtggcacaatctcggctcattgcaacctgcacctcccgggttcgagtcgttgacctgcctcagcctcctgagtagctgggattgcaggcagttgccaccacgactggc

SEQ ID NO: 171652 - DNA, 435 bp, Homo sapiens
acattagcagagttaaattttacttaaaaaaaaaaaaagaaaaatcaagggacaggtctagcatcggtatacttatctatttattacaaataacagcaagcatccattatgcacagagaaacccagcagagaggtagagaacaactgctttgaggttatgtcttcaagtctgtaacacagctgctgaaatgatacacaagtaccaaaagaaaatacacaagtaaagcttacattacactacacgttaagaattaccaagcactggccgggcgcggtggctcacgcctgtaatcccagcactttgggagtccaaggcgggtggatcacgaggtcaggaaatcaagaccatcctggctaacaaggtgaaaccccatctctactaaaaatacaaaaaaattagctgggcgtggtggctggcacctgtagtcccagcta

SEQ ID NO: 171653 - DNA, 992 bp, Homo sapiens
gagacaggctccagcgaccccttgggaactcgcccccagcactacccacccccacagccatacttcatcaccaacagcaaaacagaagtgactgtctgagctttcaccacagggagcaccctggagaccacactcaactgagagaggcaaaaaacaaccccgcccacaccctccccatcctcccctaatacatgcgtccacacactcactctcaacaagaaccaactctaaacctactggggacacagagtcgcgcttttcctaggtcatgcctgtaacgtgtcggcgggcagctgagaaagaccgaagcgtggacattcagcaatacagcaaaggggaaaatgaggcacactctttccacttcaggcccaagatggccaactcacatgcccaaaccgtggggctgagttttcttttcctcctaacttgaaactgaaatccatggtgacaaaatataaaagtagcacaatttagagaaattgtccatttgagcacatacactacttgccacgtgctgtctgtttctaggttcgaaagccagggtggaaatgggggtagagaatgagggaggacacaagagaagagtgtattctggaagaggagttgttctgggaggaatttgcccacattagaagcatttttctaattccaagaagtggtgacgtggacgtaaaattttgacgagcatgaaacagtaactggaccccaaccattctatttatagtacttttcatatcatccatgttgaaagcaaaaaacaacacaccctcaaactcacagaaagtaaatagaccctgaacccaccgacaatgatgggaaggaaaaaacaaaaaacaaaaaacattttagagaactcccataaggaccatgaccgtggaaatgggagggatgggcttttacggagagggtccggagagtatcaaataactttttaaaaagaggattaaaatgtaagcccactacaaaacagataaaaacggcaaattaggtgt

SEQ ID NO: 171654 - DNA, 273 bp, Homo sapiens
tttcagaacaattttaatggaatagttttgtttattattaaaggtagaatgttgagatatttattggtatcagtagaaaccaagacattttcagaaaatatgaatgtaaacttaagttataaaaaaattaataatactttacctgttataaaaataaataaaccatccctggttttttcttttttataatttcagaggagtttcccttaacatcagtccttagaaaaatctcaccatgtattccaggtcacatttaaagagacattctaattt

SEQ ID NO: 171655 - DNA, 287 bp, Homo sapiens
gactgtctttagcaagccctgttcctaagggaatataagtagctttatataagctctttattctgcttaatacctttttctgtttctggacttagcatatacataaattattaaaatctttttctaatacatgcaaaagtgagatggggcatgtagaatatgaatggtacacgacatattttggtgaaagggttttatttccaaatgtaactatttaacttacaatgagttgtatttaatgatgaaattaaaaagcaaattaagtatccccattatgttctaaataa

SEQ ID NO: 171656 - DNA, 470 bp, Homo sapiens
tattgtggtgaattccagcctactcatgttgccttggggattttccccactgaaggagcatatattaactgatgccagctcagatcagagatcagagatgacaggacacagtccctgtccccaaggaaatactagtctggtctgtaaacaaatccagttcaactttggctaccacacacgctgaagacagagttaccctacagaaaagagagacagagctattcaagtcaccaggatttcccatctcacacttcggaaaaactttaaatatttctttaagttgaattaaaataatagcatgatgacaacaatagataatttattgagacatttctatgtgttaagcaaggtgcaaagtgcgttctgagtattaacccattgacctccttttttctgagatggaatctcactctgttgcccaggctggagtgcagtggtgcaatctcagctcactgcaacctctgcctccc

SEQ ID NO: 171657 - DNA, 649 bp, Homo sapiens
gcctcccaggaagctgcagaggaaacccctccaatctgcaccccaggagcctcagacaggaaccccttgagttatgcggcacgctcagcacgagttcctcgtccagaaaccctgacgacgcagaggtgccccacaggagctgggcccgagaggctcagccttgcctccgagtggaagcatgtccacactgccgctcggacaggtttaagtgacagcaggaatgtcatgggcccctggcctgtgtgaggagtggaatcctttccttctttccagtatttattgagcgcccaactttgtacaaacaccgtgccaggtgctggaggtcgtgaggtcacaaggggctgggcctctgtactgggggtccctccccagggtagaggttggcagctacccggggtgtccagcctcacttccccacacccgtggggcctcaccatcaggcttggcgctagttcctgctcacccggacttagcttcacaatatttctcagctcagctttccaggctccaccaggtcagtgcaggctggcgcacaaatggacacacctagaccgcctctggtctaacgctttcaccaggactacggctggatcccaaactgttttatcaagggataccaggggtgggtgcctcagtctgacccagccgg

SEQ ID NO: 171658 - DNA, 540 bp, Homo sapiens
agacctaagtggggaccattttaggactaacaaattggaagccagtaataaaagacgggcacaagggacaagtcaaacactggcataaaggggagatttgagatattgttagtcagtgccgagaaaaacaacacaacatgactcaagcaattagggagaaaatcattaatatagagcaaatccaacttaaaaaaatgctatccctgacacaaagagcttcagcaccaaataaatacagtgaaaaatattcaagtacataatacagaagaatggccttgaaattaagaaatcaccacatctgcagatctaaaaagtactctatattccttgaaaaattgtttcagaataatgggtgctgaaacatatgcatactaagtaatctagcattgaggataaagtaaaaaatatctagcatctagggaaaaaataaagagaagtccccggaaataaataaaataatataaataaaagataatctcagacttctccaaggtaacattcaatgctagatgatattagagcagtgtttaccagaatttg

SEQ ID NO: 171659 - DNA, 689 bp, Homo sapiens
ttccccaacccactgggcctaccggcactaaaaaggtcactttgtccctggatgaccaaacacaggccaatgtaacttactgggcttgttttgccccagccatagctgaccacttcctccttcactcttgttgttgatcacctttgggcttagtctttctccatctctgttgagtccttctcccctgccacctactccttcatgctggggttctctgtagctctgtacctgacagtcacgttccaccctttcctcccagaagctcgccaacccccgtggactgctggctctcaaggcggccactagcccagctccgacagcagctgacaatgcacagtatgcggcccagggcaggccctgtgctgagaggcatgggtgaatggctcatttcatcggcaagcccccgccaccagcaggcgccgttctcctcgcatttctcaggggaggaacctgagacaatgaggttaaggaagttgttcattacaagtggaagaaccctgacttacttgaattcaactttgaagcccacattctctttttctgtgtgtgtgacagggtctcactttgtcacccaggccgcagtgcagtggtgtgaacacagctcattgcagtctcaacctccctgactcaagcaatcctcctgccttagcctcctgagtagctgggactacaagcatgtgccaccacgc

SEQ ID NO: 171660 - DNA, 223 bp, Homo sapiens
tcacaaatttaatacaaggacctaactcttgattctctccacaacgccaaacctgtttttcctctaattgtccccacctcagtcaactatattatccacctagctgcctaagccagaaacctaggaattatcccagattattattcttttttttgttttgttttgttttttgtttttgactcactcactctgctcaggctggagtgcagtagcgtgatctctg

SEQ ID NO: 171661 - DNA, 673 bp, Homo sapiens
gtcttccacttccggattattcaatttatgttaggacaaatcttgactagatcaacctgttttccatcagataattttaaaacaatgtgtaatcttgtttgtctacattctctccccagtttagctgtatttgaattactaaatgctttatcgtcaaactgtacctagtctaacttatttttcttttgctgtcgttttacaagcattttaaaattctaatattcatctctggtggtgtttaacacaaggttctcttattcaagtttcaatataaaagtttttggattatttgggtgctagtttcttgcttggttatctgttcgtttttttaagttgatttgtaatttccaaagagttatgcatacagcaataaaattattaatatgcctcccttatcttttctgaattgtaagcaagggggaggttttagactgtaaaaccaaagttatcaaatctagttattatcatcctgtattggaggagatacaattcttttattttcacaatgttaaaatatgttttcattctccatttcctagctatctttttttaatgtgtactgaggaacctactctctggaccactaattatagatgctagagcccagccttgaccaggtggttagccccacaaatgaacagatgataaaaagctgcatttttagttcttattt

SEQ ID NO: 171662 - DNA, 148 bp, Homo sapiens
aattttaccatgttcttattcatattgtatattttatctgccaaggactggtaaagaagtatgaaagtctcatgcaactatagtattgcctttgggttctccttgtattttcagcagttatttatttattttgagacagggtcttgct

SEQ ID NO: 171663 - DNA, 103 bp, Homo sapiens
acttgcttaatgaactgaaattgatgtccttgggaaaaaaatctcctatgctagccttaaaggagattgttataactactcagtgttaagttcattaaacaaa

SEQ ID NO: 171664 - DNA, 369 bp, Homo sapiens
agctggtccaggctgtgtaaagtgaacaggcagagattccagccaggcctgagtccattctctccccagtccctggcctggcctcacctcctgcccatgtgctttctctcaacttgtcgcagaaaacaaagtttaagatccctgtctttcatggctccccataaaaaggctgaatctagaagtgaagaacttgaaatcctccagtcagggtcaagcccttatctgagcgcattgaaaggaaggagaggaaggggaatgggttggtgaggagttagaagcctctggccgggtgtggtggctcatgcctgtaatctcatcactttggaaggctgaggcaggcggatcacttgaggtcaggagttcaagacc

SEQ ID NO: 171665 - DNA, 208 bp, Homo sapiens
aatgcaaatctcattggcattttttttgctgaagtagaaaagaaattctaaagttcatgtagaatctcaaatgacctgaatagctaaaacaatcttgagaaagaaaaaaacaaaaacaaaaactggaagcctcacactttccaacttgaaaacaaattatacaagtacagtaatgaaagcagtatgatattggcataaacacggacat

SEQ ID NO: 171666 - DNA, 585 bp, Homo sapiens
agagtaaaacaatttttattattctatttcacagcagacaaattctcccaaatgattattgtaaataaacaaaaagtatactacaagtgtatttccataatactaatgtaaagaatataggaaaacaatatgattacttttaccaatattatatattttgatgttgtcattcgatagtggaggaaacaattatgaagagagtggaatggagctgcaagtacccatgctcaaagaaataggaaataagcctgaaagacttgcctttaccccatgtgttcttcccttccatcacatacaatcccaactcaacttgttgatctacttattttatattttatgttagtttataatttcaacttttattttagattcagggtgggtatatgtgcaagttcgttacctgggtatattatgtgatgctgaagtttggggtatgattgaacccatcacccaggaagtcagcatagtgctcaacagttagtttttcacctcttgccaccctccaggggaaaacctccctcccttccagtagtccccactctcatttgttgccatctttatgtccatgagtaccccacatttagc

SEQ ID NO: 171667 - DNA, 430 bp, Homo sapiens
tgggaggcttggtgctggctgaggtgtgtcagtgactgccacgggctgcacccctcactgttgcctgaagtcacccaaggtcgcccaaggtcagtgggaaatatccagggatgacggtggatcctgggagcgcctcacaacagctaccttcggcacagcacgactttggaaggcctaaagtttgaaccaaaaatggagcccctgccgctctccccatatgggattcaaattgaaaagctacaaggaatgaatgctatggataaactgctgaagatggttcctgtccatttgactctgaagggtgtcttctttcacgttgaagaacaggagacaatcaaaatgtgaaacgtatgctgaagccaaccagaacatcaaaggacagtcaaaagcgctaaccatgaaactatatttctactaatacattctttta

SEQ ID NO: 171668 - DNA, 295 bp, Homo sapiens
tcagagggtaggtaagaaggatgtcaacagtctttcctcaagacagctcagactattaagtgatttgcataaatcaaggttattgatttaacaagtctggttatttggtttctctggtaacctttggttctattctagtagtaatcagattaggaatttaagaagaatgagggagctccccaacaaaggtgacagccccaaaaagtaattgataatactgagggggaaaccccaagatatatagagcagaaaagaacagggctgggcgtggtggctcacgcctgtaatcccagca

SEQ ID NO: 171669 - DNA, 494 bp, Homo sapiens
gatgggagcttcccaaacagtggaagcgctgagcacagcagcgagactccatgggggaagccccgctgggcaggagctgtgtgttggggctaagaatgcagctgggcgtccactcacagccagatgctcacgagaaccccgctgcttaagggcaggcaggagggtgttctgatgggatgggggcacggacccccagggtgggcgaaaacagctcccactatctctgtggagcacacgacaagctcgcttggcctcctggcgccatacgtggcccatggctctcaaagcgtcaactgtcagagcccctggagtgtgtgcgaggcctgggtgacatccggggatggggccaggccctcctgcccagcagggtgctgatggggaatcagggcaagagcctagagtgctcggcagcgacgggtgccaggcacgcagaggccacgtgagggagcacccagtccaggctccgggcagctgtaagccgggatgactggggc

SEQ ID NO: 171670 - DNA, 239 bp, Homo sapiens
ctgtctcatgtcaatccctttgtgaaaattagagcttttaaagtctaggtttagcttgcttaaactgagaaatggccaggcaaatagtcatgtcagtagaaatataacatctaaaagtcaagatctttttcccttcctttagttgtcattatttgtgaaatttcacaccagaagacaattgtgattttttttgaaccagaaagattgtgaaaattagctcgtattagacctgtgatgaa

SEQ ID NO: 171671 - DNA, 288 bp, Homo sapiens
ccctggcccagcaggtggcctcccggatcccctcgcttctggagccccaggcatgctgtcggacacccagccctgctacctggacctgaggaatccagtcttttggaaatcggaagactggaaagaagagctgggtctgtgagggtggcagtggccagtctggggggtgcagaggaggcacatcatgaagcctgacaccagggtactcgtcacgtgatccaggggtggtgggcagcagtgctttgccaaagtacatgtatcggtctgtgtcagggctacagctcccag

SEQ ID NO: 171672 - DNA, 668 bp, Homo sapiens
tctttaactgcaacctttattaggatatgacccactgtacacattttaaacaggaatcctacatttctccaaaagtgagacataatctaaactatggctgcaattggactgaatcagtaatatactgaacaacactgaatagaaagcagcaccatacaattgcatctaactattgcagttaaaaagatttgaaaataaaaaaagcaaattactcttctgaataagaagccatgtcaattacacgaatatattcttacaatatgcaagactggacataatggaaactttgacaaaaactgaacaatcatggaataactatatatccatttcaaattttaaagtcttggccgggcgcagtggctcacgtctgtaatcccagcactttgggaggccaaggtgggcagatctcctgaggtcagatcgaggctatcctggctaacacaagtgaaaccccaatctctactaaaaaaaaaaaaaaaaaagaaaaaaaaaaaacatttggtggggacgccctgggccctgagaaaaaagttttctataaacccctcgcggtggggcgcggggcccagtggtcagggtgacccggggccaaggcgggttgccaagagaaaccccggggcaaggacaagggcgtgggtttcctccccaaataaaaaaagccccggggc

SEQ ID NO: 171673 - DNA, 504 bp, Homo sapiens
taactatggagaagacattgaaaccctagcaggaatttcctggatgacaacagatgctttacataatttaaggatactgggatttattcaggtttgaatacgtttgttgagctacaggaatgccacaggggttgtcccttataacccagaggatcagggtctctgttgagatagaggcatgggcagcggcagcagcagaggtacttaaaggtccagctgagtgtgaacttcaggacaccatctaatggtagcttccccaccttctcttctttcgcattttttcttttttcttttttttgagatggagtctcgctctgctgcccaggtttatgtgcagtagggcaatcttagctcaccgcaacctccacctcccaggttcaagtgatactcctgcctcagtctcctgagtagctgtgattacaggtgtaaaccaccacgcctagccttctttctcacttttttttttttttttttgagacggagtcttactctgtcgcccaggct

SEQ ID NO: 171674 - DNA, 401 bp, Homo sapiens
tcatcttagctaggttccccaggttccctacacaacaccccagactgctcttgcttcctcagacatacccttcatgggcagagccttgcaactgacataggccagaatacccttgtgccacacttatgaaaagctaaaatgtgataacctttgtaaaatattccttgatttccttaacttattattattaacatccagaatttatttctccctttgacctcttatggactttataccttaattatgattcatatttggtaccctactgtcatttatatatctgtgtttcacattagattctgtgtgtttttagactaggatattatctgtctatttattcttagatttagcacagtacttgcaggtagttaagtacacaataaatgttcattgttaattta

SEQ ID NO: 171675 - DNA, 365 bp, Homo sapiens
aggccacggtcagcgctcagcccctcccctgtgtgtgagaaacagattcaatccacggtggtcagacatgggcgtctgccccacaggtgagtgtgaggctggcattggtcccatccctgctgggcacaatcttgagctgacactgagtttgggggagtggggcaggagcagcggcaacaatccccttcatcaggctgatgcctggacagccgtgggagaaaccctttatgaaaggtcaggtgcgtgggaggagccgccccacaggaatgacaaccatatgaggacaaaatagacagttgttgaaatgcattagacagacatcgtgaaggtgaaaaactatattaaattaacgccattaaaaagga

SEQ ID NO: 171676 - DNA, 415 bp, Homo sapiens
gcctcccactctgtaaaaacacaggagccctatgccaagcagccatggttagttagctctttgacctcattttctaccactgtccatttgaatgcccctgccacgccagtctctctgctgttcctcctttcacattctgcagcgcattgttttcttcctattttctccccctccaatggtccctgacatctgacgtgggtccctgaccacctcgactcaaatcttacctcatcagcaaggtttccctgaccatccaattaaattgcaacccctcagcacacactcacttgtctccctttctttccattctttctccatagcagttatcaccatcatacacaggatttgtttgggtaaattgtcttgtttcttttatctcccctatgtttcatcttagtgcaggcagggatttttg

SEQ ID NO: 171677 - DNA, 352 bp, Homo sapiens
gaggttcagcgagagcactgaagcagagcgctgggtgcacggtagctggggcttccagtagctggctctgagttgaagattcaagggcaggtgggatcaggtggggtgaggggatacctgggaggtgaccccaggaagctcctggtagggaatgggacatgagacaggaagggaaggagccctacagggggcaccaactgccaacagacatgacacatgtggatgagtggcgctcagccccgcctgggacagctgggggacagtgtagatgctcatctcagaggggtcccactcaggggcgaggagcgtggggtgttttggtttgggtttttttttttttttttttagacgg

SEQ ID NO: 171678 - DNA, 333 bp, Homo sapiens
ggtgagagcaagggtcaaatatcaaacgacaaggcctgtataatgtaggctgtctaatagaagacactctctacaataaaggggagccaaggagctaccaaatctgagtaggtgtgaactaggggtaaaccaacccttttgtagatttgtagcttgagtttgcatcatttgggtaattcagagaacctcaacccttgaacttgattaatattgcttctagactggatgcaaacccaggtacttttcagaagcaaataacattcactaaaggaaggtgccttctatttagacttcaaattatcacagaaaatatattttcagtatcatgacaag

SEQ ID NO: 171679 - DNA, 454 bp, Homo sapiens
acatcgcagtgatcgagctcggaccagggttgcttggattcccagaggaggagacatctgtgctgggttttagaggatgtgtaggagttcactgaagaataaaggaacagtccatgaagagggaacagcatctgggtaggcatgaaggaaaaagagacaatggtatgctctgtgctcaggagggctggtagaagcgtgggatgtacagactgggcttacatttgggagcattttgggctcagcattttgggaggctgaggtaggtggatcatttgaggccagtagttcgaaaccagcctggccaacatagtaaaaccccgtttataccaaaaatccaaaatattagccaggcatggtggcatgggcctgtagttccagctactcaggaggctgagccaggagaattgcttgaacccgggaagcggaggttgcagtgaaccaagatcacaccact

SEQ ID NO: 171680 - DNA, 152 bp, Homo sapiens
gccccagcctccctacattgaatttgaaaggatctttagtgtcaggattgttcagattccagataagagtaattcagaggtatagtgaattcagctgtttctaatgtattgggagggcggaggagggagatgcaaagtgtcctaggggtttc

SEQ ID NO: 171681 - DNA, 442 bp, Homo sapiens
cacccacctctcagtgatggaggagtttttgaatcatgcaggttcttggctcggagacagcatggtctatacagaagcagcttggatttgtcaagacctcagttcaccacgcagctctgctgcattttgagtacctgtgggtaaatgacctcacctcttcagccttatctgtacaatagggatgataacactcagcttacttcacaggcttgttgtagggagaaggtgatctattgtttcctaaagctgtttttgaaaacggtgactcactctacagatatgatttgtgtcttctgttttctcctgcctgatgttttccattttggcaacttagaatctaggcatacctcaggtagagcttgctgacacactggtctatttttgaggtgggtaatactaatattgagttcaagagaattttttcccccctctgaactatgct

SEQ ID NO: 171682 - DNA, 362 bp, Homo sapiens
ggaggctgagacaggagaattgcctgaacctgggaggcaggttgcagttgcagtgagccgagatgacacaactgtactccagagcctggacgagacagagtaagactccatcaaaaaaagaaaaggaaagggaaagggaaagagaaagaaaaaggaaaaaggaaaaggaaaggaaaggaaaatagagctctataaatcaatacaaataaggacaacctaatggggaaaacatgagcaaaaagccagttctcaaaaattaaagagccacaaatcacatgaaaacatagccaggttctcttgtaatcaaaatgcaagattagaacaaagctggcacctcttgcccattggccaatatataatga

SEQ ID NO: 171683 - DNA, 391 bp, Homo sapiens
tataagttttggtaggctgtgttgtgttcattcatctataagtattttctaatttccatgtgatttcttctttgattcactgattgttaaattccacaattttgtgacctttccagttttacctgttattgatttttaacttcatcccattgtggttggagaagatactttgatatctattttttaaatccactgatatttaatctgtagcctaacatatggtgtatcctggaaaatgtcctacatacacttgaaaagaatgtgtatgctattgctgttaggtaggattctgtctgtgtctgtgagatctagttggtttactgtgttaagtccactatttccttacttattttctgtctggttgttctatccattattgagagggggtact

SEQ ID NO: 171684 - DNA, 525 bp, Homo sapiens
ctgatgtgcagggactccctaaatatgtgcacatagcaagtatggggtcatcattctagcccagctgtgacatatttattcctaaaggtaatatttatctctgaaagttttaggagttaagtgttgatgactatttattcccttgctgtagagcatcccttaggagtgaactcagaagatcattaggcagagatagctcaaattcttttttcctacacttgctttgattctgtaagttgtttcttttctgccaacctgctctataatttgagtcagcctagctaactgggtcatacaatctaattctgaaataaggcctgtcaagggaaaacattttccccagtaatggggaaaaggtacttgaatttctaacatcattctttaagtgattgaaaatgtcgtgaactcttgcttcactgacttctgcctctcctgccccaaggtctttgcacgtccctaaagatgtaattcagctggaatttgtggttgtggagtctatgttacatgaagacaaatcgaaagaga

SEQ ID NO: 171685 - DNA, 469 bp, Homo sapiens
agcaacatttcaagttcccctagccacagttttagggtagctagtgctgctgtattgaatagtgtagccttagactttcaactgctaggactagggctgactttgtagttaaatagccagtccccatccagacatccccagatatactttatcccaaagaaattttttaaaaaatgcaaatactactaaaaagggccattagcaattctcagcaaacaccatattgctttgattcaaatccatattctctatgattctcccatttaaaaatttctgggattggagtttcatatgggatttgtatgtattatgtagtagtgttttttaccctttcttaaaagctattatcagatttatgatttgtctcagtgatgacattgtagaatgctgcatttttgtcacctattaaaataattatgtgatttgttaatagcaagtttgagcacagggacactttcatttttctacc

SEQ ID NO: 171686 - DNA, 589 bp, Homo sapiens
ctattcgataaaacataaattgaagtcccccaccccccacaatgaagttgttccagttccctccactgcatgtcacaaactgaatcctaagtatgcttctagaacaaatcacactgtaccctggttatctgtttacttgtgtcacttggctagattttaagcacctcagaggcaaggacctgtcttcatctgcatttactcagcaactaggacagtatctagcatacagctcaaattactacatacttatctatcaaatagattcatgaatgaagcaagtttctagctaccatctttgaaaatggatcaactgaaattaaatgcaaatgtgtacctatacagcattaagatcaaagatttgggatctcaacatcagagtccccaaagtgtaaaatatccagatctgttttaaaatctctcaaactttgatgggcatacaaaccacctgaggatctcataaaatgcaggttctgcttcagtaggtcaggatggggcctaagagtccacatttctttttttctttttcttttttttttgagacagagtctcgctctgttgcccaggctggagtgcagtggtgctatcttgg

SEQ ID NO: 171687 - DNA, 256 bp, Homo sapiens
aggttcaaccccgatagcaatcaaagaaatgcaaatagaaacaatgacaacacgtcagctcctccctcccgcagtaaattatgaaagatttttcaaataacactcaaagctggccaaggtgttccctctcctccaaagctaggaggagtggccgttggcacaacatttccggaacaccatttgtcaatctgcaccaagagcctctgacccagaaattgcacttctggaaagcaagcctaaagaaacaactgctaga

SEQ ID NO: 171688 - DNA, 360 bp, Homo sapiens
aatagccagggtgtcatgggggtgcaggtaagagcctagagggagggaccccacctcaacctgggagtaatggggaatacttgaaagagcatgtaaccttgagctgaaccgtgaaagagtagcatgagtaaaggtgcaggggcatagaagagccaggaaacatatgtttcaggtggctgcagtgaggacaggctggagatgaggtctaatgtaaaaaggggacagataatggtgtgtggggaatttggactcatccttactctagagtcagtgaaagattttaaatggttagatttaggtttaccccctcctttccttttttcttccctttctaataatcattttggtagtggacgctag

SEQ ID NO: 171689 - DNA, 448 bp, Homo sapiens
gcttctgttgacctggtagggctggttggcttggtccagttggtgaaatgcctctgcaaaaggttacctgcatggtaaggagaagaagtagagcgtggcgggggaaagggagctggtggctcactttgggggctagtcactaatttggagggagagggggtgactggctttatggatgggtctttctgtactttggtggtaggactgtctgtggtctgaggtgcttcagcctcaccactaggctgagatgtaaagagagatttgggccggactggcgtactcttaggtgtgctcttagcaacatcagcatctggaggaatggcataaagctcttccacactgcaagctttagggccagatacagctatgtccagaagaacctattggagttcgatacaccggcaatcatcagagagccctgggcgtacgggatagtatgggatcacac

SEQ ID NO: 171690 - DNA, 492 bp, Homo sapiens
cctcagcctcccgagtagtagggattacaggcatgcgccactacgcccggctaattttgtatttttagtagagatggggtttctccatgttggtcgggctggtctcaaactcccgagctcagtgattcacctgccttggcctcccaagttattattttttttatgagacttgatcttgttgtgttgtccaggctggtctcaaactcctgggctcaagcaatccttctgcctcagcctcccaaatatctgggatgacaagtatgcgccaccgtgtctggctattttaattttaataggagttattttatattctcgctatcttcttccattctgtttgccttttttatagggtcttttattttttgaatttgaatttttgaattttatgaatctctgtggtaagtactctcgttttaagaatctttctgggctgggcgctgtagctcacacctgtaatcccagtactgtgggaggatcactcgagcccaggag

SEQ ID NO: 171691 - DNA, 216 bp, Homo sapiens
acacaggattaagaagtaggtaaacttctgaaagttcagtatactagaagcactcaaaccagtaatatgccaacaacctgatgcactgccaaaagaaaatgtgaagttttcctaatagttgtattttagtacagtggtgaaactggaaagggcacttggggtttattagaacgaggcagagtataccccaatgtccctttctctaaatgcagtgga

SEQ ID NO: 171692 - DNA, 176 bp, Homo sapiens
agtagagacggggtttgaccgtgttagccaggatggtctcgatctcctgaccttgtgatccacccgcctcggcctcccaaagtgctgggcttaggggcatgagccaccgtgcccagccgataattatcaatttttagcattaagctttccatttttgtctggcacctgagagttaa

SEQ ID NO: 171693 - DNA, 840 bp, Homo sapiens
tgcctgattttcacacttactagaaagctacattactcaagacagtgtggtattggccgaaggataaacatattattaatggtatagaaaatagttcagaaataggcccagacacatatatttatctgattttcagcaaaactgctaaggcaattcagtggaggaaactggtaatctttttaacaaatgatttttggacaattggacatctgaatgcaaaacaatgaatcttaacctttaagtgggcaatgatttcttagacatacagaaccaaactgtgaaagaaaaaataaaccagctgtacatcatccaaattaaaaacttttgatcttcaaaagtcactgttaacacaattcctatcaaaatcttagcattattttttgtagacatggacaaatttattctaaaatgtatatagaattatgaagtaactggaaacaattttgagtaagaagaatagagctgaaaaaaatcacaccactagattctaactaagacgtaacatacagcattatactcaggacactgtggtattgatcaaaagatagatcagtgaaacagaattaaaagtccagaagtagacccgtacaagtagagccaactgaagtttgacaaagatgcaaaagtaattcagtggggagaaatgatgctttttgcaacaaatggtattagtataattagataataaccaaagaaataaactttgacttaaaactcttatacaacagttatcatagatctaaatgtaaagtgtgaactataaaacttttataaggaaacaaaagagaagatctttttgatctagggccaggtgaacatttcttgtaccaaatccataaa

SEQ ID NO: 171694 - DNA, 690 bp, Homo sapiens
tgcgtgctaccgtacaagctgctaaccataatggttttattatccctgacagcagcaatccaccagcatcagccacccacatgttgcccttgagactgccaaatctgtaaacgctctgaggctccacagaggggctggaaagtccgtgtggctttgcttcctaacagtcttgcctgtcatgtgtaatagacaggggcctgctggcttctggctctctagaaaacagtcttaaaagctttccccaagtcccaagatgggttaaaaccatcacctaaaaccataaagtttttaaaatctcacaatctcaaaatgtaaaattaactccaagttacacaaacaaaaataaggcaaaaaaggggtcattttcaagatcaatttcccattttatgaacattaaaacatttcatcaaaatccagattctggatgttgccatagctccctgagacagaaaaataatattgaggaaaaaaccccactcatttacccttgatagcttttccaatggaattccttcactactctgaaaccacactatgccttgaatatgccagcaaaaggcatttttgtaataaaaatgtttttcatggcaagacctaaaaagtatcaacacgaccagacgttaatgtatgtgacagcaaaccagggaggtagtacacttttaaataaactgctgcccttataaaaagcta

SEQ ID NO: 171695 - DNA, 439 bp, Homo sapiens
aaaccctgtcattctcaccagggaagcccaaccagccccatcacaagctcttccttcgtcacctggatctcgtcagcctctctgccacccaagggtcccatcaccccacagcctagccgggccccctttccactcttccaccacgttccctgcagcctctctgagacttcaaggctctcgcaccggcgcctctgaaacccccggcccgcagagggcgccgcgtcaaggacagcgcgggcagactcgggagggggcggggccgcagccacggtcgctttttatgaatgggggagcgggcggtgcgaggccttattactatgccgcgcaacgcgcgctgcgccccagcgcgccgcgcccattggctgatcggaccgctgacgtcaccgaaccggtggccgggggcggggcggggtgactcacgccgcttctcccgcggccg

SEQ ID NO: 171696 - DNA, 458 bp, Homo sapiens
tttctttggcaatctcaattgcaaatgaggataaggaaaatcctcccagctcacactctgctcccagctacttgttcttgagttaaatgagggcttggctctggcctcagggggcaagagcactgttcgttatttggtggtgggggagggggttgggggatccgtcagcacttacatgcctttagagaatctgcctttacagaacttgaagagctctgatggaggaacagagatgctgtggtggtagtggccttggaggtggtggtagtggcaatggtgatgatgatgatgatgaaagaagaagaaaacggtgatggtaaatgtcatctataaacacaagcaaaaagcagcaacagatacctttctagtcattgccaaccatagtcatgaagctgcttctgttcccaatgcaatcccattgtggtgctccccctctgcgctaaacacatccagcttca

SEQ ID NO: 171697 - DNA, 409 bp, Homo sapiens
cagtccctgctttcagagaattcagagtcaactgagggagaaagcaatgtaaacaatcactatgctagacagactatgataaatcccatagtagatgtgtgtacaggatacagcaatcaatattatagttaatgtttattggacagttaatacatgccagacattcttctacacatatacatactctcatttaaacatttctatgagggagacctatatctatttttacacaagaggggaatgagtatcagagagattaggtaacttgttcagggtcacagagctagtaagtggcagcaggatggtaaacccagtgccacctgatttcaaagcctatattcctaaccgtatgtctattctggtcttgtaactctttgaggatctcatgacaactatagatatatgccca

SEQ ID NO: 171698 - DNA, 225 bp, Homo sapiens
catgcaaaggaaattttaggcactggcagaacagaggtggggcattatagagatctgccagctgtttccttaaataatgcaaatctccttacaacgtggcaagacttcaaactgttttcactaatttctcagggaaaaaaaaaaagacaaaagtaatctgaaagtgggggggatggaaaattccaaaagctaccccattagtaatactgagtgactgaaggaata

SEQ ID NO: 171699 - DNA, 488 bp, Homo sapiens
ggcgccatcttggcttactgcaacttctgcctcccgggttcaagcgatttcaagaaattgtatgtgaaacaatttcttgatgtgaagtaggggtccagtttcattcttctgcatgtggctatccagttgttccagcatcatttattgaaaaggctattatttgtctattggatggtcttggcacccttgttgaaaatcagttgaccatagattaatggtttttttgttttgttttgttttgtttttggactctcaagtttattccattcatctttatgtcttatcctgtgctagcaccagactgtctggattacagttgttttgtaataaattttgtacttgggaagcagttttgctattttgttctttttttttttttttcaaattgttttggctattttgggctccttgcaatgccatatgattctaataatttgaatcttctttctttttttcttggtcaatctagagtcctttgttttcttgca

SEQ ID NO: 171700 - DNA, 265 bp, Homo sapiens
ggtgggaggtggagctgggagtagcaagatcgcaccaccacacccggcctgtgattcattttgacttaatttttgtttaagaccagaggtatatgttgaggttcttttctttttttcacatgtagatatctagttattccagcaccatttgttgaaagaactatctttcctcaattgcattgccttggcacctttgtcaaaaatcagttgactgtatttttatgggtctgtttctagactgttgcattctgtgtatctgtccttt

SEQ ID NO: 171701 - DNA, 675 bp, Homo sapiens
gccttccaagtagctgggactaccggcgcccgccatcgcgcccagctcatttttttgtatttttagtagagagggggtttcaccgttttagccaggatggtctcgatatcctgaccttgtgatccgcccgcctcggcctctcaaagtgctgggattacaggcgtgagccaccgcgcccgacctattggtttctttttttgacacggagtctcactctgccacccagggtggagtgcagtgatgcaacgtctccctcttgggttcaagcaattctcctgcctcaggctcccaagtagctgggattacagaaaactcttgagttctccctgaaaggagactaaagaacaatcctctgcagatgtgtctgaatcctaaaatgaacttaaggatacatgtgcaggacgtgctgattagatttttgccagtgaagagtgacagatacaatgagaagatatccctctgtaagtcggcgaatgggccctcatcagacattggatctgtgtgcaccttgatcaagaatttcccagcttccaaaactgcaagaaataaatgtttgttgtttaagccacccagtttgtggaaagttgttaaagtaacccaaactaattaagatgaggacgatcaaaaagttcaaaggatttgagaaataaagcactggggcagattgtaactgta

SEQ ID NO: 171702 - DNA, 525 bp, Homo sapiens
gggattacaggcatgtgccacaacacccagctaattttgtagtttttttttagtagagacagggtttggtcaggctggtcttgaactcctgacctcaggtgatccacccacctctgcctcccatagtgctgggattacaggtgtgagccactgagcctggcctctttgttgactttttgtcttaatgacctgtctagtgctgtcagtggagtgttgaagtccccccctattattatgttgctgtctctctcatttcttaggtctagtagtaattgttttataaatttgggagctccagtgttaggtgcatatatatttaggatagtggaattttccttttggactagtccttttatcattatataatgtcactctttatcttttttaaccattgttgttttaaagtctgttttgtctaatataaaaatagctactcttgcttgcttttggtgtccatttgcatggaatatctctttccactccttcagcttaagtttatgtgaggccttatgtgttgggtgagtc

SEQ ID NO: 171703 - DNA, 213 bp, Homo sapiens
tgtttgtttgtttttgttcctcacaaataccagatgtcattgtatttttccttctttcttatcagtgcaccctggaaactgcttcagattagttcatagggattagcctcattcttttttatggctgcatagcactccactatgtgtatctatcagtgtttagtgaaatagtctcctatgttcatttaatttccaatattttgtctttttttt

SEQ ID NO: 171704 - DNA, 301 bp, Homo sapiens
tgagctcaggcaatccacctgcctcagcctcccaaagtgctgggattacaggcgtgagccactgtgcccagcctacagggagcactttagctgtgttaattgagaaggttgttcagtgtatctaatcctaccatacaactaaaaatggaagaccctattaagctccttgagttctaaaaacctcatgtagggtgggcgcagtggctcacacctgtaatcccaaaactttgggaggccgaaatggccgagatcgcgccactgcactccagccttggtgacagagcaaggctccatctcccca

SEQ ID NO: 171705 - DNA, 372 bp, Homo sapiens
gtgactgtggacagcccctcagcagggggtcatgcctgtggacagccccgcagcagggggatcatgcctgtaaacagccccacagcaggaggatcatgcatgtaaacagccccacagcagggggtcatgcctgtggacagcccctcagcagggggtcgtgcctgtggacagccccgcagcagtgggtcgtgcctgtgaacagccctgcagcaggggtccgtgcctgtggacagctccgcagcagggggatcatgcctataaacagccacgcagcagggggtcatgcctgtggacagccccgcagcagggggtcgtgcctataaacagcccctgcactccagcctgggaaacatagtgagagcccatttatta

SEQ ID NO: 171706 - DNA, 236 bp, Homo sapiens
cagaggcacctccggaagggcctgggtgaggctgctagacagggcagcggggcaccctcctcccggagcccccgcctctgggctgaggctcggatccccaccgcctcctgcgcatggaggaggcgagaagcgcagggagacgggggccccagacggcaccccgcaggctgccattccttcaaccaagatgtagagaacgccgtggacaaaagctttaaaaaaattctgaaacctct

SEQ ID NO: 171707 - DNA, 329 bp, Homo sapiens
aatcccagctacttgggaggctgaggcaggagaatcacttgaacccaggaggcagaggctgcagtgagccacgatcacaccactgcgctccagcctgggtgacagagcaagactccatctcaaaaaaaaaaaatgtggttattactttatctattcacaacacttccctacagactcctggagttcaccttctttccgtaaacagggaaccaaccaacagacacgacatatcctccctctcccactactctatccacattcttggtttccttttttctttcacttccttctggaacttgagagcagaagtcgcgcgggatcctctattt

SEQ ID NO: 171708 - DNA, 572 bp, Homo sapiens
aatcccagctacttgggaggctgaggcaggagaatcacttgaacccaggaggcagaggctgcagtgagccacgatcacaccactgcgctccagcctgggtgacagagcaagactccatctcaaaaaaaaaaaatgtggttattactttatctattcacaacacttccctacagactcctggagttcaccttctttccgtaaacagggaaccaaccaacagacacgacatatcctccctctcccactactctatccacattcttggtttccttttttctttcacttccttctggaacttgagagcttgtttggaggttctagcaggggagcacagctacttgtatacccttgactgaagaccagtcctctatcggggctggtcgtcctcttcgacctagcatgcagctttgggagggacgcacatggagcggtgagagaggaaggagacacctacctatccagccagatcagctgaatcaaccctggcgatcaatggggtgacagatgtcgtaggaaccttatcaatctgggtattctgagtcagtttcgtgtacagtgatgatgatgattat

SEQ ID NO: 171709 - DNA, 164 bp, Homo sapiens
tgctcaggagttgatctaagacaggctctaattgcaccttaataagcttgttggggaggagttgggggtggggacataacaagccctacctgccagggtatccgggtgacagtggccggtggccgagcaccccggcctgaatagctggggactaatgcaggaga

SEQ ID NO: 171710 - DNA, 562 bp, Homo sapiens
ggacctgtaaaagagatagcaaaaatggcaaatgacactatcaaaactacttttcacatttcaaaggatgaaaagccaggagatttttctcacctccacatctctgtaaaatctttggtcatgttaagagaaaaaaaaagtaataactttttaaggatattttttctctgtgacagcatctacataaaacattaataacagcatctacttaaaacaaagagcaaagacagatcgatgtttggctttgtctgtgaacatttgttaaaaaatgcgagtagatcagcattatgatagcgaggcaggaaggcaggcacggattgggaattggagttatctagttcttgacccagacaaacctgagacccattttatcaagtcagtgaggcaaagtactcctcactcaggtgtgctacctttggtcagaacccccccaccatgagaatgtcagaactgcagagtcccctggcagtatactttattttaaaaattgattcatttctgaaagtggagctcgactgtctcctgacctgctgtctgtcctggtcctacttacagtgtggta

SEQ ID NO: 171711 - DNA, 544 bp, Homo sapiens
ggctatggtctgacatcagcaaagcttccctttaactgataagacaagcaatttcattttcgtccttagtgagtgtaaggtattaagacactacctaaaattcttcaaaatggtatcttcttctctccttgccaagctgtgagactaacaatacctttgacaagctgaaaaatttcttagctgcctgctgtctccgcaacaaatttccttcatcaactaattcactaatttgggccttcttgagaactcagctaatttgtaagaacaggtggcttattccataagtgttcaataaagattcacacatgattacacatacagcattgccttaaaaacaaatgaagaaatgtgtgtatttatggagaagctaaagagacagacaagagattctttagtagctaactgtgtgcatctggtgatctggcaaaattcttcccagaaactggtgggggaaggaagcagaagtaggtgacataaggatataaagtcctggtcacatggacaattaactattcttggggaagctaccaagaggttatagata

SEQ ID NO: 171712 - DNA, 875 bp, Homo sapiens
caccatttccttgttcttctttctacttactcctgcccagcacatctgtattgcctgggttgtacctgtaatggaatcatatagtgtacaatcttccgtatctggaggtcagataacccttcaaagaaacttttgagaacaaaggtgatggttagagagccatggaggcatgaataatgatttttttaaggtgggagaggtttgattaaaggcttgagggaaggagccagagaaaggacattttaagatgtaagagaaagaagagatacccaggggggtaaggttcctgaggtggtagaaggagatgtcatgtggaataaaaaacctttgtaaaggttccgaaaagctggagggaaaggggagttttcgtaataccatctttcttggtgactgctgggttgaaagctgtttcatgacttttccgtggctatagtttgtttttgctggtgacagctgctgctttagaggatgcccttggctatgctctgtgaatggccttgtcacgaacactttctgtttgtctcctcccttgtagtgcgagctgttaatgctcagtggggccccaggggaggtgggctctgtgctcttctccctgttctggtccgtccaaggcagcctgctatcctggtgctacctgcagctgaagagcacggactctggagccaaagatcttgccgtggaccttattgaaaaatatgtgggccagtttctggcaagcatgagagcgattttggaatcccttttctcacagtacagtggaaaaaccatagtagaaagattatgtaactcagtgttttcaatggcagctcgtcaactggttatcttcctgctggacttctgcactttagacatcccacactgcgtgctcttgagag

SEQ ID NO: 171713 - DNA, 449 bp, Homo sapiens
tgaagagtcttggtaattcagaaggtaccccaaaatgctgccataccatccttcattctgacaatgcattcataaagaattccgcgtttcagagcaagtaagcacaagctgtgcctctgtgagtgcctaagggtactgctttacgcgtgctatattcatgaggcaatgattgtgcaaatgttttgctagctcagagcgttgagagcaaaccgtgggatgccttagtgggtagaagggtaaggaacaaggaagaaaaaccgattccgaagtactgagtgaaacagggcattctgcttgttgctagtgaactgtaggaatagcatataagggaaggtagtaaaaaaaaatttttttactcatttgaaacttcaatttataaagcatgatttgggaaaatttattattagatctttttgttgttgttgttgtttttgagacagagtctcact

SEQ ID NO: 171714 - DNA, 252 bp, Homo sapiens
agcgattctcctgcctcagcctcctgagtagctgggactacaggcatatgccaccacacctggataatttttgtatttttagtagagacagggttttaccatgttggtcaggctggtcttgaactccttacctcatatgatctgcccacctcatcctcccaaagtgctgggattacaggcgtgagccaccatgcccagccggggtcctttgaaaacacaaacctgaccactgctgtaaacctttcgatggcc

SEQ ID NO: 171715 - DNA, 298 bp, Homo sapiens
taggagaagcccaaataacataatatatatattaagatgtcatagaaataagcaaagggtgatttcaaatataaaaaagccacacaggcagatgctctaaactgcagtttttcatgtaccatcaagttgcttttcacattcagaactctatgtctactgctctgtggagggaggcagcagggactgatatactgaatgatatgaagatcctcctagtcacagtcagaagctcccagcaatcagactagataaaccacaaagacataccaaactcagtgtacatgcaaaccagggaaga

SEQ ID NO: 171716 - DNA, 656 bp, Homo sapiens
tttctccaactcattcaagtacaacatttggaggccccagcgagaaacgccatgaggagagagccgggctcccccggaaggacggccggcttgtggggggtgccacctaaaaaaaaaccttcaggtcctcgaaaagtgaccgtcttccagaggagagcggatcgactacccggtgggtgcccataaaaattccacctctgagtcctcgacttctgaccctgaggtcacgtaggtcagatttgacttcagttctaggaagagggaagcggccctgatgagggtgtccctctttcgactctgcatgtttctctaggacgctagaaggtagagccctggttttctgttaggcacctctgtgtctctttctaggagggaagtggccctgacaggggccctcccttgactcagtccacatcccaggatgctggaggactgagtcctggtttccggcagaccggtcactctctctctctctgtttctatctctcatctttctcttgttcaagtttcttgaagaatctccaagaaagaaaaaaaaaaactgttatatactctgtgtgaataatgaatgagtgagggaggacaagggctcgcgcttgtcctccagtttgtagctccacggcgaaagctacggagttcaagtaggccctcacctc

SEQ ID NO: 171717 - DNA, 444 bp, Homo sapiens
agcgttgcagaggtgctggggcatgtggttcagagggctctatgcaacttcagacatgattatgctccattcacagatttattacggcaggagaaagttttcagataaccctgagttcacgtcagaatactgaatcaagcagttaagttgtggtggaataataatagtaatggtctcagctctttttctgcctcgctgtgtccacaccatttggtagtgccctctatactgacactgggcttggccaggtgacttgctctgcccaacaggacaagcaaacataatataggcaaagacttgaaaagagcttatgcactggagcttgctctcttgctgttcttgggaccctgccaccctgggagcaagctggggttagcttactaaacaaggaaaggttctaggcctagtcacgccattgcttcagcctatagccaagcaaccact

SEQ ID NO: 171718 - DNA, 312 bp, Homo sapiens
gggttgatagttctttttattcagtatttgaaaaatgtgctacttccttctgaccaccaagattttggatgagaaatcctctgctgtttaaatcattttcccccagagggtgagccagcttcgggattgcaactgagaagtgggactattaaaagaaagtcatgcccaggtggctcaccaagctggagaagggacaagagacctctggagcttcgcctttatagctgattgctttttgaatcccagccatcccagcctccacagtctgaagcagaaacatctcatccaaactgcatttgtgtgagcaagaaa

SEQ ID NO: 171719 - DNA, 303 bp, Homo sapiens
gcgctcactcattccctgccacacgctgctcattcattaaaagcccctgattcctccccgctgttctaattatgcacagcagtaataaagatgcattctcccttaccaaagaggcctatttatatgaaaagagagcatttcgcccccacaagattgagtcgtcactccaggccttattggaatcaaagcagcttctcttctgagattgtccaagccctgcctgactcccctccagcttggcccactcctgagcatccacatttccaggagcgccactgcagagtgggcaagatgtagacgcca

SEQ ID NO: 171720 - DNA, 403 bp, Homo sapiens
tctgtggaattgccacactgtcttctaaggtgttgaactggtttacagtcccaccgacagtgtaaaagtgttcctatttctccacatcctctgcctcccaggttgaagcgattctcctgcctcagcctcttgagtagctgggactataggcgcctgccaccacacctactaattttatatttttagtaaagacggggttgcaccatgttggccaggctggtctcgaattcctgacctcaagtgatctgcccacctcggactcccaaagtgctgggattgcagccatgagccaccgcatctggccatatatattatgataggcttgtttcacttagtatgtttcttccatgctgtagcatgtattagtacttctttctttttcatggccaaatattccattata

SEQ ID NO: 171721 - DNA, 381 bp, Homo sapiens
tgccagaaatattgttaggtgcctgccatacttacaaagaaactatgagaagctttttaaattaaaaatacgtatggaaataagatatgaacactgcaataattttcaaaactcaggctaaggataattattgcaaatgaaaatatgtaacttgaactccatggcagtcaaggtaataaaatgaaaataatgagttgcatagctctaatttttaataaaaggaagcatatcatttatattatcagttataaagctcgtagttttagaaaaacaaaatgcatttaaatcagaacttttaaaagtaaaactggcctttgcatttttataattaattatatctttttttatttctgaaactatataacaaatgggacactttgg

SEQ ID NO: 171722 - DNA, 542 bp, Homo sapiens
aataataaatacaaagaaatatattaatctattaaatatgttcagccagatttcaggatacaagttaaatatacaaatacaaactgtatttctatacgctagcaataaaaaatctgaaaatgagatgaagaaaacaatcacattgataataatatcaaaaataaattatttaggaataaatttagcaaaataggtacaagactagggacctaactcaacagaatgacatctcatatacaagattggaagatttatttttttttacgtggcaatactcacaaattgatctggagattcaatgcaatcaatatttaaatcccaggtacccttttgtagaaattgataaactgatcttttttaaaaaaatatggaaatacaagggacccagaatatccaaaaattcttaaaataaaaaccaaagacagtgtgatcacactacatgattttaaaaactactacaaagcttcagtaaacaagaaaatgtgggaatggcataaagatatacacatagactaatgtaatagaattgaaaaatacaaaaa

SEQ ID NO: 171723 - DNA, 211 bp, Homo sapiens
gcttgtatttttttcttcctcatctatagttgatcaagaatcatcaaaagatagaagtgcctagaatttttacagatttcagatatcaatgcaatcaagtgacatagccaaaatatctgtaaagcggatggaaactgttcttgctaaatttaggaatttctgttacttgattaagaattttcaaacataagattatatttgcagaaaagta

SEQ ID NO: 171724 - DNA, 535 bp, Homo sapiens
tcagttatccacaggacaatcacatgtgacccagcatcagcagctattgatcaagatatattgaacgaatgaatgaatctttgtaggcatttttaaatcccgggcctgttgctccttgcacagtgccatgttcagccttccatcactgcctcaccagggtgcacacaaggaatgtaaatttcaatataattaggatataattagagaagcaaatctgatgcaggtttacatactaatcccaaagattagaattacctatactactactctccaaggttaactctgtggaagaggcaccgcagcatgcaacatcacataaagaaaactgacacttcctgagcaaatagttttcgtccatatcacttattcccatccattcctttaatacatgactattcctgatccagttaatttgaagaattcagtctcctctccataaaggctgatttcacaactacagtttctcaaattcctctctccccaaaaaggggtgcacttacggacttcgcttaagaaaacaccaacaataaacggc

SEQ ID NO: 171725 - DNA, 392 bp, Homo sapiens
gcctggactagtcttcaacacaccttctgctctcaaggccatttccacggccatgtttgagaacatcagatcaacccaattttctgtcatactcagtcagttgactttactggcggacaaaatagatagttgccttcctgttgtgatttctaggatcttaggggaaagcccttcttcttcactacccttctatcccttcccttaaggttttaaatccttgaatgaggattttaaaaatcattctagaatgaaagacaggtttaaagtgcaaatatattaaaaagccaaggacgcattctttaatgagtaagtaaaatactaagcaattcgttttgggagaaagaagggctaaaagagaaaagtgtcaggtaacggatttttgattttttttt

SEQ ID NO: 171726 - DNA, 638 bp, Homo sapiens
aaagggttgcttaagctttagctgtaccaaaagccccgaatttatttagtttagttttagaaataacaagattttgttaggtattttcctgtggagtatattatattcacctagggagatatcttctgtctatagctatgaaaagaaattaaatttctatttccttgtaattgaaagttgtgaccaaaatcaagaccatgtgtagacatttcctctagctcataagcaagagtagtgttttattcagctgtttacttaaaattccaaatggtgacttttaggcctagatgtctatttgttaagaggcaggaggggctctgtgtggtggtggttcttgctggtaatcctagcactttgggaggcccaggtgggaggattgcttgagccccggagttcaagatcagcctgggcaacatagggagaccccatctctacaaaaaatcagaaacttagctgagcatggtggcacacacctgtagtcccagccaccgtggaggctgaggtgggagtattgtttgggcctgggaggtagatgctgtagtgagctgtgatcctgccactgcactctagcctgggtgacagagtgagacgctgtctccaaaaaaaaaagaggcaagagattaaattagacacagttt

SEQ ID NO: 171727 - DNA, 454 bp, Homo sapiens
aaagggttgcttaagctttagctgtaccaaaagccccgaatttatttagtttagttttagaaataacaagattttgttaggtattttcctgtggagtatattatattcacctagggagatatcttctgtctatagctatgaaaagaaattaaatttctatttccttgtaattgaaagttgtgaccaaaatcaagaccatgtgtagacatttcctctagctcataagcaagagtagtgttttattcagctgtttacttaaaattccaaatggtgacttttaggcctagatgtctatttgttaagaggcaggaggggctctgtgtggtggtggtttttttatagaatacaacaattatgtgtggtccagttaagttgaatccttgagaccctaccttaatatcctcctgacatattacgtgaacttaatcttaataattattctattcttacttct

SEQ ID NO: 171728 - DNA, 521 bp, Homo sapiens
tcacataagacctagtatatagtaggcagtcaatgaagatcacaatgaattggctagactttgatttattcatttatgcaaattgcctgacattcaaagaaaaaagaaggaaaaaatggacctcttatcatgtgccagacattgttctaagagggaaagatactgtgaaaaagaaaagtccctatcctggtggatcttagattatcgtggagaaggtaaggcaacaaacacaaaataaatacttcatataagttcaggtaatgataatgcgtgaaaaagaagtgttcttcctgttagcagtgccaacatccgctttagtgctctgctgcactgcaaaatgtgtggatgttcttgagtatgtctgggaactagctaaaattagggagttaaaatgatccagcttagctcaggctatagggaggatttctctcccaggtgtttgttttgttttgtttttgagaaagggtctcactctgtcacccaggctagagtgcagtggcctcaacctcccaggcccaggt

SEQ ID NO: 171729 - DNA, 463 bp, Homo sapiens
aagtgtatgcaagaggttcgtcctccacaagccgagattagatcaatcagcatctgtggacagaattaggaaagttaggattgggtagagagagaagtacaactatgatgatcaatggcatggtcaacccagtgaaggactctagggcatacgtggccctgcattgggccaaagtggcttgaccacttattcatgcatccatgggcccaagatgtgggagaccgcaggaaaagtaagccctctagtgaccctctgcagctgaggtagaccctgaaggatgtgccagcaggaaacgctcccttgaacggggatctgggagattcctctcccaaaccaactcaccatgaaattagagagaggctctaaagataatttaggccccatttttgggatgattaatttgataaacatgattatatttatcatgctatttctgtcaattcttttacaccatccacatctg

SEQ ID NO: 171730 - DNA, 542 bp, Homo sapiens
tggagacaaaaatggagggacgtactcagagaatccagcaaaaaggcaaagcaatggaaaatgtgacagagggtatgaaaatcagagaaaacagataggagggccaaggcctgaataacagcagttccagagagagagaagaaacagaggagaggagataatcaaagaactcaagacattttcttaaagcagaagtcccagggtcaccagactgaaagagccactgagtgagaaaactgacccacaccaagacccatcactgtgagacgtcatgttctagggttgtagagaagatcctaagacaggaccctaaagaaggcaacaggactgagaatggacttggagcttttaagagcaacccaggaagttagatggcaatggagcaatgtcttgacaatactgaaggaaaatgatttccaccccagaattctatgatagatttcaatctactgcaaaatagaataaagacatttccagcattttcagatatgtgaaggatcaaagtatttccctctcatgcatcttctctgaagaagaccaca

SEQ ID NO: 171731 - DNA, 423 bp, Homo sapiens
actgagtgcgttctcagactcgccagagggctctggtgtttttgtatttctagcaatgatgaaggggcagagaagggcttaaaaaggaaggctcccttggccttccagcttgataagccctcaggcacaaaggcctcctaaaacactttctgtctttagataaaaccagaccacaccttgcatttaccactgggtgtcagacagttattggtgatcctaaactcatgctgtctgatacagtaactactagacatatatggttattgagcccttgagatgtggccaatctgaactgagatatgctgcaagttaaaccacacgctggattttgaaaacaatacaaaaacctgtgtgaaacatctcatgaattattttctaattgattgcattactttatattgatttttttttttttctttgaga

SEQ ID NO: 171732 - DNA, 584 bp, Homo sapiens
ctgttcaaccgcacctctcatctcccatctcgattcactacacaatggcaggaactcaacaaagaacagcagacccgaggccgtgcaaaaagctgctgaattgtacactttggatgggtgggttgtgtggcatgtaaattacatgtcccccaaaaaaattacatttgtaaacatgtaaaccagaagcagggaaaaggtggtactatagtaaacttctccatggctgcctcccttcctctctccactccaaaccatggtctatgtttgccaatggtcacaaatactgtggtttccattttcagcatgccgatgtgtgctaggccccaaatttccagtccacagttaacagacagctttgtttgtttgtacagaaatttcaaacagttttattctaagatttaaaaccaaagcaatagcactgatgctaaaagtacaaatttattacaaagtagccttgagtacaaatttatttcaaagcagacaaggccaggcatggtggctaacacctattatcccagcactttgggaggccaaggcaggtagatcacctgaagtcaggagttcgagaccagactggccaacat

SEQ ID NO: 171733 - DNA, 442 bp, Homo sapiens
caggggctcctcggtcaccaggctggaggcccacggcccctttgccggcagcgcccatcatgtccacaccagcagccacgtggtcagtctgcccagctctgtccagagcatggttagtaacagcaggccaggggcggccctcacagccattcctgtgtctagacacgggcaggggcagagctgcctcggacccccatccagggccaggacactgcacagcttctgcatgaggacgctcaggctggctgccacagcctgggccagctctccgagcaaaaggaacgggtggggaaaggccccctaacccgccctggcagccccaaggcactggcaaaagccagcagccattctcaaacagggcggacccagcccgtgcacacgcggcccgcaaactcagaatgggttttactgtgtggaacggcagagaaagaaaaaagagcga

SEQ ID NO: 171734 - DNA, 820 bp, Homo sapiens
cacgatcatgatgagaattgatgatcggacacgctgatttcattgtctgaagcggcactggagacccaggaaaaatctcgctgaatccgcctgccccagcagcggcctgatctgggttccgctgattcctttcgtaaccgcaccacacccgagctacaggaccgcactcagttcagtgaccgagacttagccacccttaagaagtattgggacaatggcatgaccagcctgggctctgtttgtagagagaaaattgaagctgtggcaactgaattaaatgttgactgtgaaatagttcggacttggattgggaatcgaagaaggaaatatcgtttaatggggattgaagttccacctccaagaggaggccctgctgatttctctgagcagcctgagtctggttctttatctgcactcacaccaggagaggaagctgggcctgaagtaggagaggataatgacagaaatgatgaagtatccatctgtttgtctgaaggaagctctcaagaagagcccaatgaagttgttccgaatgatgcaagggctcataaggaagaggaccaccatgcagtaaccacagataatgtgacaatagaacttatcgatgatgacgaaagtgacctgataagtattctggagtagaaccagtaaatcctttcgtggattatagatgacgagtcaattacttggaatgggtcgagaattcaaagcaaaatatttaagttgaatttgaaaggtgtttacaggagtggaaaggcaagggcgggtgataccggaaggaggtaccgggggggggaaacctcaggtttgggaaattggt

SEQ ID NO: 171735 - DNA, 360 bp, Homo sapiens
  misc_feature (59)..(59): n is a, c, g, or t
tacctgtgaaacttttctgcaatataatcttatgtttgaaaattcttaatcaagttctnctcccctgacatctctgtatttctgtgagcatctctagagggtacacttgcactggtggaacctgcagggctaaaggacaggcccactatatgttttactgtgtattgccaaacttccctcccatctactacctcccactcttgcaagcattggatatactattaatttttagaaatataagaagtgaaaaggtcttcactttaacctgaatggctttaccataggatcaagactaccttttcatgttcattagtcatatgtaaatactcattcaatgcttgtcaggggagaagaggtcgg

SEQ ID NO: 171736 - DNA, 420 bp, Homo sapiens
tccccccaaaatcccacaaaagaataaaagtagagttaaaactaccttcactccatcctctaatcccactcttaataattacaggatttatctttccggatcatttctatgcacaaacacataaaaatctctaaattttaaagagaagtataattatcctatacacacacacactggcaattttaaaaattcaataatgtatactggacctatttccagaaagatagcctaacattccactctatgtatcatagtagatattttggatgtttccatttctcacataacacacaatactacaaaaggcatctctccccatcatctctgtatttctgtgagcatctctagagggtacacttgcactggtggaacctgcagggctaaaggacaggcccactatatgttttactgtgtattgcc

SEQ ID NO: 171737 - DNA, 365 bp, Homo sapiens
tgctacttttttcttctcctttgtaacaaaattcctcacagtcatttgtactcaaaagagttgtctacacttgctatctccgtttcttctgtaccatcctcacttaattccattctaatcagatttttgctcccattactccacagaaactgttcttatctaggtcattagtgacttttctattgctaaatccagtggttgattcttagtcctcatcgtactgaatctaccagcagtatttaatatagtatatagttgatacagttagtcactctcttctccttgatgcattttccttcacttgacttacaatacttcttcaagtatgttcttggtttcttaccttaataactattcctgctcag

SEQ ID NO: 171738 - DNA, 700 bp, Homo sapiens
accatcaccctaacacccagcgcagagacagatgtgtccctggtctaccgtggcttcatctacccaatgctgcctggagggccaggtggaccaggggctgaggacgtggccgtgtggacgcgggcccagcgcctacacgtcctggcccggatggcccgtggccctgacacggagaacatggaggaggtggggcgctgggtggctcatcaggagaaggagacgcggcggctgcagcgccctgggtctgctcgcctcttccctctgcctgggcgggaccacaagtatgcagtagagatccagggccagctcaatggctcggcaggccctgggcacagcgagctaactctgctgtgggatcggactggtgtgccaggaggcagcgagatctccttcttcttcctggagccctaccgctcgtcgtcctgcacctcctattcttcctgcctgggctgcttggcagaccagggctgtggctggtgcctgaccagtgccacctgccacctgcgccagggcggagcccattgcggggatgacggggctggtgggtccctgctggtgctggtgcctaccctctgcccactctgcgaggagcatcgggactgccacgcctgcacccaggacccttctgtgagtgaccggatccgatgtacctttttagattagaggcggggcggggtcatgctataatctgccttggagc

SEQ ID NO: 171739 - DNA, 215 bp, Homo sapiens
accaggatgcaaatagggcacggataataggaggcaagaacaacaaaatgtggtcaccaattcattaagaaaaaaaatgtttcctctggctatctccatgcacagctgcccagatactagggccacaatgtaaaccaggaaagttagggctatataggttggacacagtattctagtaagaaacatcctaattatattaaatttgaagcataggc

SEQ ID NO: 171740 - DNA, 219 bp, Homo sapiens
taagctgcatcgcccaacaccaagaacaagcgatgtttgcttttaactgagggcaaagtaacttgcccactcgtgcagagagagccaggggtgggaccctaggccggtctggctctaaagctggtaacttccttgttgtggccgttagtcataaatgtgtgcaggtgagaacagctaaccgcaatcttggtcatactgtgttggggatgatttactaag

SEQ ID NO: 171741 - DNA, 258 bp, Homo sapiens
cccatctaacgccaatagcaccaacctccaaggctaacacacacacccttagaagaatacaggcacagggcccacactctagaaagggaagagacaacctaaaaggacataagtgcgcaacacaggcgcgttaaaaagcttcccatctgggttctagcgcacgcattgaaggcgcgcccgtctctactaccctcgtgtctcctaccgcgcacgcgcaccgcgtcgacccggccgcgaatttagtagtagtagtcgacc

SEQ ID NO: 171742 - DNA, 299 bp, Homo sapiens
tgagctctgacttgctcttggaaacacttcgaggcttagcctccccactttgtttcccgagagtgtgacctgttcccctccaaacacccccttctcctccagggccatgcccacccgtcaaaatcccccacgggcaggacgaactgtgggtgtcagtcaccatctatcctgcatcctggttccagggccccccccagccccgcctccatagggacaggcgtgcagacacccgtccctggctgcttcctcttgtggaatgggttcaaaagtaagcagtgttgtttacactgacaaactga

SEQ ID NO: 171743 - DNA, 101 bp, Homo sapiens
ctggctgcagttggacccacaggttgtgaggactcaagagcaggatctctcctcctgctatcattttataaaatgctgaagggaaaaatgagctccgcaga

SEQ ID NO: 171744 - DNA, 342 bp, Homo sapiens
aataaagtgtgatccagatgttaacaaacttgattcttcttactgactgaatcattattgttcagaaaccctttgatacaatgggaaaaaaaaatgctgttgatataagaagggagtcaaatattacaggactggactgttgattaaaaaattatttttaaagcacagtagctatgaattactgtgctgttgtatttgtctctatatgtgttgctgatttctgatcttggatcatgtttaaaaccagtggcagtctgtaaataccaacaattattatcttttgatacccttttaagttatgaaactcatattgttgaagaaatacctggattcattaagaaa

SEQ ID NO: 171745 - DNA, 242 bp, Homo sapiens
tcaaaaatatttataaagaccatagaaatagataaaaatatgacaaagtgaaactatcagactacaaaatggagcatcagctacaactgttattaaaaattccatacaatatgggaggtaatatctgataataaaataaacctgtcttatgcaggtgcatcatgaatattattatgtacaacttaattattaaaaataaataaataggctgggtgcagtgactcacacctgtgttcccagca

SEQ ID NO: 171746 - DNA, 350 bp, Homo sapiens
aaggctaggttaacacataagggctgagttttggttcttccttaatcagattttactttttgtgaaaggaaaataaaatcttgggaccccaatttaactctgccaataggaaaaaaaataaactgaaagccgagtcatgggagaaactgcctctccttttgtccctaagcagatgctacagataaaaggccagatatctccacagatagttattctatcttcactttatcttatgtaaagtgccgatttactgagtgtgagatgaatacaaaattgaccattctcttttttgtcattctgcttttttcttttttttatcttgcaacatgtggattcagtaatgtgaccat

SEQ ID NO: 171747 - DNA, 554 bp, Homo sapiens
gggaatgagcagacaatgcaggcagggggagaagctgagtccaggtgaagaagagggaaaaaggtcaaagccagagagaatggggcttgaggctgggaggaggggcaaggagaagctacagtggggaggtgaaacctccaggtgagatgccaggaggacctgcagggtgtgctgaagtgtgggagaaggtgaattaggacaagaattctgggctaggtctgagaccaccataggatgtcactgagtggatcttcaagactgtcctaaagaaaacagacagaaagtggtaggtcactcagggatgggaggtgaggcgtgaaggggcgagaaccagcaagtagtgttaagtgagtggccagcaagtgtattaggccattcttgcattgctataaatacctgagcctggttaatttattagaaaacacgtttaattggctcatggttctacaggctgtacaggaagcatagcactggcatctgcttcaggggaggcctcaggaagcttacaatcgtggtagaaggtgaagcaggagcaggcatgtcacatggccaga

SEQ ID NO: 171748 - DNA, 204 bp, Homo sapiens
ctgcctcctctcaggcaaagctaagggcatgatggcactcagaggaagaggtggggatggggattgaggtgaggagctcccacggcccccactccccgcctgtttggttccactggatcacgggtccagaatattaggtcttgatggtacctacggtggggtctctcatgggagcaagacaggcacctcctcaggcaccaggat

SEQ ID NO: 171749 - DNA, 479 bp, Homo sapiens
tagaggatcctgacagatccctaaccagaagagtaaagagtatttcaggtacaggaaaagcaggcgcaaagacctaaatgcaagaaactacatcaaaggttgggcacgctggcttacacctgcaatcccagcattttgggaggttgaagcgggcaaaatcaccaggtcaggagtttgagaccagcctggtcaacatggtgaaaccctgcctctactaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttactgtctttacagcatctagcc

SEQ ID NO: 171750 - DNA, 529 bp, Homo sapiens
ttgccattctgaacatgacacacacatacacacacacacactccaccttaccacctcagtagacactcctgttagcaaaggattgagattgcactttttgtgaattatgcactgaatctataaatgatatttagagaactgacatctttacaacaattaacctttgaatctaggaatctagtatatatcactatttttatacttaacgtctgggccttgacatatttaatgctttttaaatgtttttgttgtgtctttattttaagataacacacatatttactgtgttttgctgaagtttattatggcatatcaaatttatgtccagtaaatttgctaaactctcttaattttaataatgtatctaagatgatttggctttttttatgggcacaattgtagtatatgtgaaataatgtttaattcattaattttaaacatttccttttaaaaaattatggatttatagccttaaattaaatgtatattaattatgttctagatatttgaatgcgtccgtacattgctt

SEQ ID NO: 171751 - DNA, 226 bp, Homo sapiens
ctagattttgaagacagatattcccctttgagagaatcgttgtagtgatagtagttttggaatgagtgtgtaactgtcttacatattgactttagatttatacatcttagttgtagggactgccatttatttcccttccatatgtattccagaggtcaataggtacttaataaataagaagtaaaaatgactattttcctaagcttttccagcattatttgatgat

SEQ ID NO: 171752 - DNA, 390 bp, Homo sapiens
aaaaagcttgtctctttattattgacattctgtcagcttccaaaattttttgaactgactagaatggtgtatgtaattggctattttacgttgacacttttcattctaacttgtaagaatttcggtataggctgggtgtggtggctcacacctgtaatcccagcactttgggaggccaaggtgggcggattacttgaggtcaggagtttgagaccagcctgggcaatatggtgaaatcctgtctctacaaaaatacaaaaaaaattagccaggtgtggtggcacatgcctgtaattccagctgctggggtggctcaggctggaggatcacttgagactgggaggcagaggctgcagtgagctgagattgcaccactgcactccagcctgg

SEQ ID NO: 171753 - DNA, 239 bp, Homo sapiens
tgggaggctgtggcaggtggatcgcctgagcccaggagttttgagaccagcctgagcaacatggtgaaactctgtctctgcaaaaaaataaaaaaaagtagccaagtgtggtggcattcacttgtagtcccagctacttgataggctacttgagccggagaggtagaggctacagtaagctgtgatcacaccactgcattccagcctgggtgatagcaagatcctgtctcaaaaaaaaa

SEQ ID NO: 171754 - DNA, 582 bp, Homo sapiens
ctaatatccccattttgcagatggggaaattgaggtcacagacattcagtaactcacctaaggccacacccccaagttccttaggcaacagatgggagctgagcatgggggccagagggacagtaggggcagtagcaagaattcactttagcgctggttgaatgtgaggttcctgcagggaatccacatggagggcccaggaggaggtcagatcagtgggtctggggcaaaagccagtttcctggagtctcatcagatgaaggagtgaaaaggcagggggagcagcccaggataaatgccctattctctttatacgtggactcagaatcacttctcacacacgtgcctctaaccacccattgcctgtgcctctggctttgtaacctcagacaaatccctcccttttctcagcctgctttcacatctaagatgcagagatgaccatccctgccttccacggcgcccagtaagggggagggatcattagcattgttacaatatttcctgtacttgtcagtctggcaaacacactccctccaaaacttcaaccttccacctgccagtagcttccccttcctccca

SEQ ID NO: 171755 - DNA, 118 bp, Homo sapiens
gggattacagacgtcagccagcatacccggttgtatgctgatgttctaattcaatgtgataccaaagacctgagatagtctctcccactctggccccataacatatgtccacgaggtg

SEQ ID NO: 171756 - DNA, 344 bp, Homo sapiens
ttaattcaactgtagatctttactaaaggattgtgctaccctatgatctgtgtggcacagtcacatgcgcaatgcttccccttccagggcttccccccaacttcagtggtgagaaacactgcacatgggctgcttggctcatctgcattgactgtatatcctgaggccagtgcacaatgtccaggtcaacaacatgtttttcaaaacgtggtttaacttgtttgttgtagctacaaaaatcagccagctttgcagaagacaattcattaaatgaatgaagactggtcatcatgcccaaatacagacaaaacactgtgactcaagcatgctctcattatagagac

SEQ ID NO: 171757 - DNA, 743 bp, Homo sapiens
cttcaaacaccatgaggacaaactcccaggtgtttaggatctgctagtggacccctttaattctcaggaagacagagatgcagggagattctcagaaaaccctcttgagataaacactctactgtgactaatttaaaccacactaaactgccccagtttcaaggcttcccactttggggcaataaacgtagctatttactgcagtcaccctctgatgttacaatagatggccttatggaagtggataatcccagtactgctcatttatttctccatcacatttttagtaacaaaagaaatatacgcttgatacagaaaaactgtaaatcttaaaaaaaattacagaaaagtatcatccctaaaccagctcccagattagatccctggatctctcttcaccagcatgagccacttaaattccaggtgctgtcacgctgcaatactaatcatctgcctcgcccgtgttctactgtgttttgacttcccatttcaaaagaattcagcagtaagggtcataaaacactgtgtattaattccaaacagatttgctatttgttttttaaaactatgaagataattttaaagaaaactcaggatggcagaaaggctgagctgagcacacacacaccgaggaggaaggccacgtcccagccagctgcagctgtccctggcttgcccggcagtgccattgtttacacccaaagcctttcccctgtaggaatgatgtcacctggagcaagctg

SEQ ID NO: 171758 - DNA, 566 bp, Homo sapiens
  misc_feature (58)..(58): n is a, c, g, or t
  misc_feature (238)..(238): n is a, c, g, or t
  misc_feature (338)..(338): n is a, c, g, or t
  misc_feature (351)..(351): n is a, c, g, or t
  misc_feature (398)..(398): n is a, c, g, or t
  misc_feature (408)..(408): n is a, c, g, or t
  misc_feature (491)..(491): n is a, c, g, or t
gagatagaatccatctaccgtaaaattcacttaagtgtacgattcagtgcttttttgngggggaaatttgtaagattgggcaaacagtaccacaacccggctttagattttcatcattatgcatgtttttatttttatcttgctattttttagacagggtctcactctgttgcaatggggtgatctcagctcacggcggcctcgacctcctgggcccgagccgctgtcccacctcagnactcccgggtagctgagaccacaagcgcgcaccaccacgctcagctaatttttgtatttttgtagacacagagtttagccatgttgccccgggtggtctnctaactcgtgggnctcaagtaatcctcctgcctcagccttccaaagtgctgggattatanggtgtgagcncactgtgcctggccgctatgcatatttttaaaagttgattttaagagctgtatagttgctagagatattccctcattttgtcncatttacatctaatttttgtttatgaggtttttttggggggattgttaaaacaatgacaatttcatttgttcaca

SEQ ID NO: 171759 - DNA, 276 bp, Homo sapiens
ttattatacaggatttgacttttaaaaaccactatttcactacaaagattgatgtatgggaaaggagaacctggcaatgtggtactattgaaaggcagaagctcaaagatatcagataccaatctggtgtctatccaaagacaacactagaataaaaaagtatagatcattcttcaaaaatattcatcccctcccattgatactctttgggagcagcatacttctctaccccttgtcttgggcttggctatgtgatgtgctttggccactgggatg

SEQ ID NO: 171760 - DNA, 336 bp, Homo sapiens
gcaggggaggcactagcagctctgccacagcagccactttggagtccctaacaccaggatgtcctgattttcatgcacttagccctgtccaaggggagtctcaatttgtgtactcttttttttttttttgagacagagtcttgctcttgtcacccaggctggaatgcagtggcatgatcttggctcactgcaacctctgcctcccgggttcaagtgattctcctgcctcagcctcccgagtagctgggattacaggcccctgccaccacacccggctaattttttgtaattttagtagagacggggtttcaccatgttggccgggctggtctcaaa

SEQ ID NO: 171761 - DNA, 160 bp, Homo sapiens
ggatttctgtaattactctgggttagtagtgtgacaatcttgaggtcagagggagcagtcttctctgtaaattcacagtttgaacaaagccttctgaaagagatcattgttttgctttgcatgtacaaacaataaatgtacactgtagttatcacatgga

SEQ ID NO: 171762 - DNA, 548 bp, Homo sapiens
ctattgaaacttctaaactgtgctattgaaacttctaaaactagggaaacttctaaaactagggcttgccagcaataacatccactggactgatggacgttgtctaagggctgtttaaccagacccagcctgcctttgttcccaggacagcctcagccccagtgctgagctgcagcgccccctggaggaagagagacagctgcacctcccagcccacagttggaggggctcttctggtgaaagtcagtctccttggagaaaaaggataaaacttgctattgaaacttctaaaactaggcctagttttagaagtttcaatagcagaagattgctattgaaacttctaaaactagctgatgcagtggcagaacagtgaggcattgtgtcctggatcgtctgggagcccagtgtcaagtccgctggaatgcaggaagtagaacagaatcgccacgctattgaaacttctaaaactaggcctagttttagaagtttcaatagctcattcattcattcattcaacaaacattcagaggtacttaccatgtgcc

SEQ ID NO: 171763 - DNA, 270 bp, Homo sapiens
gtttttacctgtgcttctgaccaactggctaaaaatcagggttctgcaaccccttccttcagttttaataatttgctggagaagctcacagaattaatggaaacctggttactaggctcttacaaatgttattttaaaggatataaataaaccgtcaaatgaagagttacagaggcaagatgtacaatggtgaaggagcttcaattcccttggagaaaggtgtgccaccctctcactacatgaacatgttctaggttacctttctggaag

SEQ ID NO: 171764 - DNA, 506 bp, Homo sapiens
ccgagggcctgcggggcggggagtagcctctggctgtgagctgggaagccctcactctggagggacctggttcctgctggtaggtgtctcccaagggcctcccataggggtgttgccccaagacaggctgaggggtaggggctgcaggcaccgtggaggggtcttcctgccacaggcagcccagcttaaagtgagggtggctgcatcattctggcctggtataggcatggagtgttggagtccgggagtgctgcaggctggcagggatgggggtccacacacaggagtgcatgggctgtgagcttagtagactccttcataaccaaggtgggtggtgtccccacacctctgccaggagcctacagggattgactcagttctgttgagaggcagcttagtgagcaggtgggagtcagtgagatagctggagacttgatgtgtggccagggacatggtgagaggaggggcctccgtggggtgggaaagggtggggttcagtggtgggg

SEQ ID NO: 171765 - DNA, 622 bp, Homo sapiens
acatctagtataacagttgcttcttccaattttttggattgccttttgtagggaaaggttttttttcctgaagatatatctgtggttttgtttgggtagggtactttcgctttgattctggatgtgtgcagaagtggagtcttcatataatttcttcaattgtaaatagcatcagtggtgtttgtgattttcccagtggcttaagctgcaatagttagtggtaacaacttgaaaactgttatggaggcctagagcttgtgaaattccattaaaaaattgtaaaggcacatattcataatggtgctgagaactttctgtcttttaagtgaagaatattaaatttttttacaattatttttgaccaaaaacaacataattctatccagtccctatgagttcactgcctttgtagaaaatggcattgctttatgaatctgggtgctcctgtattgggtgcatatatatttaggatagttagttcttcttgttgaattgatccctttaccattatgtaatggtcttgtctcttttgatctttgacggttacaagtctgtattatccgagactaggattacaacccctgcctttttttgtttcccatttgcttggtacggattagcg

SEQ ID NO: 171766 - DNA, 655 bp, Homo sapiens
tagctgggcgtggtggtgcatgcctgtaatcccagatactccagaggctgaggcaggagaatcacttgaacccaggaggtggaggttgcagtgagctgagatagtgccattgccctccagcctgggcaacaagcgcaaaactctgtctcaaaaaaaaaaaaaaattaattaactgggcatagtggcacgcatgcttgtggtcccaagctactcaggaggctgaggcaggaggattgcttgagcttaggaggttgaggctgcagtgagccaagttcatgccactgtactccagcctgggcaacagagtgaggccttctcttaaaaaaaaaaaaagactgtagagccagactgcctgggttcaaatctcagctctactactaacttggacaagacactcaacctctctatgtcttagtttcctcatctataaataaggttaagaacagtatcaacctcacagagtgttgtgaagattgagttaaaatatgcaaagcagggtagtatatgtatatgtaataagaggcaagtacaaataagagctattattatcattaacattattgttacatgaaaagcatgatatttaattacctgtagtacaacacaacatacttagtgaaaaataacataatggaaaatgaatgtttagtattga

SEQ ID NO: 171767 - DNA, 414 bp, Homo sapiens
aggaggggaagtgtcacgttaagcctgtgccatgaggtgttccttgggatctttgaaaactcttcttctgagtgttaatgatagagcaaggccctagcgggaaacccttctccccagtaagtcatgccatgtcaggagtgaccaaattagtagtgatgcagggcaggtgacccccaaagtggagcttaccccatgagagttcttagctttccccagaaaataattcaagggcaagctagaggtagaagaaaacagctttatgaaagaggcagtgttatagccctggtgatgttgcagctccttgactgctcctgcagagtagggccaacccctcagcagagagaagcagctcagggcagttttgcagttctatttataccacttttaattacatgcaaatcaggaggcagttca

SEQ ID NO: 171768 - DNA, 359 bp, Homo sapiens
tgtcttcaaattttgtctaccacattgagtcaaatagaaggtatgaaataagaagccagaaataaaaacatattaaatgccccattaaaaagacaatgattatcacagcactttgggaggccgaggcaggcagatcacgaggtcaggagatcgagaccatcctggctaacatggtggaaccccgtctctactaaaaatacaaaaaattagccaggcgtggtggcgggtgcctgtagtcccagctactcggaggctgaggcaggagaatggcgtgaacccgggaggcagagcttgcagtgagccaagatagcgccactgcagtctggcctgggtaaaaaagcgagactctgtctcaaaaa

SEQ ID NO: 171769 - DNA, 748 bp, Homo sapiens
atagacactcatagaaggtgacaattatatgaatcctcttttcaagaagaccatttaaaggagtgaaagggattatttaaaacatcgttagttgcaagttgttttgagaagcataagttatatcaatattttactagttatattttgagggacataaatataaaaatggagagtattctattatttcctgtaattgttcagtaaacattaaacatgtttttctattagaatttttcacataaaattgaatctgtattactatggaaagaacattggatttataatttccctccaattatcaactgaaaatactccaatattttccccaaatatcagaacaaaggtttgactttacaacttattatttaacagtgcttaattagcttttgtctaattactgtcccatgtgtttgggactttcttcatttgataatattaaatactttttcaaattctcaggtgataggaaagcaagagcagatcaaagagaaatgagagagtatacccaatatatacttcctgtgcccttctttcttttctaatgcaagcaatgggaacatagaaactatttgaattttaaacgactggatataaaattctccaatccaatgagggctgaaaataatttttagcttcaaaatttgcatttaaaatgataacagtgagtaatgatgtattagagttaaagaaacacttgtgacagatatctccattcgctgataaagaataaatgcttccaccagattta

SEQ ID NO: 171770 - DNA, 365 bp, Homo sapiens
gtgttcccacaagccagagtggaaagacctcctaattcaaagggcatcgtggaggctgcagcagggtagtgtgtcagcaatggggccagattagccccaggctgaaggacccacactaacgaggcttctaagcaatcctcaaaaggattccaacacaacccaagaatattcaaagtaataccaaaaattcagcacccacccatgtacctttcacaatgtctataccattcaatcaaaaactatcacacatagaagcaggaaaatatgattcatacccagggtcaaaatccatcaatagaaacagacccagagaagacagatacaatgggatttgtatacaagaacagtgaggcagtgctaactag

SEQ ID NO: 171771 - DNA, 873 bp, Homo sapiens
catatataataaaatatatttcacctaatatttaatttatgtgtttattatttttacaaaagaagtctgtgacaccataaaactggtacccacagatgctctccttattctcacttccacccatcctcaattgtgtacccacttgtgagccgtcactcctgtaaatcaggcaatgttgactggattcctgtgcccccctttcatttcccaccctcaggctccagtcctgtctttatccagatgcattcacagctggagactagccaggagagaaagcaaaccattggcctcaatgaggcagggctggagaccaaagtgcagggaagccctactctgccctgctagccccgcaggtcaacttgaaccacctgagtgcctctggcctcccggctagggaggagacagtcatccacagtccagccccctgccatgagctgcagcctcagtctgatccacccacccacctgggacagggagagagtgacagaggagaagggaaatgcttgcaggtgaaaatctgcctgcttttcctacagcaatgacatatgggcttcgagtagtttctgtttgcatcatctcacaagacttgattgttaattttccggagttttgcaggctggcagttaaacaaagacatcatgcaaaattaaattatgcaaacttaagagttaaacaaaggccaggtgtggtggctcacacctgtaatcccagcactttgggaggccaaggtgggctggtcacttgagcccaggagtttgagaccagactgggcaacatggcaaaaccctgtctctacaaaaaagtacaaaaattttccaggaatggtggcatacacctgtagtcctagctactgaagaggctgaggctgaaaga

SEQ ID NO: 171772 - DNA, 847 bp, Homo sapiens
catatataataaaatatatttcacctaatatttaatttatgtgtttattatttttacaaaagaagtctgtgacaccataaaactggtacccacagatgctctccttattctcacttccacccatcctcaattgtgtacccacttgtgagccgtcactcctgtaaatcaggcaatgttgactggattcctgtgcccccctttcatttcccaccctcaggctccagtcctgtctttatccagatgcattcacagctggagactagccaggagagaaagcaaaccattggcctcaatgaggcagggctggagaccaaagtgcagggaagccctactctgccctgctagccccgcaggtcaacttgaaccacctgagtgcctctggcctcccggctagggaggagacagtcatccacagtccagccccctgccatgagctgcagcctcagtctgatccacccacccacctgggacagggagagagtgacagaggagaagggaaatgcttgcaggtgaaaatctgcctgcttttcctacagcaatgacatatgggcttcgagtagtttctgtttgcatcatctcacaagacttgattgttaattttccggagttttgcaggctggcagttaaacaaagacatcatgcaaaattaaattatgcaaacttaagagttaaacaaagtgctgggattacaggcctgagctacagcgcccagcctctgccttattattttattcccacgagaacagagatcgaatacgcactaaagtcagactctgtaaatagatgggaatgtatctgacatagcatgttgcagtgaatagtaggtatagcgatcatcatgagtata

SEQ ID NO: 171773 - DNA, 526 bp, Homo sapiens
gatctgtaaatgtaagcaaatatttgaatgcacggtagcatggtggaatcagagcaagaatgtgaactgaaatttttgccatctgtttctgattttcccctctagattcactctccatttatatcccccagagtctctgtcttgggaggctatgaattaagtcaatgggctcccttcctttctgtttatcagttggatttggtcagtggggagtccaggcagggatctgcaggaggaaggacattgggagctgggtatttctctcctggactcactctgtatgagtcactacaggctggctgtgttcttcaacagaaggttattgctcttcccaaggtgacagctcctatgggactcactttctaacagggtctcataactgtcccttgctttgttgtttattggcacctagaaatgataaagttgctggccccaagctcatgaagaattccttgaagcctccttatacccttccacagctttgtaattagtctttttgtaaataaacccacttcaaattatccta

SEQ ID NO: 171774 - DNA, 273 bp, Homo sapiens
tcttgctcttccctagataatgttgaaaggcttccaggacttagtccttgaacttgatctcttctctatgtttactcactaaataatgccatctagtctcctggctttaaaattccagcctgggccaggcacagtggctcacacctgtaatcccagcactttgggaggccgaggcaggtggatcacctgagatcaggagttcgagaccagcctgcccaacatggcaaaaccgtgtctctactaaaaatacaaaaattagccgggcgtggtggt

SEQ ID NO: 171775 - DNA, 177 bp, Homo sapiens
agagctttcaaggggagcaaaagaagctagtttatagatgtagccaaagccaacacctctcttcccccaccctggaagagaggcttgctggggagaagctgtcaggtgaacagccacgaaaaaagcagatgccaggaggtgtcctctccacacagttcctggctctttagcaccatg

SEQ ID NO: 171776 - DNA, 821 bp, Homo sapiens
gcccatctcttcacataactgaaagatggctggttctcccagaagagccagaggcctctaaatggagtgaggtcctttctctgcatgtcctgtctctctccagaggtgggcttggaatctctttcgctttgaccggtgactaccatcccctccactcctgtccctcccctgcatcactccatgttacccctggccccagaggtctctgaggtcccatcaccttctgatgactctgtctgcagggatgagtctgttgttactgagccgctagccttcagcttcctctcccatggtcattcccgaggctgcccactccccctagttgcccacaagccttatgaactcccatctccgttcctcctgtgtggcctgttctggttccctctcctccctgtcaggctcactgtatctttgtttcccatgatcctgcagtcagggaagaccaagccccagttactttcctgatgagctcaaagtccagaatgcagtcacgtgactggggtgggaagccatgcacagggccctgagagggtgtgagggattcgaggcagctgtggaaggagagcccttccagctgagatgaattcagccccagagaggcactaaacaacctaaggatggtacagttccccagttattaaaaatttgcatacttactataaagggtttagtaaaacatagtctagaggaagaaaaccagaaaagcatgatgtgtccatcttcccagtgcttaacattttataccgtgttcttttcctctctcccactccgcgtgagtgcttctatgtctttatattggtagatcttacttagaatctgac

SEQ ID NO: 171777 - DNA, 452 bp, Homo sapiens
tcaggtcaaacatgtttactgttaactcatttattcaaagcaaattttctcagtatctattgaccaggcaataggatatgtctttctacaagtgacattgagaaatgcttccttttgtctctcttctgaggaagagaatcttcttgctcctgagaaagaaaacatgagccagtcagattcctttttatgcatatgtgaagaatgtctgatgttctaattttctagtatgtctcaaattatgctacttgaatttccaggctctttcatgccttttatttagttgaggctttggtgttacaaatctgatgttcacatgccagttctcttcaacacagttcttctgctttatcattggatagcatgagcttttccttgccttggtgctcacatgttccatgtacaggatattgactctctcagttctctttctaatggcctctctcaggctgttg

SEQ ID NO: 171778 - DNA, 502 bp, Homo sapiens
gacaaaatacatggctgagaattaaggatcactattacgttcctttttgtttagaaaaaaatgtactttaagtctatcacatctaatttaggaagcagcccttccaattgtggcaggtttggttccaaggcagatttgccagaattattgaggggtgtgggcaggagaggtatgagaatttaaaaacacaaacataatccattagttcaatgcacgcaggagggtatgtttcgtgatagctggagagtaatcctccatattactgaaatctctattccatataaagcttgctcagaattaacctatctcaatgaaagacatacaatcttatcagaacttatcagatcttatgacccagattcttcaagtcaagaaaacaactttcttggcattgtctttccaagataataatctagtttatccaacaaggaaaatccttttatctcctccttcatccacaacttttctctactttcccacatctcttgaccgtgggcttact

SEQ ID NO: 171779 - DNA, 265 bp, Homo sapiens
attcgcggccgcgtcgactcattccattccattccattccattgcattccattccattccattccattccattccgttgcattccattccattacattcggattgattctattcaactcccttactctccattacattccattccattcgggttgttccattccattccattccattccactccattccattgcactcgggttgattccattccattccattccattccattccattccggatgattccattccattgcattccg

SEQ ID NO: 171780 - DNA, 479 bp, Homo sapiens
gagtgacaaaaagaaaaaaaaaaaggaaattattgtcgtatatattgtcccttcaaaggctggaatcattcgtattccattcagcaagtttcagcaatacatcaaacaaaatgtatcacttaattgaggaaaaatcattctaaaagatacaaaaaaccctgaaaccatcagttaattgaagcatttactttgtaaatctgtagaaaacgcttctgttattttgtatttttaaaaaatcatggctgggcacggtggctcatgcttgtaatcccagcactttgggaggctgaggctggtagatcacgaggtcaggagttcgagaccagcctggccaacacagtgaaaccccgtctctactaaaaatacaacctccgggggtccttatgatttggctgttggttaatattaatgcttgaagactaacatgaatctttatttcctcccaatacttgggttacaggttggctatgctacggagg

SEQ ID NO: 171781 - DNA, 344 bp, Homo sapiens
tctggggggaagggggctgagggatagaagatgacacactgggtgcagtgtgcactgctcgggtgatgggtgcaccaaaatctcggaaatcaccactaaagagcttatccatgtcaccaaacaccacctgtttccctaaaactattgaaatcttttaaaaaagtttcagtggctatataaaggaacatttataaaccatgatgccttaaacactgaagttctagattaacttaatccaaattactactttaattactaaaaaagcatatgagaatagagaactcatagttcttgcggttttaatctttgtgtcaccatgtgttggtacagaaccaaccaattag

SEQ ID NO: 171782 - DNA, 236 bp, Homo sapiens
gaacattatagccttccatttgggggcggtggtatttgtttcttgaaatgccttttcggatgctcattatttccagtcaagaattccttttgaacagctactctggccaggcccaggagagtcagtggtgaacagaagctgacccaggctctctccagcaagttggtgacagggtgagcagtgacagtctcaagtgctggatcctgagctctgacccgcagccctgtggtgatagg

SEQ ID NO: 171783 - DNA, 662 bp, Homo sapiens
tacgagttcaccatgttgcaggctgtcatgaactcctgacctgaatagatctgcctcagcctgccaaagtgccgggattataactgtgagccaccatacccagcctgtgtgtagtttttctgtgaaagaatatgttggttgcaagtatgagaaaacacaagttgggctggctttagctgtatggccatgtattggctcctctgacttaaaaggccacagtaggattgacttaattgagcagcccaggctcccctgctctgttctcccctgtgtgcactcgcacactttgttatcaggctggcttcattatgttggcagaatggcttgtggctcacatcttagagccactcagtaaagcttagaagagcctaaaaatgacttctgtcatctcttggccataacggggtcacttgcttacccacaaccattaataggggtacatagggttatgcacatgagttgagagctaagccacaaccccttgagcaaatgtggagggagcttctctcgaaacatggttgctatctaaacaaaaacctggagtgcttttaggaaggggaggacaaggattggatgccaggcaggcaacaaacagtggttattaagatgctcccccagggctggggcgggggctcacgcctgtaatcctagcactttgggag

SEQ ID NO: 171784 - DNA, 390 bp, Homo sapiens
ggagaggtatgtcaagggtctgattgggcccacccaggatggtttgcccctctgatggaggaagtctggtgacagagaggttgcaacctcatgggatgaggttctagggtcaaggtatgaagtggaaaccagagattgccaactacttatcatctcacacagctggattcccgttcggtgtggtgagaggcaagcggaactggagacaagttccatccccttctcgtcttccattcgggacatccgctcacggaacagggtggctgagtgtctacatctctctctctctcccttttcatcctgaggacctacagttgagttcctcttcgtgacggtgtgtctgctgggactcacctgcatgttcacgtatggatagaattcctatcgggg

SEQ ID NO: 171785 - DNA, 444 bp, Homo sapiens
tgagagggagtctcactctgtcgcccaggctggaagtgcagtagcgcgatctcggctcactgcaacctctgccttctgggttcaggcgattctcctgcctcagcctcccaagtagctgggactacaggcatgcaccaccatgcctggctaatgttttttgtattctttgtagagacagggtttccccatgttggctagactagtctggaactcctggcctcaagtgatccacccacctcagcctcccaaagtgctgggattacaggagtgagccaccatgctcagcccatatataatcattttaaagcacataaaacaagaagttggaagcactgataatggaagcaaaactaatgctaaggtattagtaagattaggagaattaaaaaaacaaggcaggtaaagatgttaacttagaaaattatagctaagctattaaggagt

SEQ ID NO: 171786 - DNA, 845 bp, Homo sapiens
gggctttcaaagaagcagatccaatgcccactgcccttcctcactcccctaatagatgtagggcaccatggacttttacagactgagggacatactctggatgagaatagtttaccctatcaaggaaaagtaagttccccagatgaaacgccacagataacaggcatattgtaagtcaggctttgtacgttttccaaaactcactacagggatcccctttgaggtgcagaatcttgtatcacaataatcacgattccttggccaaggccttttgatgtcatggtccgtgtttttctccggatcgttgggcatgcggaggcagaaggagagcctggcagagtgaatgacaaacgcaagggaggctgcagaggggagggagtgagggcggcccagggcccagcccggcgggagccgaggaagagaaggaccagccagccaagggcgggcggctccagaggaggcccgggactcccaagtttcccagcctcttccaccccacgcggatccctgccccgacgctgattcagggggtcaaagcctccggcggggcggaccgcggcggtgactggaggcgccccagtttctctgggtgtggcctgcggaccccctcgggagcaggtcgtcccgcaccagtgtctgcccccggcccccagggacacctgcacccgccccactcacgacggcgcgtcaggtccccaaccaggcgtggggcggggtgggaaggtctcggttcggccgccccgcctgtgctgtccccaccgccccccggcctcgggcagcgcgctcccgggtcacccacctcccgcgggcatgcgcagggcggcccctccgggcgctgcggccgc

SEQ ID NO: 171787 - DNA, 189 bp, Homo sapiens
gcggccgcctactactactactactgctcgaattcaagcttctaacgatgtacggggacatgccaggcaggggctgaccctcctgcagcttggacctttgacttctgaccctctcatcctggatggtgtgtggtggcacaggaacccccgccccaacttttggattgtaataaaacaattgaaacacct

SEQ ID NO: 171788 - DNA, 508 bp, Homo sapiens
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacacct

SEQ ID NO: 171789 - DNA, 843 bp, Homo sapiens
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacacctaaaagaaaaaaaacaagaaaaaaaaaaaaaaaaaaaaaaacaaaaaaaaaaaaaagaacaaaaaaaaagagagggcgggggccccgaacaaaggaaacccccgcggagggggcccaagaagcaacaggaggaacccacgcaaagatatggtgaacaaagggggggccccccaaagggggagcacgatcaaaaaaaaagacgacacaacaggaaccgggcataaaaaacaacacgcggaacgcaggaacaaacgcccgacaagcaagaacaacggaggaaagaagacaacaccaaaaaggaggggagacacaaaagaggaacaaagcaacactaaa

SEQ ID NO: 171790 - DNA, 754 bp, Homo sapiens
  misc_feature (754)..(754): n is a, c, g, or t
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcaggagatccagggctcctaaaacatgaccgaggttgagatgaaggcttgttcatggagtcaaaaatgtgtctaaaagaaaatggccagaaaggactacagagcctcgacttaataccaattgaagggcaatgctgttagattaaactgaaggcgacttaaacagcttaaagtttagtttaaaagttgtaggtgattaaaataatttgaaggcgatcttttaaaaagagattaaaccgaaggtgattaaacgaccttgaaatctatgacgcagggagaattgcgtcatttaaagcctaattaacgcatttactaaacgcagacgaaaatggaaagattaattgggagtggcaggatgaaacaatttggagaagatcgaagtttgaagtggctggatgacagaagtcccggatggcgaagaaacgaatagaggtgggttccn

SEQ ID NO: 171791 - DNA, 738 bp, Homo sapiens
cttgacaccagcagggtgacatccgctattgctacttctctgctcccccacagttcctctggacttctctggaccacagtcctctgccagacccctgccagaccccagtccaccatgatccatctgggtcacatcctcttcctgcttttgctcccagtggctgcagctcagacgactccaggagagagatcatcactccctgccttttaccctggcacttcaggctcttgttccggatgtgggtccctctctctgccgctcctggcaggcctcgtggctgctgatgcggtggcatcgctgctcatcgtgggggcggtgttcctgtgcgcacgcccacgccgcagccccgcccaagaagatggcaaagtctacatcaacatgccaggcaggggctgaccctcctgcagcttggacctttgacttctgaccctctcatcctggatggtgtgtggtggcacaggaacccccgccccaacttttggattgtaataaaacaattgaaacacctaaaaaaaagcagcagcaagaaaaaacaaaagaggggcgagccgtctcttaacagtttctcccttgcgaaggcgcgccccctcgcttatccgcggtgtaccccagctttctattggactacaaacaggtggctcccctattagcgtgcggctcgcctataatataccgcgaagcgacccgttggccgcgcagcgtctttccacacacgtctgtgtgcactcggggcacaat

SEQ ID NO: 171792 - DNA, 206 bp, Homo sapiens
aaaaaagagcaaacaatggtaaaatgttagcaaagttagagctgagtggtgggtacaaggattactatggtgttcctttctgtatcttaaaatggttatcattacagttttagaactgaatctggttttaaatacaggccgtcacgtgaggtgggggtttttttttttttctcccccttctttctttgggttttttcgtctttgtc

SEQ ID NO: 171793 - DNA, 731 bp, Homo sapiens
aaaaaagagcaaacaatggtaaaatgttagcaaagttagagctgagtggtgggtacaaggattactatggtgttcctttctgtatcttaaaatggttatcattacagttttagaactgaatctggttttaaatacaggccgtcacgtgaggtgggggttgctctgctctgtctaatccccacacaaagggcagcccttgccccattctctccgtccatcccttgctgacgccagccgtcgggagtcagccccttgctgtctgaaggctgccggcccgtggcccatgccgagctcctgtttgtctcagaagaactggcttcctcaagctttgatagggccaaaaggaggaccctcatcttcaagccctaacagccttcctaaagtcacccagacctgccagttctgcccaggcgtccagacggcaggcatcttagacgtcgctgcaagggtctgctccagatggtgagcaccttagacagacgttgctggaaggcactgctctgaacggtgggcacctaacagacgttccgggaaggcactgctccggatgttgggcatcttagatgttcctggaaggcactgctctggacagtggacaccttagacagatgttcctggaaggctctgctccgatgttcctggaaggctctgctccgaacagtgggcaccttagacagacgttcctggaaggctctgctccgaacagtggacaccttagacagatgttcctg

SEQ ID NO: 171794 - DNA, 482 bp, Homo sapiens
tacctgcctggagaaatgatcattttttccttcaaactttgctcttcccttttaattttttgagtagtgctttctattaactccctgacttgtacctcaatgctttggacatcctctgatttccctgctaagattaccatctccttaagtgtatcaaactcaatcaaaatcctgtcatctttcacatcattttttatggtgtcccacattgttggatccactttaattgggttgactttatatttagacctgatgctagagagtgttgtggaagtatctgcctgccaggtcttgattctcggtcttccttcattgactaaggtggctgctggtctgatggtaactttaccactgagttgggaccacgtgagctcacagtgacaacgcctcatttcatcgtttatctcctcaatgaggtgattctttttctgtaagaacttccataagggaagatctagtgactcttcaaatggtgctggaag

SEQ ID NO: 171795 - DNA, 844 bp, Homo sapiens
tcagaatagatgaagaaaagatgaaaggacaaaaggatgtggcataaagataacaagctgagatgaaaagggaccaaaatatgataaaggagtcatttcaaagtgctgcaaactaataattataggtaccattgaagaagagggcaagcaatcataaaaaaagaaacaatcaaaggcctaggtgaatttgattttttgatgttgattaaagccttgagttaaaagtgctgattggttactagaaaatatttatgaaaaaagacccatacttagacataacatggcaaactgaaatgtaggtttaaataaaacataattccataagcatccattaaccagaaaccgattatgtaaaaaaggaatgaaatcaatctggtatcagttttattctttgcagcactaatatcaggaaatagaaatggaccaaaatcttcaaagttctcaagttctcaaagggcaagattggggaatcagggttttcatcctacaaacaagtcattttgtttttgtattgttttgtttttaaatacaagggctctcagaatggactactcacatgctcttatctacaaaataagtagataaaattaataggctgacttaataagattcaagatatcgagaacaagcaagtattattcttatttttaaaatttgatattgagcataaataatacaaaagcaaaaaaaatcaaaagtaaaaatttatatgaaagagagataatggaaagaaaacagacaaacaaaacatcagcatggtgatatgtgtctacttttaagagcgagtgtaagcaagataatataagtaaaataatctgttatgacaataaatataaatgagtta

SEQ ID NO: 171796 - DNA, 891 bp, Homo sapiens
tctaaagacctcctcagaagagagagtatttgtacacaactttgccagagagggaagcttggcagtgtgaacgtgtgtggggtgtcccgggcgcggcgggcagtcagggtggccaatacaaggtgctggcggtgaggtgggggcggactgagcctgtgtagtgaagtgtcttgaggaacgtcagctgtatcttttaggaaaccaaaactgcatagacattgaacccaggcagaaggtcatgaagtcagagctaagaaatgctagtggggatagggggtgagatagagttgggaaatgtttcagagctacaggtgacagttgttggtgtccagttggatatgtaccatgaagggaagaagcagtcagagtgggcaccaagctttctagcctggaggactgaatggttctgtgcacatttcagatggaaagaatagaggcccacagaaagttaatgagatgcattttatacataccagttttgaattttaaggacctgtggggtagatatccaagatggctattcccagtaatttgtatttatatcttgctacatcgcagaaaggatttgaagctgctaacacacataagatataagattaaaataggctggacgtggtagctcacacctgtaatcccagcattttgggaggccgaggcgggtggatcacttgaggtcaggagttccagaccagcctggccaacatggtaaaaccccatccctactaaaactacaaaaattagcaaggtgtggtggtgcgtgcctgtaatcccagctattcaggaggccaaggcaggaaaatggttgcaggaggcagaggttgcagcaagctgagatcatgccactgcactctagcctgggtgacagatcgagactccatctcaaaaaaaaaa

SEQ ID NO: 171797 - DNA, 657 bp, Homo sapiens
tgcctgttgagtacaagtgctaaaatacaggtttctcagtattgtttcacatgtaaagcaaaaagccttttaatgcaacacctttttcctttttaccaggtgattttgttattgatctctaatctgcccctttagctgtattaaatgcttaaagtgttctgcttttccatgtagccttgatgctagctatttgtgtctataaattcattaacattaaaacaggatctatatagactattagagtctatgagttagaaaatggcatattacatacttgtttagggcataaataacaacataaatttaagattatctgcataaatgttataaaaatatgttcgttgataatatgttatgagattttaattatgtatttataaggaacatatttttcacaatctctcttttctttagcaatcactgtacacttaccaggagaataagagtagtcaactccatttcttaccatatccatccatacctagaaagaagaaaaaaccaaaactgggtacatttttatatataaagatatttgaacacggctgggcacaggctcacgcctgtaatcccagtactttgggaggccgaagcaggtggatcacctgaggtcgggagttcaagaccagcctgacaacatggagaaacccgtctctacta

SEQ ID NO: 171798 - DNA, 262 bp, Homo sapiens
tggggcttcctgtctgtcccacccgttcttcaatccgttttctctcctttattgtagatgctctccttctgtcattccattttttcttctgatggtttagaaattactctctttcaatcttgagttagcatcgtaggaattaaaacacacatatttataaaagtttaaaattaaatgttaagatcactgtaccatgaccttcaacatttaattttaaactttgacacctttaccctgctaaacaatacagtacagtgacctt

SEQ ID NO: 171799 - DNA, 524 bp, Homo sapiens
agaatgaggttgagatttctttttctttcactattctaaagatgttgctctactgttttcttgcttgcattgtttccaataaaatatttgtcattattttggttcttccgtacatagcattttcccccctttggctgcttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccactgcgcccggcccttggctgcttttaagatttgctttattactggttttgagtaatttgactgtaatgtaatttggtgttattttcttcaca

SEQ ID NO: 171800 - DNA, 568 bp, Homo sapiens
ttttggcctagtcctgcccacaaaggtgccagcagtcaccagctgaactgcccagtagataagacaccagagctaacacaaagactccccacttgattgcttcctttcctgccttttaaaagtacccgttgtcagctccaaaagtgaagcaatacacttaaggcaggatgcccgtatttcttcccctaagctagccttggaataaatcactttttttataccagaccttgctcttgaaaagtggactctgcaggtggcaaacaactaacctacagtttggttacagctggggtcaaactcccatgcctctctgactccttttagatacttctgacataaccatcggtaacttggttttttttttttcacacgttgttgtcctactttcttgcaaaatagttttgagacagttttaaaaattgaaacacacataaagaagtacatttaaaatttttttaatggagtaagagtaaaaacagttcagaaatttattaccccaatattctacagaaaataaatttctgaactgtttaaccatttaaagacaagtaaccatttaagatttatt

SEQ ID NO: 171801 - DNA, 208 bp, Homo sapiens
agcacagtggctgccctgtactgaaacttctaaaactaagaaatctgtgtgggatgaatagcacccttagcaccattgctaccttatgtgattcctaccatgaaaatctgcactttaaaaagcaggaaaatttgaaatccctagttttagaagtttcaatagcaatctacctggaaaaacaactggatgaactactaagtagaagaaa

SEQ ID NO: 171802 - DNA, 1541 bp, Homo sapiens
  misc_feature (3)..(3): n is a, c, g, or t
  misc_feature (132)..(132): n is a, c, g, or t
  misc_feature (284)..(284): n is a, c, g, or t
  misc_feature (440)..(440): n is a, c, g, or t
tgngacggagtcttactgtgtcacccaggctggagtgcagtggcacagtctcggctcactgcaacctcagcctcccgggttcaagcaattctcctgtctcagtctcccgagcagctgggattacaggtgccngccacaatgcccagctaattttctgtatttttagttgagacagggtttcaccacgttggccaggctggtcttgaactcctgacctcaggtgatctgtccccactctgctctgcttttctaagtcattgtcttctcaccgaaagtgtctgtcntttcctgtgtttcactgtggcaataatgcctctgatatgtacagggttggcgctctgttacccgattgctttccagctgtgtctggttcccattcatgctgcctccagcaacggataagtatacggcagcacctccttatttgagtgcaaatgtcnggttgtaatagaggtagatgattcttggtgtggtgccgtggtcattgtcgttttgtgtcatggtaacatgtcatccgacgtcggccgtccacaaatgtctgcagctacgatggaccctcagctgctggacaggaaagaggatcaagctaagaaggcccagagtgtgcaagcagagagagggtgtggacagaaaaccttgccttctccagggctagtggcgaaagctatctcaggctggctcaagtggagagaaaaaagcatgagatcaagcaatggacagctggggaagggctggcttttatttcctcagctcccaagctcagtccctggcactgggccgttgcctttgtaggtccctctgtgcccaggtcttgctatgggggttgtttcttggcattaaggtctcagttcaaacgccaccgtctccaagaagccctcactggtcaccctatctaaagtaaccctcactcctaaggacaaacctgttttttcttcctagcatagaccactctctgaaatcaccttgttctcccagtcatctgctgcccttggctgttgcgccagctataacatggcactctgccttgcccactgctttgtccccaggacccagccctgtacccagggtatggtaggtataagaggcctggaggccactatggaagagctcctgccagatggtggtggagtgcggtcatgaggacctcggcctccagtgtccccctccactctttcccagccctgtggtcttgggaaagtcatttaactctgctaagcctcagtttctgcatctgtaaagtgggaagaatcctctccaccttaagccttgctatgaggattaatgagatgcgtgtacagagtttagtacacggcctgccacattgtgagtgctcaataaatgttggccgttctcttcattatcgtcagcagctaacttcaggaacgagatcccctagggcagaatctaaggagaaactttcctatatcaaattgtatcttgtattgtggtactgaattgtttaactggtcctgaatgatataactggaatgaaaccagcttgtcatgtatatgtatacacataatatgggctgtcatatata

SEQ ID NO: 171803 - DNA, 511 bp, Homo sapiens
aaaagagaaagtatgaatatttataaataatatggtatctgggggcgaaaaacataataaaataataagaaagtagcttactacagaaagtaaagttctctgtgtaagagaatcatttaaatgaggtaaagcgattgggtcaaacacattaaaaatgcttgcttgccatcaagatacaatgagaatgaagagaaaggtgcagcttagtaaagccatacaacatatcagtgcacaggcagaacatcagctcactgtaaaataatctcaggctagtagctttcaatgacattaagggtttcagggacaggctaatcactgagtccattttagagccgtttggttttggccaaggggagggaagaagcaggtgataaaaaccatttcatcattttcaacacttttacgtaaacagatgtagaaatatcttcacacagcataatgaaaaatcacaaaggggctagatttgtaacacaacaaacaggttcaccacgtcattcgaagaaccaattag

SEQ ID NO: 171804 - DNA, 241 bp, Homo sapiens
atgaaagcataaaattggtgtgggattgccacttttttactggtatttcttcagaagccccacatgggctgcatttttcaaattaacattttgtatttttttttttaataaagaatggagcaattttgggcccagtgcagtggctcatgcctgtgatcccaacactttgggaggccaaggtgcgtggattacctgaggtcaggagtttgagacgagcctggccaacatggcgaaaccccgc

SEQ ID NO: 171805 - DNA, 235 bp, Homo sapiens
aggactccgtcacacgccgaagccccataacagaatgcacttggaagaagcagcgttttttcaattcttaaattctctagactctatgagtaaatactaaactgtattttcaaaggagaaacaggctggttctttcaaaatatggtccatttaaagtacttatccaggtcagatcagctgcttttttttttttttttgagacggagtcttgctctgtcgccaggctggagtgcag

SEQ ID NO: 171806 - DNA, 591 bp, Homo sapiens
aggactgggcagacacttgagaagtggccatcagttgtattgagcagttagcatgtaacactgtgtggaaacacacaggttttccttgggggagtgaagacagagacaaatgtggggcaatgaagtcagagacaaagacacttaatggctgtctcttcccaaatatacaccatgtttgggaagaatgcatctggaggcttttgggaaaaagaaatatttcataatcaagtgtttgcctaggatgctgcccttttcctaaaggaaatttatcaacatctgtttcacagccacaagataattgcatgtttattgaagttttgagatccatttatactggctagagcactcactgaacagttttgtagtcttcttataaaatattagattgggacttgttagagttatagattataaacaccacccaaattcaacattctgtaaatttttaccaccagttttatggctgaggctatcttagctctcttgacttccatccctagtacaagttgttggcattttgaaaggaaccctttcccctatctacagcaaaacaaaatttaaaataatttaacaaagttgacttttcactga

SEQ ID NO: 171807 - DNA, 654 bp, Homo sapiens
acaattttgaggttttgtttcctcgcctgttcactatgcctctacaatattcctccactgccctaagggagtgaaggtaaatgtttcagtgtgtcttcccctggaaattcttgactagttggtattttagtagtatttatttatttatttattgagttggagtcctgctctgttgcccaggctggagtgcagaggtggaatctcggctcattgcagcctctgactcacaggttcaagtgattctgcctcagcctcctgagtagctgggattacaggagtccaccaccacgcctggctttttttctgtaatcccagcactttgggaggctgaggagggcagattgcttgaggtcaagagctcaggaccagcctggccaacatggtgaatacaaaatacaaaatactaagaatacaaaaattagctgggtgtggtggtgcatgcctgtaatcctagctactcgggagtctgagacaggagaatcgcttgaactcaggaggcagagtttgcagtaagccgagatcatgccactgcactccagcctgggtgacaaagtgggactcagtctcaaaaaccaaaaacaaacaaacaaaaaaaagaaagtaaagaatgaatgagtcttgcttgctttcctgtttcctagtctcattatccaa

SEQ ID NO: 171808 - DNA, 258 bp, Homo sapiens
cacacacatacaccacagacatacacacgagcctgcaatgatggaagcaaaacagaacgtttggagatattcactgccgtttacaaggccacagtaagcagtaagcagattttctactcccctctagcagagaacatggtaggaaaagctagacattgtagacagcagtaagaacctaacagtcaacagtggacaatggattctgaaactgagatcctatactgcattcacacacgttaaggggcagggcgctgggaa

SEQ ID NO: 171809 - DNA, 477 bp, Homo sapiens
tcagcaatatgcccaagagctcgtgtttgcaatgctcgagtcccagccaggggagaaatgggtgtaagggacccacaggggaacaatttgtgttgacttggagctccacatgctccttcaaaggaagggagaaccttggaaggaggaaaggactgaagactttccagggaaattcaagagtctcaggcaattagtcagatccagaatatagatccaatattcagaagcagaagagggaaatgcaattatttgggggtctctctcttctagtctccttctgaaaagcccttttctaagacctcaattcctatgtctactcaatgggtatgattcctatcactttctcgtaagtacattttccttcaaagtttaaaaattttgtagatcttcaagtgcgtaaggcatagtagtgctaaacagaggtggaagtagtgaagggagttttgaacgtaaaaacataaatcgagagatgatgaa

SEQ ID NO: 171810 - DNA, 357 bp, Homo sapiens
ccagcctgggcgacagagtgagactctgtctcaaatgataatagtaataatcataatttaaaaaattaaaaaactgtgtaatagttggggcaaataggagtgggatgggtgctgtaggttgattggtcaagaaatgtttgtctcaagaaaatacttgaactgagacttttacgtgatatgaaggagccgtgcaaagatctgtggatacaatacgccagaaacgaacagataacagatgtccaaaatgcgaacacacctgacatgatgcaggaacaaaacagtaggccaatgtgactgtagtgcctacagtgtgatgggaagtgggtggagggcagtgtaggcattgtaagtcatggc

SEQ ID NO: 171811 - DNA, 260 bp, Homo sapiens
ctcagagagctacgtatcctaacaccaacacccaggtacaccctcggcagggatcccggtacacgcacaccctaccgggtgttctcacaactccaggtcgggcgatggacacccccagaaacagatatattcagtgcttcttgtaagcagggatccctttttctctccatatccccatcacctagcccagtgtctggcacacagtaggtattctgtaactcttgaatggatgaataaatgatttgttgacgatgggagga

SEQ ID NO: 171812 - DNA, 367 bp, Homo sapiens
caccaagccaaggtgggccgcaactgtggctgttacagttgattagttgcttcatttaacatacaagatgtctggggcagtggctcatacctgtaatcccagcaccttcagaggccgaggtgggaggattgcgtgaggccaggagttcgagaccagcctgggcagaatagcgagacccccatctttagaaaaaataacaacaggccaggcgcggtggcttgcgcacctgtagtactgctgaggagggaggatcccttgaacccaggagtttgaggtggcagtgagctataatcgtgctattgcactccagcctgggcaataaagattctatttataaaagaaaagaaaatgcaaagccagatgatgg

SEQ ID NO: 171813 - DNA, 470 bp, Homo sapiens
ctcagagaggagggctcacaggatttgacctttaccagcgatttctgtccatatgtggatgtaaacagttctggaacgttatgcatgcagttagcgaatccttgaattatgttctggtttgtacttgtcccatccatccaaacaatcatattacagtcgatgatgccactgcacttggccaagttatttatttttaatctctcttgcccttctcccaaggcaggcttaagttgagactattataggtgtctaataacctgtgacagagtaatgagtacatgcttaagatgttataattagccaacaccaacacagcaaaaaatataattccagccaaagattctggaaaatccctcagaaggagggataacaggatttgacctttaccagcgatttctgtccatatgtggatgtaaacagttctggaacgttatgcatgcagttagcgaatccttgaattatgttctggt

SEQ ID NO: 171814 - DNA, 201 bp, Homo sapiens
tacggcagggacagcagaaaacatgtaaagcactgtgggaatgcagagtggcagcgggaaaggctctaaattaggtctactgtggtccctggacctgcagcagcagaatcactgtgaactgaatagaaatacaagtctagggcccccctccagacctacagacacagaaactctgggggcagggcagagaccagtatttgt

SEQ ID NO: 171815 - DNA, 449 bp, Homo sapiens
gggacatggatgaaccttgaagatattatgctaagtgaaaaaagcaagtcacagaaaaacaaataatgcatgattctacttagtatcaggtatctaaaatagtcaaattcatagaagcaaagagtagaatgctgattaacaggggctagggagagaaagaaatgaggagctgctaatcaatgtgtgtaaaatttactacatgagatgaatcagttctagagatctgctgtcctacatggtgcctagggctaccaatactgtattgtactacaaaaaaatctgttagaagggtagatctcaagttctgttcttaccacaataaaaaaaaattaaggtttagcctatgtatcagcactgtgaaagggcttttattttattcttttcctttcatttaagggcactgtctaatttggcaagagcacagacaatttacatttttccagttatgt

SEQ ID NO: 171816 - DNA, 404 bp, Homo sapiens
tctcttatcgcccaacacattataggcaaatcaattttgctcatccaggctttgcttgcctgttaattttgtgcaggcgctttgtcaagattcaccagaggacaaatgatttggagaaggacaatgtaagagataaaagcatgaacagtataaccgggcaagcattagaatatttctgatatttaagtacaaatcctctttcttacttatccataaacccctgtctttgtaacacctagcacaggccatgctggttaatctggcagcctagaacaagaagtctctattcattctaattctttttattctttttttttttctttttttctccacatctgtagcaattgtaggtgaaataagaacagggagagtgtagcgggtaatggtgttggggataacatgca

SEQ ID NO: 171817 - DNA, 442 bp, Homo sapiens
  misc_feature (105)..(105): n is a, c, g, or t
  misc_feature (209)..(209): n is a, c, g, or t
ccatgcgtgtcatctgagcctctggcttccctgccagtccagccctggcagtgtcctacttcccagggctgttgtctgcctggcgggaaggtcctgggcaaaggntcagtctttgtactctgagagcagactacttggctcctctctgttttttatcagcgaagttggatatatctctcccacatttccctaatcatatgctatatatnggctttttttttcttctctatctcccaaatacatcaagatgtttgtactggatgaagctgacgaaatgttaagccgtggattcaaggaccagatctatgacatattccaaaagctcaacagcaacacccagggtgagggcagtcttgcttgaatagctaatgattcttgaaaaatagtaagtgcccagggggaaccaaatactggattcttgagcctttttatgcatctgctt

SEQ ID NO: 171818 - DNA, 373 bp, Homo sapiens
  misc_feature (105)..(105): n is a, c, g, or t
  misc_feature (209)..(209): n is a, c, g, or t
ccatgcgtgtcatctgagcctctggcttccctgccagtccagccctggcagtgtcctacttcccagggctgttgtctgcctggcgggaaggtcctgggcaaaggntcagtctttgtactctgagagcagactacttggctcctctctgttttttatcagcgaagttggatatatctctcccacatttccctaatcatatgctatatatnggctttttttttcttctctatctcccaaatacatcaagatgtttgtactggatgaagctgacgaaatgttaagccgtggattcaaggaccagatctatgacatattccaaaagctcaacagcaacacccaggtagttttgctgtcagctacaatgccttctgat

SEQ ID NO: 171819 - DNA, 706 bp, Homo sapiens
caatcttaagaagcaacaatgctgcagttaagaatatgtgtggattggccaggcgcagtcactcatggctgtaatcccagcactttgggaggctgaggcaaacagatcacttgagcccaggagttcgagaccagcctgggcaatgtggcgaaaccccatctctacaaaaaatacaaaagttagccaggtgtgatggtgtgtgcctgtagtcccagctactcaggaggctgaggtgggaggatcacttgagtatgggaggcagaggctgcagtgagctgagattatgccattgcactccagcctggcctgcagagctagctagaccctgacacacacacacacagcaagtgtggatgtttataatagtgaaaatttggaggcaatctaggtatctaatgggaagattaataaaattatactacatgtacccagtacagttccattaagcattaaaatcattttgtggatgtgtacttctggactttaattaggaaaaacgggatgaggaagaagactatgaaagatcaagtaaaatgtcatagaaaagaaacaaaaaaagtatccaaaagaaaattaggtataggtaaggaaagcaaatgggatcttatttatgtgttttagacaaaagaatatatgaaatagtaaagtatattaaaagacaataggaaagcttttttgaaataaaagaaaacctgaataggaaagg

SEQ ID NO: 171820 - DNA, 384 bp, Homo sapiens
tcctgggcttaagccatccacccgcctgggcctcccaaagtgctgggattacagaagtgagccaccgcgcctaatcgggtggtttgtttgtttattgacggggtctcgctgctgcccaggctggagtgccagtggctgttcacaggtgcagtcctggagcattgcatcagctcttgggctctagcgatcctccagagtagctgcagctgggattccaggcgcgccaccgcgcggggctcagaatgggtttttatattgagggttatgctgccacctagaggatatatgtagtaccgaactgtgtgcgcagggaggctgaggttgcagtgagccaagatgatgccagggcactccagcgtgggtgacagagcaagatttcatctc

SEQ ID NO: 171821 - DNA, 622 bp, Homo sapiens
aagacagagtttcactctgtcacccaggctggagtgcagtggcacaatcttggctcactgcaacctctgcctctggagttcaagtgattcttatgcctcagcctcccacatagctgggattacaggtgcatgccaccatgcccggctaatttttgtatttttagtagagatggggttttgtcatgttgcccaagctagtctcaaactcctgagctcaagtaatccgccactttagcctcccaaagtgctgagattataggcgtgaggcaccacacccagtccaaagaagaaatcttaacagaaattttaaaatatattgaactaaatgaaaataaaaatacaactatcaaaatctatgcaatgtagctaatgcagtgcttagaggaaaatttatagtatgaatgcatatattagaaacaaaaaatctaaaatgaatacgcttccactttaggaaagtagaaaaagaagagcaaattaaatccgaaacaagcagaaaaaaattataaaaattagagcagaaataaatgaaactgaaaataggaaatagagggaaaaaaatcaagaaaatcaaaagctgtttctttgaaaatatcaataaaataagcaagcctctaccactggg

SEQ ID NO: 171822 - DNA, 584 bp, Homo sapiens
agggttactgtggttaaatcactatatagcaaccaagccaggccatttcagggttctgaaagcaggagtattgcaacagcagctaatgtatgcaagctcaactctagatgggagaaggagagaatggggagctgactctgtgggtcatcatccccaccaatgcccaacatcctaggacaggccttagctgcagactagggtttctgacatgcctcctccttcctggcatctgacaacagatggccctgcactacagaaatagcatttataagactaaaaagctctacgcaaaagtgttactggaaaaattcatgccatgtaaaggattctgattttttacaacaaaatgcaaaaagaggcaactgtataaaaaaagcactggcgcagaatcaagcaaccttggaaaagccactccccttctctggacctgtttcttccatagtaaaatgaacagatttggccaggctagtggctttcaagcagtagaccagagctggcactgaagctgcccttgagaagtgagtaaaaggacagcccaactactaggacttggagtcttctattcctccttcaaccaagccaac

SEQ ID NO: 171823 - DNA, 267 bp, Homo sapiens
tctcatggagacagagagcaaattgatggttaccagaggctgggaagggaaggtggagatgagtataatgaagagaagttggttaacgggtaaaaaaaatagttagataggagtaataagttctggtatttgatagcacggtagggaaattatatttcaaaacagctagaagaaaaaagtatatttcaaaacagctagaagaaaaaaagtataatgttcccaacacaaagaaaacataaacattagaggtgatgaatatcccaatta

SEQ ID NO: 171824 - DNA, 452 bp, Homo sapiens
cgcagccctcgagttatgcggcccccatttcccaccacaataaagatccacctctctatcccaggttttattccatcatatttaaggcttggatgtaatttttggaacaattgactgctttatttagttggtggggagaggagtaggagagagaagcaaattacagtcaatgacaggaccagggattctgagcatacctgcatgtatgcatactagacactgatgttccagccagtgaaaggagatataacttctaaaaaacagtatcaactttattatgcttggaagtaatgagaagagaggcaagaagcaggcaatggtaagagaaagcgggtgggacgtagtggcttgcacatttaatcccagcactttgggaggtcgaggtgggaggatcgcttaaacccaggagtttgagaccagcctgggcaacatagtaagtctccatctcttca

SEQ ID NO: 171825 - DNA, 935 bp, Homo sapiens
  misc_feature (1)..(1): n is a, c, g, or t
  misc_feature (10)..(10): n is a, c, g, or t
  misc_feature (15)..(15): n is a, c, g, or t
  misc_feature (25)..(25): n is a, c, g, or t
  misc_feature (717)..(717): n is a, c, g, or t
  misc_feature (732)..(732): n is a, c, g, or t
  misc_feature (738)..(738): n is a, c, g, or t
  misc_feature (758)..(758): n is a, c, g, or t
  misc_feature (778)..(778): n is a, c, g, or t
  misc_feature (786)..(786): n is a, c, g, or t
  misc_feature (801)..(801): n is a, c, g, or t
  misc_feature (811)..(812): n is a, c, g, or t
  misc_feature (815)..(815): n is a, c, g, or t
  misc_feature (817)..(817): n is a, c, g, or t
  misc_feature (822)..(822): n is a, c, g, or t
  misc_feature (845)..(845): n is a, c, g, or t
nacttaagcntatcnggcctctctnctttaaggccgtaccaggaatgttgcatagaacgaccgcctcttcggctgcgtggcttcggagcagctttgactacaactcccagactgcatcgcccctgcccccccacttccggagctgacttcacttcgaggaaccttttccctccaggaatcaaggattttcttttgctttgtggccggattttgctactgcttgctcttcttactttaattatttctgtgactacctcatggcttaactcatttaaatctccccaagtttatctgaaggaagaagaagaaaagaatgagaaaagacaaaaacttgtgagaaaaaaacaacaagaagcacaaggagagaaggccagcagatacatagagaatgttttaaaacctcaccaggaaatgaaattgagaaaactggaggagcgcttttatcaaatgacgggtgaagcctggaaattaagcagtggtcacaaacttgggggtgatgaaggtacaagtcagacatcttttgaaacatcaaacagagaagcagcaaagagccagaacttgcctaaacctttaactgaatttccgtctcctgctgaacagcccacatgcaaggagattcctgattacctgaagaaccttctcaaacagcagaagaagtagttacttgtgtgctctcccgatgtccccaagtgagaatgtcctgaggagaaggttttngaagtcctacagctnacaggncttatttgactggatgacgngaattgggtacacatatctntatacagnctttctacttccttnccagaaggcnntgnantgganggaggccctcctagaggacatangaatacctgtgaccctggcttctcccggaggggaaggaccacccactaggaagaaggagagccccttgttgatgagacattttctttaac

SEQ ID NO: 171826 - DNA, 125 bp, Homo sapiens
caaaagatatccaaaattgaaccactactcttcatctttaactctgtcactctgctgcaatcactatcatctctcacataattacctgaatagccttaaaactatttctacccatagccccacta

SEQ ID NO: 171827 - DNA, 486 bp, Homo sapiens
ggcgtgtggcaccatgcccagctaatttttgtatttttagtagagatggggttttaccatgttggccaggatggtctcgatctcttgaccttttgatccgcccgccttggcctccgaaagtggtgggattacaggcatgagccactgcacccggcctgcagatatttttttcagttagctacttttcttttcactttatagtatttttttacttaattgtggcacaatacacattagtgttttagccattttaaagtatacaatttagtggcatttcatacattcacagtgttgtgcatccatcactgctgtctagttccaacagattttaatcacttctaaaagaaaccctgtactcattccctttgccctctatcccatggctactaatttgctttctgtttatggatttgcctgttctgaatattgtatacaagtgggatcatatatagtagacccttgaggaatgggggggttagggtcacc

SEQ ID NO: 171828 - DNA, 372 bp, Homo sapiens
cctctaccatatctttaagccacactgagaatgtactgttttcctaaggtgtagtttgggagcttacaagtttgttttctttaatgatgagtaccataacgctattatcagactttttcctcttttccaaacctgtttttatttcctttgtagtttttatttagaaaaggttcttcttaattatgtacggatttattgtgaccacatcaatgggtttatttattgatttttcatgaatcactgctctccttggcacaggtcagggtgtgtttgtaaccatcattatatgtgttatttttattccatcaactatagcattgttactaattaccacagagagctggaacggtgaccgttttgggtacagcgcga

SEQ ID NO: 171829 - DNA, 208 bp, Homo sapiens
gcggccgcgacgctatggcgcactggagtaccctgttcctggcagtaagtgcttctgggttctggcgttgctgctcagtggggcccaagtttgcggacccgggatctcaggatgcaggcagggcttatgccccgcgccggacagggcgtagggtgggcctcctcctgcccctactcgcgcggtttgctcctcagtctccttcccttgc

SEQ ID NO: 171830 - DNA, 729 bp, Homo sapiens
cattggacagctttgaagaatgttagggatccataagaatgtacagttttgaattaaagagaagaattgagcatttatcctgtttttcctttatggattatgtctaaggataaccaaatgttgatgacagaaaatcctttttaaagatacctttagccaaagaatgaagaaagaatgatagaattgaaatgttaccatttttgcaacccctaatgaaataatgaatctagccagttgttatcaattgttgctaacataaaaaatgagagacaaacagacacgcctcttcatagaagtatatgataccacctataaaatattactgccagaaaaaaaaatcaaactttggatctaattaccaattagatcagcctttagctctaacaaccaatttgcaatatttacaggagatacaggagcatgttgaatgacaccataaaaaggcaatcagtaaaatttagtttattataaactatataggataagtgatccagttgctgcaataaatatattacagaaggtgtgtattggcgggtgggagataaaggagcaatctatagataaaaacagacttaagggacataaaaacaactttaatgtatggatcttatttggatccttaagaaaacaaattgtaaagtagcatgagacatttgaagaaaatagaaatagtttttaagtgtggtaatgatatcgtggttatacgttgttaaagaatgcctttagagg

SEQ ID NO: 171831 - DNA, 416 bp, Homo sapiens
tttcaccctccaccatgattatgagacctccccagccatgtggaactgtaagtccaattaaacctccttttcttctcagtcttcggtaggtctttatcagcagcagaaaaacaggctaatatagtaaagtggtaccagaagtagtgtggtacattgctgaaaagatacgtgaaaatgtggaagtgactttggaaccgggaaacaggcagatgttggaacagtttggagggctcagaaaaagacaggacaatgtgagaaagtttggaactctctggagacttgttgaatggctttgcctaaaagcctgatagcaatatggacaataaggtctaggctgagttggtctcagatggagatgaggagcttgttgggaactggcacaaaggtgactcttgttatattttagcaaagacact

SEQ ID NO: 171832 - DNA, 127 bp, Homo sapiens
tggatactaagatacatgtaaacacaaacagttcaagtataaaatatgggatggcacaattgtacccaaaattgggtagagaaaaaagttataatttattgttgctagggtgaatttttaaaaatgt

SEQ ID NO: 171833 - DNA, 538 bp, Homo sapiens
ccaagatcgagccactgcataccagcctgggtgacagtgtgcgactctgtctcaaaaaaaaagaaaagaaaaagaaaagaaaactgagatttaaaaaaattaaggttaattaaggttattatatccatgtaactttctgtatttcttttaaagttcttgtgctactaattttcagggctttgactcctgagtctaaaaaggtcactaactcccgctaaattgagagcaattgaagcctcatcttcagatctaggagaagatgaaaatcagaataagctgcagtcatgagacatggcgccagaaattaagactattcaaaccctctagtcccagggactattgaagaagaagtgggtgtgtaagcttgtaaggacctattttaacagataaaattagttcagtttctgtataatttatagataatttaatttaaagagttttttttttttttccagataaggtctagatctgtcacccaggctggagtacagtggcatagtcctagctcactgcaacctccacctcccaggctcaagtg

SEQ ID NO: 171834 - DNA, 462 bp, Homo sapiens
ggatcgaccacacccagttggtatcagtcaacagtgtatcatgccgtgtgtttttttaattcatgatttcctcttgaaactccactgaggagtgttaactgtgtgcgtttttttaaattcagttttgtatgctagcattctttaaatgtctgccagaagtttaatttgaatttctgatccctgaaggcagctagacagaatcattctagttcttcataaattgccttctatgattcattgttaactcataaaacatactcatttctatatactcaaacagttaaggtagttacagtatcggaaattttttttttttttttgccttatatttaaatcgtcttttgagaaagaaatcaagaattagcttgaactcccagttaaggcatgaaccctgtagcacagaaaacatcagaaatgaatgttgttatctcaaggaggttaaggtagaaggcatgaaatctg

SEQ ID NO: 171835 - DNA, 660 bp, Homo sapiens
agaaaatggattccactcaaaaacttggaagtgaacatttatagcagctttattcagaactgccaaaacttggaggcaaccaagatgtccttcagtaggtgaatttgtaaacaaactgtgatccatccagacaatggaatattattcagtgctaaatggaaatgaggcaccgggccacgagaagatgcagaggaatgttagatgcatgttacgaggtactagggggaaaggagccaatctgagaaggctacaaactgtagggctccaactacctgatgatctggaaaaggtgagactacggagatggtcggaagatcatggttttccagggttaggaggaggcagagatgtacaggggtagcacagaggatttttagggcaatggaaccactctgtatggtgccataatagtggatacatctcattaaagatttgtcaaaacacgtagaatacacggcaccaggagtgagccctaatgtgaactgtgtttggttgatgatacgtcagtgtaggctcatagattggaacacatggaccactctggtaggggatgtggatggtgggggtggcctgtgtatgtgggggaggtggcatatgggaaatctactttccacccaactttgctgtgaacataaaactgctcaaaaaaatagtcttttt

SEQ ID NO: 171836 - DNA, 395 bp, Homo sapiens
acttgctgaaccacacttcttccttagaattatataataaatacagaatatgtacatttacttgtgtatagctgcctgtgatttacctatagtaaggtcaaaagcattctatggacatggtcttccttgagcccttcttctgtgctgtcattttcctttgccagggaaatggtttctcaccatccctcccatggacacctatgtctggaaatgtctaaaacacttttcgaatagcaagttgctttctcctataccagcaagaaatttttgcaactccacctgtccctcaaagcaatgtggccacaataacctctgcaagtctgtctgcctatgctgtttctttttctaatacccaactaatttattgatttatattgtctttacgtctcctctgg

SEQ ID NO: 171837 - DNA, 402 bp, Homo sapiens
gggcctgccgcccccccgcatcaggatctgccctcagtggtttctacttcaggaaagtcctgcagtcctcttggcatagcaaggcctggtgggggtgggtcccagaccaggaccctgatgccccttccaaccccagaaccctagaacccgggtagggggtcctcagagctctttccctttgccccacccaccctggcctgtcacttggaaataccctggacagtttctctgcctggtgcctgtggctccttccggaactggtgcccatgcccctcccctcttggttcccaggcgccaggtctgcctgtgggaattgaagtcagcaggaggcaccatggcactgggaagcgtccgggctctggcccagccctggcccaggtgccccacagagcaggcggggaa

SEQ ID NO: 171838 - DNA, 202 bp, Homo sapiens
ctcagttgattgttcctagtaactctttatgaatattaccttgttcttcaatgctcctttccttttatcatcagtaagctataatatttactagctagtatcctcaatatgcatctcatctgtgaataatcgtagccatgtgaagcaagcctataaagggatgacaaatctgggatatccatgacactactcccctctcctg

SEQ ID NO: 171839 - DNA, 148 bp, Homo sapiens
attttacaggtgaggaaactgagacaaaaagctgaagttacttgcccaagatcacatggctggtaaatggcagacctaggcgttgagcctgtgcctcctcagagaccctatccagtgccatgggagtcatgctacccggcctcctgag

SEQ ID NO: 171840 - DNA, 261 bp, Homo sapiens
cataaagaacaataaagtactcctcccaaagtgctgggatgacaggcctgagccactgcgcccgcccagtccttggtactttttgaagaagggctgtattctcactgtgcacggccccccgagtcccacccccctctgccctcaggtcaccacggacctgcatcacgggtgcacagaccagcacacgggcacctcggcctcagccccactggcggccggcatgatcgccctagcgctggaggccaagtaggtgactgcggg

SEQ ID NO: 171841 - DNA, 167 bp, Homo sapiens
agaccagcctggccgacatggtgaaatcctgtctctactaaaaatacaaaaattagctggtcatggtggcacagttgatagctcaatgaaggctgtggaatgggggctttcaggtttggttgcctgagccaccagtcgttctgctatgacatggacaggaccacagg

SEQ ID NO: 171842 - DNA, 339 bp, Homo sapiens
ctagcttgggcgacagagagagactctgtctcaaaaaataaaaatttaaaaaaataaataaataaaaatttaaaaatcaactaaactagccaggttcaaggttgctctagaataacattcttcgtggttgtaattggctgtgcttcatggggtggagtccgggcagcgctctgagaagtgcgtgcagcctagggcctttctcaccgagagctcagaccgaggtctccatgagccccggggagcaggaagccactgaacctcatcctgggtgtgttgagacagaaggaaaggctgagaactgcagatttagagattgctaaggcaaaggaaggagataga

SEQ ID NO: 171843 - DNA, 126 bp, Homo sapiens
taaactaaccaggctggtattagtgattcttaaattctacaccaatgtgctgaataattgagttttcaaattgactttctgtatttgtactttacatctatatattgagtcttagcccagtgatct

SEQ ID NO: 171844 - DNA, 261 bp, Homo sapiens
gatgtacacgtaaaggttaaagaagattaagaagatatcccttaggaaagagtttttaaacttttgaaaatgctataagaattttgaaaataatatacccctctggatgtctgcaagcgacattaagaaatttttttcaatacaaaattgtgttatttttaaatgtatcaatggaatctaaatagcatagcaatgtgatacctactatcctgtaaaaaaataccagttcagcatttggaaattttccattattcttttttc

SEQ ID NO: 171845 - DNA, 344 bp, Homo sapiens
ggacgcgatttcctggctgcgctcccggggtaggaggtttgcgctgggtcccatcccccggccggtcctgctcaggaaacgcggagagaaagccaggaaccaggcctgccaggccctgcggcccctcagcgccgtccctcctccccggccctcggctgcaggaagccggctggcgggaacgccctgcctggtgggtgggaaaggccgagagcgcgcccggcaccggcggcttcccaggcccgcggccggctggcggcgcggagctgtcactgcggcaaacggcgaacgcgccggccccctcccccgccgcccgcaagcctggtgcagtcggcccatgagtattt

SEQ ID NO: 171846 - DNA, 203 bp, Homo sapiens
  misc_feature (177)..(178): n is a, c, g, or t
  misc_feature (185)..(185): n is a, c, g, or t
aaaaataaaaagagaatgctaggttgctgaaagagaaaaaagcaaagagccagtctgagaaacaccacggaaaatgtgtgttttttttcgtgttgattctcctggtaggctcctgggctattctctagtcagctctctggcagcaaagcatagtatgatttcagagtatcgggtccnnccaatcnaacatggcaactgttctg

SEQ ID NO: 171847 - DNA, 846 bp, Homo sapiens
tgtcctcacatggtagaaggacaaaaaagggccgaagctagttccctccagcccttccctccagccctttccctcaattcattcatgggagtggagtcctcatgacttaattacttcccaaacaacctcacctcttaataccaccaaagttgagattaaatgtcaacatatgaattttgggggacattcagatcaaagcagtattatagcacatttgctttcagaaatgcataatgatatatttttgtgtgtgtttgtttttagccagggtcttactttgtcacccaggctggagtgcagtggcacaatctcggctcactgcagactccaccttgcaagttcaagctattctcctgcttcagctcccctccccccgcaaatagctgggactgcaagcctggccaaatatggtgaaaaccatctctactaaaacatacaaaaattggttgggacgtggtggtgggtgcctgtactcccagctacttgggaggctgaggcaggagaattgcttggaaaccaaggaaggcggaggttaccagttgaagccaagattcgacaccatttccaacttccagcacgggggggacaagaggccaaaacttccggctaaacaaaaacaagccgggacgagtggacacaagtgcttgtaagtctggaatcccagcaccttgggaaacgtggctggacacatccccgttagtgggaattgacaccccgccaggacagtggggaaaacctatctctataaaaatcaactacccaaaggtggtgtaatgacgtaacccgaaccaagaagtcgggggaatttaaacccgaggcggaaatggagcaaatggcaggagacgg

SEQ ID NO: 171848 - DNA, 342 bp, Homo sapiens
accactgctggggacaagaggcaagttggctgagcacagagccaacgggagaagggcagtatgccaaacagttgggaccgaggcaccccagcaacatcggccctgctgtccctttaatgaaacggttgtgtggtggccggtgaaggccatcactggaagtctctatcgccataaaccaccagggacagagcaatgtggcctttccacttccctgggcaaagcactgcagtcgtcccaggagcagagctactgctggctgcttctctaggtcgagatggaatctacacacaggcaaaactgcccactacagggtacacttagatctgaatgtggacaaacata

SEQ ID NO: 171849 - DNA, 215 bp, Homo sapiens
agttatgtaagatctcagttagacatgccattacatacagttaaaacaacaacagcaacaaaaaagcaaagaacatgagcggagagacaacactggtgccatagacagtgtgcagtggttattctactacaagcaagaggtatccaaggcctgaataaaacagtagtgatgaaagttcacttgcagaatgctcataaaggtaattgagggtagca

SEQ ID NO: 171850 - DNA, 795 bp, Homo sapiens
ggattgagatcagctctgtagtaatgacatgaactaaaagtaagagtgatagaagtttctccaaaagaaaataaggactctttagttactaggaatgagataaaaacaagaatattcacaatagtatagaaacataataataaaaatgtgttatttaatgattgatacaatactagattctctgtgggccttacttaagtggctttcaaatgtttttgcatattaaaatcacttgggaaggttttaaatatctcagtgtcctggctgcacaccaggccagttaaatcagaatttcgttagtacctaagcctgtgtaatttgttttgaagttccttaggaaaatcatgctaacaagaactaggtagacagatctggtagagtcaaggttcaaaaagagggatttcaggggacagagaagttcacatgggagaagcaggatccaatggagagaacagaggggcctcaaagagagagagaaagaaggacctccagcctaggaggtacctatcaaaagaagcgtgggactccaatctagtttcagagagtacactcaaaatcttaagtatcagaattcttgccagcttcagtgtatgttcagtggttcaggaatctgactcaccagtggatccccattaatcagtcagacgtgaattcaaaggtgcaaacatagggtcctgggtccagtgatgaatctgattctgagtcacagcaccataactgttaaagaaaaaattactcagtgatacttgttaaagcatgataaggctgactttcttcagaatcattgagatatag

SEQ ID NO: 171851 - DNA, 168 bp, Homo sapiens
ccttttttttttggtttgaggattattttttaagttctttagttctcagctaagaacggtgacagtaggggtagaaaatgagagctatacttgtgtcctaggtttgtcttccttctaagactgtaagtgtttaggtaaaatgagtagctgaatgaacaaagaaaagga

SEQ ID NO: 171852 - DNA, 781 bp, Homo sapiens
cggccgctggaggggcgccgctctcagggctcggtcaggcggcccctgcgactcctggtgcccggctgggacacgtggggccggctttgcggagtcagcagggccaaggtgcgcggggtgcgctcccccccggaaccccgccccttctcaccccatctcgcttttttgggagaggagagtggagccgtcagcacccactggcagtgtcggtgctgtgctgggagtcctcccagaccagcccactcctcctggtttgagcttccgatccatccctactcctttacggttcttcttccccgtagttaacctgcggagaggaggaggtactgtctccgcacaaggtactgcggaggtaccttgcggaggaaccttgcggaggaggtactgcggtggggaggcaggggggaggcgcatctgcctccgcacaaggggtctaatggcttgcttattccttctaggccaggttgaaaggtttttaaaagcaggtgggggtgccaggatagtgagaaaaacaagaaaagacactgctttttaccccatgcggggcagagctggtctcctttctgcaggtgttgaggggagttgagtaggagcccagagctggtacaggccccgtttaacgtgcccccgcagagtgagggctgggggtcaccccataggcaggggagcccttctgggagggaattcctgcttaggtgggaggttgacctgaatgacatctaggtcctctacctcccagatgccgaattttcagggaaggaaccaaatggatgtatggccc

SEQ ID NO: 171853 - DNA, 476 bp, Homo sapiens
gaggcaggaggatggcttgaggccaggagttcgagaccagcctgggcaacatagggatataccatctctacaaaaatttaaaaaaattagtcaggcatggtggcttgttcctgtagtctcggctgctagggaggctgaggtgggaggatcacttgagcctaggaatctgaggcaacagtgagctataattgtgccactgcattctagcctgggtgacagtgagaccctgtctctaaaatgaaataaaataaaaataataattcttacaatgaaggtaagagagaaggagaatgggtggccatccaggtgtgatgggggttcttcattggtggaagagagagaatactctagagacagcctagcagaggacactgggaggcagatatccatacttggcataacagtctttcagtgagacaagaattctctatgtgcatttttttttttttgagatggagtctcgctctgttgtccag

SEQ ID NO: 171854 - DNA, 306 bp, Homo sapiens
atagcgtacctctactcccctgacacaaaatcattcaagaagaaatagataccagcctgagcacatggcaaaatcccatctctacaaaacatcaaaaaaaaaaaaaataagtcggggcatgggggtgcacaccttgtaatcccaggtagctgccattaccggtgcccaccaccacgcctgggtaatttttgtatttttagtagagacggggttccaccatcttggccaggctggtcttgaactcctgacctggtgatccacccgcctcggcctcccaaagtgctgggaatataggcgtgagtcacc

SEQ ID NO: 171855 - DNA, 460 bp, Homo sapiens
tcaaccacacaagtgagattatgaagaatcttcagatgactccaaattaggcactggtttccaaaatgctacctgtaaagacatcagaatctttccctgatggaagcaataaaaaaaggttacatgaggttccaaagagaaagaatttccctgggaactgtaatattttctgtattataactaccatatgcttttttcacttgaacttgggccaagatttcagaagattggcaaagacatgaaagaatataactgtttttaaaaaaaataaagggcattatctgtagtagagatattttataaaatagtctgtaaatcaggcacttcattttaaaaaaatgaaatattttaactgaaaaacctgaacacatctggtttcttaaagacaataaataacgcaacatcttttgatccatttcatattccatttttgcctctgctcccagccttgactttcttg

SEQ ID NO: 171856 - DNA, 851 bp, Homo sapiens
acaaaaatgcaagtagagcccattttcaaaaatcagtctaacaagctgcatcacaaaaggtttccacctggagtttgcaaaaggctttcagagctagattctcttaggcttgcattgagaaaagggcttaactgcttctcagaggcaaagctacagttgtggagcaagggaaggcctacctgacccaagactcagtagttctgtaatttattaagaacgtgatctgttaaacaccggagactccgccaaggagcaccagcatggtgggagcaggggcacacagcccagatggcagaaggccactccacaccacgggcatttacccagcactttctacgcaccagccactccctagctgcgggaccccaagctaggtaccccgctcctctgccgatcggtccccgttctcagacaggtggcccagaatcaccaccctggccaatttgcagggctgctgcgaggctctaatgagacagcaaatcaccacatacatgccaagaattgctactcgcttcaactgggcttaacctcatgatatgcaatgacagcctcaagagccgagcacacgcggggcacatagtaggtggtccacaaacgtgggtgccctttcttcatgaaagggaaggggacgaaggaagaaaaacactccggtccaaaagtaccctcaagcccttaccccacagcgtggatgccccgatttcccaggtccctccgcaaccctcagtagaactcccaccgcgccctgggctgctgggggcctccccagccgggtcacagtgcacctgaacgccccggtccgtgccacctcgcccgcaccggccaccgcttccctggaacgcggccggcggccg

SEQ ID NO: 171857 - DNA, 310 bp, Homo sapiens
tgctgcaatcccagtctcaggtgggattttcccacctctgcctcccaaggagctgggaccacaggtgtgtaccaccccacctgtctaatttttgtagagatgggtttggaccatgttgcccaggctggtctctaattcttgggctcacctagacctccgaaagtgctgggattacagatgtgagccaccgtacctggccttcactttggattttatcaggaaggaatattgtacatggtgaacattttgtagaaaaataccaaagtagatttatatttattgagtgcttactctgggtaagggactgttt

SEQ ID NO: 171858 - DNA, 715 bp, Homo sapiens
cctccctggcactcaactgacagacaacaggatttctcgtggcgtccagggctgcatgtcctcttgggttacctcgacctgatcagctggctccactgtgtgtttccagtgtgaggtgtgaggtcaccatccgctgccattacacaaagacccatttcccctgggccattgctcaagtatgacagagctgattgtcctgtatggaaactcagccactcacagctctgcccagtgagacaggcaatgactatctgatcatggttgctgacacagtgcttgtggtggggagtgtccctatctggaggcaaacagccgagtggctgctgtgccctcaacaagccccaccctgcttcacggtgaggaaacagcccccacccaaccagtcctctccccagcctccagttgagtcaggtgcccccctccaagtgtttatgtaatttgtgctgatcttaccagggtcaaagcacttaccacattactttgtctaactattattctttcatgacacaaaacatatttattgttgaaaatgtttaaatgtagtaggtaacatctattatcccactacctggaaataatagctgttgacagattggcataactccaagaaatttttttaaatctggaaaacatcgcttttaaaactcattattattcagtgatctgtgtcaataaatggcattgaaacagctagatagacactttcctccttcag

SEQ ID NO: 171859 - DNA, 427 bp, Homo sapiens
ccacacggcggcctttccctggggaggtttttcttgaagatgcttctattaatcattataactccagcatttgtgcagagcaaatgctgtacctgacgccaactggagccctgctgggggctctgccagagctacgggatggcctcaagggagctgaggcttgcaggcaggtgcagcttccggtacattattaggattaaataaaaacaaggaaggccgggctcggtggctcacacctgtaatcccagcacttcgggatgccgaggtgggcagatcacgaggtcaggagtttgagaccagcctggccaacatggtgaaaccccatctctactaaaaatacaaaaattagccaggcacctgtagtcccagctactcgggaggctgaggcaggagaatggcgtgaacccgtgaggcggagcttgcagtg

SEQ ID NO: 171860 - DNA, 327 bp, Homo sapiens
actctcccgtggacttgctgcctgtccaggctctgcacccccatcctgcctgggtcacgcagccctctcgcccagggctgataccctggacccgcatgggtttgcgttcaggctgaagatggcctgatccttgctgaatggggaatggtattctgcacattttcccatgtatgtgctctgagtttaagactgggggctggggagatcctctctccacactgggtaggacatggtcatcctgtcatctgtcactgctggatgacatcctccccgtagatgaactcagggagaagggagtcttccacacgtgcttggagagaggatctc

SEQ ID NO: 171861 - DNA, 143 bp, Homo sapiens
ttaaaacatcaccacatgttataacattatgctttaacaaaaagaacgatgaagtcctacattatcctgacacatctgacagaagctgcagtttgatatgaatcatcccaccaacacaaaagtagcatgataaacaaaaatta

SEQ ID NO: 171862 - DNA, 443 bp, Homo sapiens
gaagtgttcttagagatttgaggacaaaggagaaggtataaagtcattatctatggaagtgagggattggactagggtgcaggccagtaaaacatggcttgtgaaccaaattctgcctgccctgtgtttttggaaacacacaaagttttgttgtaacccaagcatgctcatttatctgttgtctatggctgctttcctactggaatagctgagttgaatagttacaacagaaaccatatggcttgcaaagcatacagtatttactctctggccctttacataaaaagtttgctgacctccagactagggaaatctagtataatttccaggcagccttaaaaactctttagaagttaatggtccagaataatgacaaatagctgattgttgaatttcactatcttcattgcccctgttagagagttttgagctggaaagaccga

SEQ ID NO: 171863 - DNA, 380 bp, Homo sapiens
ctggggggtttgggaagatccagacagatcagttgtggaggaagtaattccgagatgcccattagagaagtcaagtggcccaaatatcaatattattgttgttgttattttaacttacatatcttttggcactattttctaaagatcattttatctaaaaatattctaatatcatatttattgtcaacaggaaatatttgttaaagcactgctttataaattgctgaagttaaaaagagatgtatggtcactagtcttggaaacttgaaagacaaaatacaaaggaatcaggcaaatagcaaaataagaaagcatatatacaatggcaaatgaggaatggtagaatatggaggaaacagtgtgtgtgggcataggaggtg

SEQ ID NO: 171864 - DNA, 242 bp, Homo sapiens
ggatgctttttttggcttctgaacacaagtaaccaactcatctttcaggtctcagctgaatttttttttcccaggaacttcctctgtaacctccccgcctccaaaccttgtatttgggttagacagccctcttactgccagttactgaatctcactaaacttcaagatccatgagacaaagatatgtcttgttcagtatgattcccagcacacaaataaacagtgttgaataaatttgtcta

SEQ ID NO: 171865 - DNA, 155 bp, Homo sapiens
  misc_feature (17)..(17): n is a, c, g, or t
atctgaggatccccaancaacatgaagcacatggatcaatattgagaagaataacagaaatattagagtacaaacattctaataatttcctcttcctatatctgacaagatttttttttttttttttttgagatggagtttcattcttgttgcca

SEQ ID NO: 171866 - DNA, 309 bp, Homo sapiens
ccataataaattcgcttgagttttacatattttcctgaaaggaagatgaagatttcatcttgtaaccaccatgctgaaaattgtacatgactcatgtactggcttacctttgctgtgtcaaatggtgatgagatgtcatggggataggatattatgatcattggaatactttcattatccaagaaattggtgacttggcagggaaaaggatggagtttgtaaaaacatttgaaatttatttcaaatgaaaatgcgtttctttgtgtgaaagttggaaaggttatgaagcaagttgaaaactgcggcacc

SEQ ID NO: 171867 - DNA, 472 bp, Homo sapiens
gtgctcagtagctatatatgaccagtgactacagggttcctctccagtatcagaaagcagggcaaagcaggagagacttggagctgagagatgataaattgataactggcacaggattatagtaattatgtggccacatatggagcattacatataattaaaagccatgttctaaaaagttacgaaaattttaggaaaaggcttatgtgaagttcaaacagaaaccacctatgtattgaaaaagaaaggaaatacactgaaatcttagcaatggttatctttgggaattagtattgggctgttttggtttcttcttcctacatttatgtattttcaaagttggtttaatgagcacacacagtttatccacataaagtttatgctcttgtagcacagaggtatcctttgtaactctaagcagtggagcttattagaagtctaggcccctaagcttcaatttggtcgcaatttg

SEQ ID NO: 171868 - DNA, 189 bp, Homo sapiens
tcgtatgaggttcgataaccatgcacactactataaccaccctaaccctgacttccctaattccccccatccttaccaccctcgttaaccctaacgaaaaaaactctacctctctatactaatctccctacaaatctccttaattatgacattcacagccatagaactaatcatattttatatcttctt

SEQ ID NO: 171869 - DNA, 258 bp, Homo sapiens
atgtgtgaggtgctctagaggaccccttgtgtccactattactaatagattttcaaagtagtccatgatttaaaaactattaagagctgctgctctgatcagcaataaatgaaaaaatttaactgataatacaagaacaaattaagtaccaactaacacaatcagtcagtcaagacagcgccactgaacttccagcctgggtgacagagcaagactctgtctcaaaaaaaaaaaaaaaaaagaaaaagaaaaagaaag

SEQ ID NO: 171870 - DNA, 387 bp, Homo sapiens
aaactgagtagtcaggagatttgatagaattaaaagcataatttcatgtaattctatttattaatagtgttataaccagtggtagttccaaggctgtcagtacgattttgagatgacttgatttgaaattgtcatgtaacaaaacagtactacatttaaagtgtcttattggaaagtgaaacctccaatttttgtactgtctttcttggtttgttttcaagaacttacttcccttaatgcttttttggaatagatcatttgggaaatatttgtgatgtctgtaccatatgtttttaaaatgttgtcgttgttacacattctagaatgtgtcaccacgccgcttattagggccttcaaagttgcccccttgacttcctctaccaaagc

SEQ ID NO: 171871 - DNA, 541 bp, Homo sapiens
ggaatttgtaggtctaagtgtaaggtagtgttagcacaaagttagtcttcagttttctaactgtattttaatgttaaattttgggctttgatcatttcattttgtttttgtccctacttgaaaaatgtttagcttattaacctaggggaatgggggaatatagtattttgtattctgccctatcacataaccagctgagccagttagctcagactttcctaaatgattcaccttttggaaaaagccagtcatggaaagtttctgcccaattaaagactttcaggaagttctgagcaagtgaaaataaagttaaaatggaatttctgttgagaacacttgaattaactattactaataataggccttttcctgtcagagttccctcttgtgcgttagaggtggtctataatttaactgttctcctgcttgaagatattttgatacttgaatcccttattgcttgttaaaagtggagttgttctaggcatactgtcaatgaagagtaatctgtaatattacttggtgtcaattactaaagttc

SEQ ID NO: 171872 - DNA, 425 bp, Homo sapiens
cgagaagctgggttcctgctccacctcggtgatcaccaggcccatatgcacaggcagcttctccaaggaacgaccgtccgcgcgccagcgcatccggtggtgtgcggctgccaggcacgaccccccgcgcgggtgccggtggtgacggcggttcctgccgactgccgggggcttgcggagcgtgaagccgagcggcgctaggaccgcggcagaggcggctcggcagcagcgccgccagatccagttccaggtgccgaaccgaacgcggagccaggaggtgagcgtgcggtgcagacagagcagcgcgtgcagcacccgccacaccagctcgtacagccccgtcatactcttgtggccctcggacaacccctctccctcccgcccactcccgcagcgcgacggctttttatccgcccctgcggccg

SEQ ID NO: 171873 - DNA, 694 bp, Homo sapiens
ctcactgaaaaaaactgacatttaattaaacacttggaggatgtgaggttgttaaccaagccagcatctgaggataagagcatccaacgcaaaagcagccagtgcaaaagccctgagcaggaaacgtgcctggtgttttcaagaaacaaggaggccactgtgggtggagcagtgtaaattagagaggagctaatggggtcagagtatgtatggccttgtagaccatctgatggcctttttcttttaccttgagtaaaggaggaagtcattacaaagttttgggtggaagaatgacatgatctgacttatgctttaaaaagatcattctggctgctataaataagctacatagaattataaactgtagagaattaagggatatcttttaggggactattgcagtaatccaggagaaagtagtgtcttattccaaggtagagcattggaggtggtgacaagtggctggattctggaaatacatgtgctccttgacttaaaatagggttatgtcctgataaacccatcgtatgttgaaagtatcataagttgaaaatgcatataatacacctaccaaacaccatagcttagcctagcctatcttaaacatgctcagacaacttatccgacagttgggtaaaatcatctaacacaaagcctattttataataaagtgttgaatatttcatgtaactta

SEQ ID NO: 171874 - DNA, 379 bp, Homo sapiens
ggttcatgtgcaggtgcaacctgccccgcagtcacgggacacagccacatggagccgagccacgctctcagagaaggagccagggaagaaacaccctaactgcactcctcccttcttctggcccccagcagccataggccctgggcccccggtgagatacccatagagatcagctcccaggcagcaggatggagggtgtagactggacatgaagaggcagctggaatgtatcgggcactcagctccagctcaccacgatccaggcactcaagttcccaagacaatagtttctgctctcagataaatggaataattaaggatcaaaaggttatcaacaggtaaccaagcataaacagattttttttttttttttttttag

SEQ ID NO: 171875 - DNA, 485 bp, Homo sapiens
gtttttgagaagggtgggtggtgatgaagaaaggctgaagtgttgccttgtaaaatggagacatattctcgggaagctaatattctaataaagcagaaaaaaagagcagcaatctaaaggtcccatccttgccttgttaggaaagctatccccatatcagctaagaacacaccaggcaaccagtttccactcaatgcaatctgaaaatcagcattatgttgatcttggtacttctgcccaatagagtagtttggttagctactggttccttttcctaacagaaactattagtgaacccaatggtactaattgagtctagtaaagtgctgagcattatcagccattagctgaagttctaccctaaatacaatccaaatacaatggcagggtgacctgctggctggtagcagtagcaacagcaatgaaggaagcaagggcttatggtagacctcctttgtggccagtgttgtagctctactctccgc

SEQ ID NO: 171876 - DNA, 344 bp, Homo sapiens
aatgggttaagaggaagggattacgtataaaattcctttaaggtatgaaaagctttgttgacagagtgttacatatttcattcccagtcaacaatcttttattgtcaatgtctgaccatgttgatatatttgttttgtttttctcctcctttgtaactgtattataaattttttatattaaacaaatatagaacttaaaatttagtttcttagtagtagtcctgaataattaacatcagttgaaattggattgtttgtgctcagtgccttggatatgtacaaaacctgtttgcttcaaattagtgagttagaaaatattttaatcttttcatcctgctcccctc

SEQ ID NO: 171877 - DNA, 516 bp, Homo sapiens
atgttatcttcacaccttgtagtgataatgtcacagatttttaggatttttgtcaaacttgtagtgtttcaaatttgtaataactaatgtcatatactatttgaattggtgacattatttctggaagctatgcatattagtttactagggttgccatagcaaaatagcacaggttgggtgacttgaacaacaaatttattttctcagttctgaaagctagatgctcaagatcaaggtgttaggagagttgcttttttctgaggtctctccttggcttctaaacggctatcttctccctgtgccttcacatgctctttcctctgtgtgcacatacacacctgtgtccaaatttcctctcataaggacaccagtgacactgtattagaatccaccctatagacctcattattttatttcgagatggggtctcgctctgtcactcagactggagaacagtggtgcgatcacgtttcactgaagcctcagtctcctgggctcaagcaatcctcccacctc

SEQ ID NO: 171878 - DNA, 599 bp, Homo sapiens
gtggccgattggcggagcgcactcctgctgtttctcccaccatctcgtggatgtcgtccctcgggtggtgagagaactttgcagtgggctggagcgccctttgcggagaagcacacgaaggtgaaggaaggaaagaaagaagaccggagtgaatgaatggatgctctgtgaatgaatgttggtcctggtgatgcgggcctggtcctggcctgtgcatgtggcatgagtgcagccctgaggctgctgggctgcccttgatgctcccctgtgggctcgatggaacatttgtggcaacttgctgtgtgaacttgctctcggtggagtagccccgtcgggcccggaggtttgtgcaaccgcggagaacaccgagtgctggtcgcacggggcgtgccgagccgccttccggcgcgccctccgcactttccccgcctagtcatccctcgctccccggccaggagcctccgccgcgtcctcaacctctctcccttttgcgtcccgggaccctgcgagcacccgggccgagggcgcagccgagtcttgcgggagtcgccccgaaagcgtcgggtttgtgtggggttagcgggggccgccgcgccacc

SEQ ID NO: 171879 - DNA, 584 bp, Homo sapiens
ttccctccttacttagcctaaattccaggccaaatcacagaatccttcccctgcaaccatcctcagcatcatggttctacttttccttcaatgtactcaggaaaaccacaaccctgaagaaatccaattctctgtttactccacccttgcaactgttgagctgaatatggctgaagaaaacacataacctgattgcttctcagcaaccatactacatttccctagttcagtggttctcaattttttcaatatagacattaatcattccagcaccaattctagaaaaggttacccttttcctcacttaactgccttggcatctttgtcaaaaatctactgaccaaatatatgtgagcctaattctggactctctgttcggttccactagtctatctacacacaaataccacactatcttgactactgtagctttatggtaagccatcaaataagtttgtagtacaagttctccatcattactgttagttttcatttttcattactccaggtcctcttcactgccatatgctttacaatctacttatcaatttctacaaaaaatttaaaaaactgggtgtgttatg

SEQ ID NO: 171880 - DNA, 442 bp, Homo sapiens
atccaagcccctaccatctcatacctggactttgacagtggcttcctaattgatctatttgcttctagcacaattccccttttggtccatttttaacacaacagccaaaagtgattcttttaaaccttaagtcaggtcaggattatagcactgaacaactctacactgacttctgtgtgaacagggcccccatgaaatggtacaatgtgacagccttacagatcatatcactcttttgttcaaacccgtcccatatcttccaatctcactcagagtaaaagccaaaacataaaggccttatttgacctaggtgccttgttacctctccgaccacatttcccattactgacactctcactcactccactccaactatcctggcctctctgctgctctcaaatataccagacaagctccttcattgtgtgcattcactagcaac

SEQ ID NO: 171881 - DNA, 238 bp, Homo sapiens
tggaccacccgctccccccattgccctgtgctgcactgagcacctgaagacagcagaagattccttggcacagttaagccaggccaaccctcagtcctgggtcacagtggagactgggacatggccctctcctccaaagctcaggggccgatgggatgcagacggaatataggctttgaatgtaggcaggatgaggaccaccgtgatagaggagggaccaggtgctccgggagcacag

SEQ ID NO: 171882 - DNA, 456 bp, Homo sapiens
caatgttcttccccagctttccccacagttgctgcttctcctcctcaggtgtcagctcatatggtgtttcctcataaacaggcctttcttgcctgccctacctacgggcccttctcatctcacgtcatcgtggaacttccttcaaggcacttgcaccaccggtgatgactggtgagttgtttactctgtttctctgtgagggcaggaacttgtcttattcactgctgcatgcctggcaaacagcacaggcctggcaaacagcacaggcctggcacgtagtaggtacacaccattaagtatgtactgaatgactggagctggaactatcctgagcctgtaagtccaaaatgctgtcccaaagtaaaactcacgcccagtctctggctgcaaccctgactataagcaatttggactgctggtccttatgcatcatgcagaaatgctttgctgctcctc

SEQ ID NO: 171883 - DNA, 505 bp, Homo sapiens
aggttttagttgtttcttctttcttcttcaagattctgctgggacccagacctgggtttggagaaggaaaaacccttccaggtggaaagcagttgccagtgaaccaaggactgctgtggaaagtgattaagtccaggaaggagggaggtttgaacaaagagatgtctggaggttaggagggaacactttctaggagagatgaaatttaagctatgccttgtagctgaagaagtttggtaaattgttggtttccagcatatgcttttttgtatctcaaggtaaaaagctgggctagggagggtggatgcctttgcgtggtaaacaccgacgttgctaagtaattatctttgaatagaggagaaataaaacttaaggaagaggctgttgactaagcagggaaggtagaagagaatcaatttcattgaatatcttcaaaatgttgtgaatgtgttttgagttgtttttcctccactagctctgcactgctacttttctttaggcaaaa

SEQ ID NO: 171884 - DNA, 789 bp, Homo sapiens
aacatttttaaatgtttaaagttggataggtgacataattgagtatttgaggagagtagtgaaggtttggaatagataccaaaggaaacaggagagatcacaccaaaacttaaagggaataccaactggtgctaagggcagctgaggttggaaatcatacaatcatagtggcaccaaatggagaggtcaaggaaataaaattctaaataaaaagagctggaagtataagagattgtgagtgaagaataagacgttgacgtctgagattttcacataatgacaatgtgtaatttgtggccatcagtgttggtcaggagaatcaaggtaaaattattggttttgaacgtgtgaagctccagaagtatgagtcacccatttggacactaagatacacaatatgacaaccagagttaaggtaaaaggaaaactatgtgaaattattccataagtataaaggagaaacccaagatacgggagaggtcagtgtcatgaaggagtgaagggtagtataagccttaatactaagataccaaagactaaattccagtgatatcagtgactccagcacttactaatttatccatgggatgtaatatgcagacatttttccaaaaaatacatttgaactagtataagctacatattatattttccctatcttaccaatacaaccaaagatatttatggattaaactatctacttttgcttcctcacagcccgcagcatttgccataccatgtattatcagttgataccataagccattaggagtagatgaagaggcacta

SEQ ID NO: 171885 - DNA, 648 bp, Homo sapiens
atagcacttgagggctcaaaggatctaaattggggagtcaggtggctgggtggaaaagatgaaaatacaacaaacagttttatatgttaaatcatgttaagctgaattcagtgtctaaactgggttttttattatagctccaaatttctataacataacgaaatacaatttagatactaattaggccaacttaccctataattctttaatgattcagtagggaatgtttgaatatggggcaggataatgggtaaagctgttatcctatggaacactcagaagaaaaagcccattagtatcttggtggggataatggaattgactgttggtgatttcaggaagtctttgtttgagatctgtgagaaaaattttgtcacattttcatcttcttcaagatcttactatccctgaaaattacttaatcacaaaaaatatgtgtttagtataataatagtataaaatgacattatgaaaagtatattagtggccgggtgtgtggttgcttacgcctgtaatcctagcactttgagaggccgaggcaggcagattaactgagggcaggagttcaagaccagcctggccaacatggtgaaaccctgtctcttctaaaaatacacaagtagccgggtgcagtggcgcgcgcctgta

SEQ ID NO: 171886 - DNA, 490 bp, Homo sapiens
ctctaccagccaaagagccgcctgcacttgtgtactggggcacacgaggccacagtgggaaacatatttgcaaagctgcaccttcactcttaatagaagtctgacacctccaagtcacagtcacacaggctctgtgtcctcaaagccctaggtcacagaggactcttcccagagtctttgagcagcagggcctgcacatccacaacaggttctcatccaaaagctcaaatgacatattttctgaattaaaatccacatgtctggaagcatttgtaaggctatgctctccacagcgatctacgcttacaaataattgtggttgtcataaatcattggaatcagcctttgaggcacttgaaaatctgacagcaccattattgtggcttttcaaagtcaggaaaatgtgtagatgggagaggggtctcatatgcaggggattcccaaagattgatattctattaataaaatgacttctccattctgtctcata

SEQ ID NO: 171887 - DNA, 560 bp, Homo sapiens
ccgagttttccatgaaaattctatcctattatcatagtttgtaaaagctgtggacaagtgtgatggaatgaatcctattagcttgtgtaattataaagtgatagaagacatgagccagtgtcactcttattccaatccagaaacactgagattagttgactcttcattcatcttctctgtccaatctgtcactaggtccatgtgtcattgtttttcctccaaaatattccttcatcctgagctctttgtcacctaggacctggactactacagtaaccttgctccttgacttcagattttatctctgctaaatcaactggaatgtccccactatgtaccaaatgaattcccactttagttaataaatctagattgccttatttccctttgatacaactaatttcagaattcaactcaaatattatctggttgtcttttttttttttgaggcagggtcttgctctgtcatccaggagtgcatgagccaagatcacaccactgcactccagcctgggcgacagagtgggattccatctaaaaaataaataaatacataaata

SEQ ID NO: 171888 - DNA, 327 bp, Homo sapiens
aacaagcctcaaagagatgcatcagccacagctgtcctggcaagaggcctcacctccccctgctggaaggatatggacctgaggctgccgggaccaaccaccacacataagctgagagtgaagccaacacagtggaatctggagccaaagatggtgagaaatggagtcttaatgatattctttgtgtctctgatcaagctgtacctaaagcctggacttttcaggggcatgagacaaaaaccttccttttttggctaagctgctttgagttggccttgctgtctcgtgaaaatgaaaaggttcaagactgatacaatctcttctcag

SEQ ID NO: 171889 - DNA, 105 bp, Homo sapiens
aagctgcaggccccttgcagtgtggccgaagcttacctttctaacctcatccactacacctgagcacttgctcctccttgaatagagtgcacagggtagttgtca

SEQ ID NO: 171890 - DNA, 1406 bp, Homo sapiens
ccctgcgccccacatctcccaactgctgaaggccctcacccatcaatgggccgagtgattgctggacgcgtggtgctgagttaacgccacagcagtagctttttgcccccgtggactagttttatacctgcccttccccatccatcatttgaatgatgtcatttgttagttgtgccaggtttacatgaagagcaagtgagcctatgttttctgttcagcctatgggatcctgcttattgctttggggacaccacattagaaaagagttacaagggctgggcgcggtggctcacacctgtaatcccagcactttggggaggccgaggcggacagatcacgaggtcaggagatcgagaccatcctggctaacacagtgaaaccccgcctctactaaaaatacaaaaaaaattagctgggcgtgctggcgggcgcctgtcgtcccagctactcaggaggctgaggcaggagaatggcatgaacctgggaggcggagcttgcagtgaggcaatattgcgccactgcactccagcctgggcgacagagcgagactccgtctcaaaaaaaaaaaggagttacaaagtagaggttatcagtggctgatatcaggctggccttgtttggatggggaaaaggaactccagaactgaaagacagagggactggactgcctcttgagtgtggaaggtggatcagagccaagcagggagctggggaaccagcgctgggagtggcttgcctggtggcgcagacccagctcactcaagatggatctcatactggggaagccaggagattcagctctgctccgaaggcccttcctgtctgcacgtgggtatcactgcatgaagaggagtagagacccgattgggcagaagccattccttgttctattttggaagctttttggctgaagccagtgtttcatacgaggaaatgaaagttggctgatgtaattcagtttaaaataggtgtcacctttggggacctaacccagattgtaattttcttttgcatgctgggtattcagaactcagcaaagaatgtgttgtcaggattgcaactgaggttggggggtaagggtggagactggctcattgttggcaaaagcttctgttagattgataaactctttccaggtaacagttgggacctcattgatcccgatagatcttagaagttctagcacatcttaatttccttaatagtttaattgatgaagagcattgatgaagagttaggaggtctccctgttgtacctacattttccgcttttttagaatgagaagatgagaacgacctccagttcacatgtacgggtgctgtgaggatccagtaggggagatacagtgctcagcaccaagcaggtgcaagtgagcacaatccaattttacatcaagttacccctc

SEQ ID NO: 171891 - DNA, 187 bp, Homo sapiens
ttttggataatattgtatttcatttgaataaggatgcatcttaaaatctactggtatacctctttttccaaaattgaagtgaaagtagtaatacaatatggagctttggaatttattctgaaggatactgtagcttatgagtggtcatggagctgattaaataaatgttgtttaagcaattactccc

SEQ ID NO: 171892 - DNA, 145 bp, Homo sapiens
acatggagagagtaatgagaaatttgacgcttttccctctttctctgtttcctggtttagagctgctgcatcccacagtgaattactagctacaaagagaagggactgctctgggactgacaattgagaacatttacaattagct

SEQ ID NO: 171893 - DNA, 235 bp, Homo sapiens
tagattgtctcctttcctttcccttcatctcttaattagtttcagttggttatattacattgccaacaagaccaatgccacagggtccctcaaatgacatttcccatccttagccatttatcccataggggatacatttccatcaccagaagaggctttttgttttgtttttttaaacacaaagtgggaagagaaggaaggaggaaaatgacagtgatgaagatgaaagttaatc

SEQ ID NO: 171894 - DNA, 429 bp, Homo sapiens
ctagaaagtcctcatatatttgaatttctagtgtttcccttttgccaccaaaatacatatactccttctcacccccattccccaaataaaagcagcctcaaatttacctatcagagtccaggtataccttaaagactgaggaagcctagctaattctctccacatgctgacaaagtttctactgcttgaagctcaggtgagtccccaggaaccccagttttttgaaactgtacacggaatagcagaatgacacttctcccaacacccattctgtgcggtctttgaaaaatataaatccagggtcaagtaactaaaaaaacacagaagacaaatagctaagtaatagcactttataaactactcagaactcctgaataaactgttgtaaaatcctaaagttgttagctataaagcagcaacttaacaaca

SEQ ID NO: 171895 - DNA, 465 bp, Homo sapiens
cagaataccgcatagtacagtgatatatttaagtttaatatctgaatttctccagataagattttgttttaatatttaccccctctcaaaagtttatttatttgagacggggtcttgctgtgctgcccctgggctcgagtagtcttcctgccttggcctcccaggtagctgggattacaggcataagctaagtattttaaaccttaaaaatacatgtatacctaataagatgttatttaacgtatatgtattatttaggaatgactttttgtttctaatctttagcagtatttatccttcctgatagttccccaggtatagaggttattgtatgtatttttttaaggctgggtacagcggctcacacctgtaatctcagcactttgggaagccgaggccagtggatcacctgagctcatgagttcgagaccagcctgggaatatggcgaaaccccatctctatta

SEQ ID NO: 171896 - DNA, 628 bp, Homo sapiens
  misc_feature (559)..(560): n is a, c, g, or t
  misc_feature (563)..(564): n is a, c, g, or t
  misc_feature (568)..(569): n is a, c, g, or t
  misc_feature (571)..(572): n is a, c, g, or t
caacaacggattggcgacatttcaaaccataagaaaattttacaaaaacacatttagacatggagacacattttctaaatatgaatcactgtgaggaaagcagtttaaaaataataatagcttctataatttatgagtgttaaccatggtttatgtactacggcaagaacgttgaggaaatcatgcaatcatgcaatttgtaaatacattcttgtaaaaaacaaaaaacaaaactcatgtggtggagaagcagactgagtaaaatgtccaagttactccttcacaccactcgcaaaaccattcctgtcacttttttttttaagagacagggacagtgtctcactctgttgcccaggctgggcaagagtgaaactccgtctccaaaaaaaaacaccaaccaaaacacttaaaatgcaatcctttatcaagttaaagtggggcaagtcctccttgggttgtttgaagctgcagcccttctcctcatccaaacctggtcatgatgagcagcattaggatgggacttcggcatagggaatcccaaggtcatggtaagggtttnngtnnagtnntnngggaatcagacagaggcagagttgaatcccagctctactgtttccagctttctgac

SEQ ID NO: 171897 - DNA, 629 bp, Homo sapiens
aggttcaatcttccttcccccagtctccatccaatataatacactcatccctcagtatccttgggagattggttccagacctttggtgtataccaaaatccatggttgcttaagtccctgaaacaaaatggtatagagactgggcacagtggctcatgcccaaaaccccagtgtttagggaggccaaggcgggagaatcgcctgaggctaggagtttaagttctgcctggtaagacccaataattaagactccatgtctataaatttttttttttaattagcctgacatggtggtgtgcacctgtagtcctagctactaaggaggctggggcaggaggatcacttgagcctaggaggcagagcttgtggtgagctgagatcgcgtgcaccactgcactctagcctgggcgatagtgtgaggctctgtctcgaaaaaaaaaaaggaaaaaaaaacttacagtacggaatatatagctccctgtactgaattcccacagtgactagccagttattaaaaaatcattggctgaaataatccatcttttctccactgacttgacgcactttttaatcataatttccacattgtggatgtgtcttttccttgatactaaagctaacagatgaca

SEQ ID NO: 171898 - DNA, 169 bp, Homo sapiens
tgtatagcagaagtagcagaggggccacaaaagcaagcactgcctacttttaagtgtctctgcaaaccagggcatatgaggcctcatttgcagaaaaaaaaagagtgaggtctaagttggggaaattcaaggtcaaagccaggtttggaccgaattatttgctactact

SEQ ID NO: 171899 - DNA, 197 bp, Homo sapiens
atatatatcaaaaattactttaaatgtaaatgaactaaacaattcaattaaaagacaaagattgtcagatttttgtttatttcctgatttggatggtgtctacatggatacgttcattttgtgaatatttatacagctgttcttttttttttttttttttttttagatagagtctcgctctattgccagactggagt

SEQ ID NO: 171900 - DNA, 135 bp, Homo sapiens
tatttaaagtaccaaagctcttggtattctcctattggtcttctcaaccagttcttatctttccagtcacactctttctccatctccaggtagaataaataactttgttattgtgttgatttaattctgtcttat

SEQ ID NO: 171901 - DNA, 621 bp, Homo sapiens
aagacaaacaggagcagttttcaaggagcccttcccttatctctaaggtctgggcctggaattcagcttggcccatttactatgccagctctgtgcagggtgcagagatccaagataaatcagacagggtctctgctgtcagtgtgctcaaggaaagaggcttttaggggaaacaaatctaaacgactgccagctggaacttcaactctgtaaagcagcaccctgccacatctgcctgctggaacattttcatctgctgggctcacgtagctgtgcaacagctggggctggggtcacattctgggctgatctgatgattattttggctagagtgagctcatcctttttgttttcaggagctgttcaagggtggtctgatggtttggatcaagactagctgtatcccggagaagaatacgttgacttttctggggtggggtctggggcagaaagcaagaaggctgccttacttcaaggaaggctctccttccaccttctgccctctgagtgccttgtatgcgcaagtgacactagacaaagtgcttaacacttattacctgacttgaatctcccaatggccctgtaaagcaggtactccattatcatcaccacccttcttta

SEQ ID NO: 171902 - DNA, 251 bp, Homo sapiens
agactattccgtgaggagcttttgcttactcttcctgttcttagccctgtgtctcattcttgcctccccttacactggataactagaaacttttatgggtttactaggacagatggcttcctcctcatcagtagcctcttcctcacattattacaggtcaaagctttcctctgccctatcttgtcaagtactacacttccatctgcattctgtctctagcaatttgctaaactttctcatctactgattaa

SEQ ID NO: 171903 - DNA, 321 bp, Homo sapiens
tcctatccttacagacacaaggacacaggtgggaatggcttttcatatgcaaattccatgccatttgcttcctattccagccaaacagttgtgcagaagataaaacgaatcagggagtgctccagggagtgctcccggctctcaggagtactgtagggagtggagacaggaaggaagccatgacagggaaggtgacaatattggcccggtgctctagatgcagttctgcaggcgctcactgaagagactgctggagaaggcaggaggatgtgctcgcggtttcctgtgatgtggtgagggcaggtggagcttcagcaccca

SEQ ID NO: 171904 - DNA, 257 bp, Homo sapiens
actttctgaacttgtttccttccctctaaaatgcgtttaatattctaccatgaaaaaatcactgtgagagaaatagttcatggagatcagttaccttaatgacaagtgtatatggaattatgagtagaagtataaaatcttgctttgtaggacaatctgcaaccattattatttgtcagcttttaaaatgcaattttcctgtattatttccatggatgatttgaaataggtgatttttgttagattattgttagata

SEQ ID NO: 171905 - DNA, 1414 bp, Homo sapiens
  misc_feature (2)..(2): n is a, c, g, or t
  misc_feature (850)..(850): n is a, c, g, or t
  misc_feature (1367)..(1367): n is a, c, g, or t
  misc_feature (1413)..(1413): n is a, c, g, or t
gngggcgcacgctcttcctgggtcaagagccggctcggttctgggattctgaggctccccaccgcggtccggcttctctgggagactgtctacaaaccgacgagaggcgtcaaccttttaccctagggggcggatttgggtaggagccgagcgttcggtcggaaacgcccccttcttcctcctgggcggggcaagtgaggccaagtactgggcctccagggcgtcgtacctctgtgagacatggctcgctgtggggaaggcagtgcggcccccatggtacttctggggtccgctggagtttgcagtaaggggttgcaaaggaaggggccgtgtgagcggcgccggctgaaggcgacggtgtcggagcagctcagccaggatttgctcaggcttctaagggaagaattccatacagatgttaccttctctgtgggttgtactttgttcaaagcacacaaagcagtccttttagcaagagttcctgacttctattttcatactattggacagacatcaaatagtttaacaaatcaggagcctattgctgtggagaatgttgaagctttagaatttagaacgtttttacagattatatattcatcaaacagaaacataaaaaactatgaagaggaaattcttaggaaaaagataatggagattgggatatcacaaaagcaacttgacatcagttttccaaagtgtgaaaactcatctgattgttctcttcagaagcatgaaattccagaggatatcagtgacagagatgatgatttcatttccaatgataattatgacttggagcctgcatctgaattaggagaagatttattgaagctttatgtgaaacctngttgcccagatattgatatttttgttgatggaaaacgttttaaagctcacagggccattttgagtgccagatctagttattttgctgcaatgctgagtggctgttgggctgaaagctcccaagagtacgttactcttcaaggtataagccatgtagaactgaatgttatgatgcattttatatatggaggaactctggacattccagacaaaactaatgttggtcagatactcaatatggctgatatgtatggactagaaggattaaaagaagtagcaatctatattttaagaagagattactgtaatttctttcagaagcctgttcccagaacattgacgtctatactagaatgcctgattattgctcattcagttggagtggaaagtctttttgctgactgcatgaagtggattgtaaagcattttgcaaggttttggtctgagagaagctttgcaaatatacctcctgagattcagaaaagttgtcttaatatgttgattcagtccttagtaantataacctgaatactcttttgtgtgtttgccattaaaaagtttatnc

SEQ ID NO: 171906 - DNA, 750 bp, Homo sapiens
ggaaaacgttttaaagctcacagggccattttgagtgccagatctagttattttgctgcaatgctgagtggctgttgggctgaaagctcccaagagtacgttactcttcaaggtataagccatgtagaactgaatgttatgatgcattttatatatggaggaactctggacattccagacaaaactaatgttggtcagatactcaatatggctgatatgtatggactagaaggattaaaagaagtagcaatctatattttaagaagagattactgtaatttctttcagaagcctgttcccagaacattgacgtctatactagaatgcctgattattgctcattcagttggagtggaaagtctttttgctgactgcatgaagtggattgtaaagcattttgcaaggttttggtctgagagaagctttgcaaatatacctcctgagattcagaaaagttgtcttaatatgttgattcagtccttattgtgggtggctggagcctgtctgcagctaaggacccaaggttggaaccaaccctggacaggataccattccagcgcagggtgcactcacagcacagaacactcacttatactgggacattgtagagaagccagttcactaaatgtgcacatctttgggatgtgggaggaaactggagtgtccagagaaaacccatgcagacatggggaaaacatgcaaactctacacagacaatggcctggccaggaatccttttttcccttatca

SEQ ID NO: 171907 - DNA, 416 bp, Homo sapiens
aattgtggtaaacagttctaggacagcagaagattctaattgtcagcatggggttcatttctccttcagccaacatccaaaccactgcttaagtatacaagggaaggcttcaggatatcaatagcatcttaatgttcaaaattcacagtgataatcagtgactgcagaatcacttatatcttccttacacactagagttatctgaaattagtgttggtagttgataagaaataatgagaacactgtaaatgccttcactcaatccaatactgtgttaatcttttttaaatgttttattgaaatccaaaaaggatagagaggctgaaagaatttctgactcagcctgtagttcttcaagatcaattactgtcctcattacaagatacttacatttacagataggaaaggtattcccc

SEQ ID NO: 171908 - DNA, 307 bp, Homo sapiens
ctggagcaagtgacccagcccctcctacctttggcatgctcatctagacaactggcatagaaacacatttctgacagggctatggagactgtataatgtgctttgcagatgggaggtgcccagtaaatggtataaggggcttcaacccctacattcccactccaagatagagaaactaagcctcatagggataaaatcttcacttaaagccaaatatctattagtgatttttctactacaatcacactgtcctctcctaggatacagtgaaaacattcctgagtcacagcccaaagctcatagagca

SEQ ID NO: 171909 - DNA, 344 bp, Homo sapiens
ctatgatggtctgtggaagcgaactcacatatctccgaggtatgactgtacataactgtgaaaacctgaaattaaataaactgtattgtctacagatgccaaaacagtggcaaaaaaataaatagcccttacttatattttaccctgagtgtggttctgaatttgaagaatggttactcagaggcaaagagattggggaaaaaaagatcagtctaaatcttgatattatttctcctagacttaaccggtctccagggtccgcaataggggagactttgggttcatcatgggatctctaaagtaagtggcttaatgataatattgcgagctttattactatcatg

SEQ ID NO: 171910 - DNA, 479 bp, Homo sapiens
tcccaagagtctccaggctgaacaaataatcgactgcttctcaagttaccttttaaggcaccactgctcaagaacaagagaactttttgaacaggtgagccaaacatgaggctactgtctgcaatatcctggtctcctttattaggtatgcctatttagttccctctattgagaatattcccactcacctctacctctgctccaatctgaaagaagcccaaagtcagcagttacgcatatagtctccatgtactgcatctggatgtactgaatctccatgtactaatgcttgatgccccatcccagcatcggggtcatgatcctgctagctagtacttccatacccatgttctctcacactggttttaacagtcctgggctgcaatcaacatgtcccaggccccagtggccactgttcccaggagttgccatgcagcaggctccttaacccagttttttttctcactcctttgcatggg

SEQ ID NO: 171911 - DNA, 354 bp, Homo sapiens
actgctggcttctcaccattttatgtcgctgagttgttgggtggcctcaggcaagacccttcccttctctggcctgcagattcctcatttgtttgtcagcaggagggagctccttctatctctgctattaagttgaatttggttcctggaagctggtgagagagtatcgtaacacccagtttggttggcctgtgtctttcagatattaactgttacctgattagctggggtctcaagttcctatttcctgtgcttttactaaggaaattctcagacttatcaatgcaaatatggtatcaattttgttgctagaccaaatatgattttttaaaatagagatttcccactatgcta

SEQ ID NO: 171912 - DNA, 166 bp, Homo sapiens
ctggatacattcacttcccctctgccatctcctgccccacattttctaagccaccactagatacgttaaattgtataaattgtatacaaccactgtatcaagtataaagtatagatataatgaataatcctattttgcacagaaagaaaccagagtgtggagagag

SEQ ID NO: 171913 - DNA, 267 bp, Homo sapiens
caattcaaatataccgcatgtccagattcatgtgcagatttgatcttcagtgttactaagctgctttcagaatctctgctccagttatttccttgaattcgtgtgttctcacagattgcaactgagctttttgttaatttgctttatttactggcacatctaatatctgaatcagctttatcaggtattttactacccagatttcttcccacctgcacaattaatccctttcgtaagggattaattcatcaacattcaacaagccct

SEQ ID NO: 171914 - DNA, 150 bp, Homo sapiens
aaatcattcaccatgagcaaaggtcagcagacaaaataagcgagaggatcagtatccccaagaagttgagatcatccatcaaactaacaaagactataggaaaagttatgtttaagactatttacaaggaaataaggctgagcaaaagaa

SEQ ID NO: 171915 - DNA, 422 bp, Homo sapiens
ggaatcctcacagagctcctgctggctgtgagcactgcatggacttgcaaatgccactccacttctttaccttggtttcattttgcacttgaagataaagctcaaaggacagcatcctggaaaagcacatgtacccaggaggcagacaaccctggcttgagtcctgtccatgccctttcctagctgtgatattcagcacatcgcagggcctcctcaaatatatactgtctaacgtggcagctggtagccacaagccacgtgtatctattcaaataaaaataaaaatgaaatgaaattaaacattcagtgactgagtcacaccaggtttgagccaagtgctcagtagccacatggtgtccatggtattggaaaatacagacagagagcatttccatcaccacagagagttctattggaaagtg

SEQ ID NO: 171916 - DNA, 467 bp, Homo sapiens
tcattggtctgccctacccacttggtgcacagtcaaaaccaaattcactctccttttcttttaaaggaaacttaatggccacaagctaggagtcatgggaataattgcgtggcagcatctgtgagcagatcacacttaggatgctccacaagtcactcctctgaagtggtagaaatgttggccgggcgcggtggctcacgcctgtaatcccagcactctgggaggccaaggcaggtggatcatgaggtcaggagttcaagaccagcctggccaagatggtgaaaccccgtctctactaaaaatacaaaaaattagccaggcacggtggcaggagcctgtaatcccagctactcgggaggctgaggcaggagaattgcttgaactcggagggcgaaggttgcagtgagccgagatcgtgtcactgcattccagcctgggcaacagagtgagactctgtctcaaaaaaa

SEQ ID NO: 171917 - DNA, 205 bp, Homo sapiens
atctcttataggaacctatctttaaacctccagagttttcataagtattagcaagcacatttttaaatgccatatttcttcctcccattcctccccttcacactctttaacctaaatttcgtgttcaatggagtgaatctggaggcactgccttgacatttcactataagaactgaaagactgggagctgcgtctgctgtaggag

SEQ ID NO: 171918 - DNA, 176 bp, Homo sapiens
atgttgaatgcttgagaaagaggaggcaaatgtgaggccattagatgaaaagaataagtagcattcctaagaatagtttcttcccaagcccatctttttccatgactctttacatgttagtgttctccagtgttttggccccacttgtcttttcattgtttatgcaagtttgtttt

SEQ ID NO: 171919 - DNA, 431 bp, Homo sapiens
taacaactgtgtgaagcaactaagtcaaattttatcattcactcattgtacggatgcagaaatggaggcatggagatggaagataattgaccacgactataataagtaagtggcaaaactaagatcagaactcaaatctcttaactctggctttcatgcttctacatatggcatactgcctctccagagggacaatacggagatggtgatgaagtgattcctagtttgcaagattcaaaatatacacacttggtatattcatagcgtaagccaatattacactcctggagttgaatattttgtcgataagtttccaaatgttacaattccataaagaaatgtctatgttttacttttaaataagatattttttccacccattaatactctgttttgatggtatctcagagaacttacgtgtgggattttag

SEQ ID NO: 171920 - DNA, 375 bp, Homo sapiens
taggaatgtaacagcattaccaaaactagaagttagttttttggagtaacaaaagacgaacttcaagaaggttaagaaaaaaagaaaattaaaagataaagcacatactatcaactttatacaaatgaagaaaacatacaaaataaataaattccggagaaaatactcaaaccttaataaaaaagaaatcatataggatatggaatgtcccagtttctccaacaaatccatagcataagttggggggggggtggaatcctgattcaaacaagccaactataaacacacattttgaaatgagagtaagacatatttaggtacagactgagaaatgggtgatattaagaaatcattaactttattgactataacaat

SEQ ID NO: 171921 - DNA, 882 bp, Homo sapiens
agatgttacaatggccttgtgaccttgtaagtgagccatgtgcttgcaggtgggctgcgctaggctagttgcgaattagcattttcctgacggcccatgaagcaagctgtgtggttttcatttctagtgggtggaagaaaagatggcactccagggactaagtcctaggaaattctgccatctggcataatgttggaggcagtgtgtgccagggcaggaaatatgggttcttgggctggctctagattggccctgtaatctctaatgcctcagtttctctaactgtaaagtgggacagataatcccactgctaccttcttgtgaaggtaaagtatgcaaaggccctttgaaatgtcgagagcacggttctaaatgtggcttgcctgccaaaggaatttgccaggcctactgggaggcagcagtttgcttctgtgtcagtttctacagtctgtgctcagacaggtacttaagcatctcacatccataaatctcacctcctatctatagtcagcaaataagaaaaagggcaggctgatgctctgcttctgtctgatcttcttaccaatcctacccttgcctcccctccccctgacctgatgcgatgatcttgctgctctccctcatctgttctgggcctgtcagtttaatttaacaaggttctgggagaggtttgatttaatcaacccagttgctgtatccatcctgctcagaggtccctcagtgtcaccaccgaggctcagattagacagtgacaattacttcttctttcctggctattgcctcccccttccctttcactccctggagggaacaaggaggcagaccaatctcttgggacctaagaatagatgcgggaggatcaaaggagggaaacaggctctg

SEQ ID NO: 171922 - DNA, 678 bp, Homo sapiens
agcaatatactgagagtgacttgggtgattttctggggtgatcaaccacattccatgagcaggttaactgtggaagacacctgcccttgagcatcgcgtttgggccacatgcgtcaatggggaaatttgtgtttccattctgcttcttgttttgccttcacaacttcagggatagaagcgtattccatttttagttaataatcagctctctggggcttccatgtaatgagtcagaaactgatgactgactccactctgctcattatcatgtctcccaaaaacaacccgagaacccactgtgtcaagtgaagctttaatttttcaggggaggttttctccattgagaccaatacatcttttcttgtgacagatccagttaccatatttccttatttttaactgtcgaaaagacagttaagctgcaacagagtatggtgagtttaccaattttaatacttgaagcaccaaacaaaggatcagtgttgcaggctgtctcttcttgactttttccagctctccttagcagataaccaggatgatattttttctgctttacaacatgatgaatgctatatctctatattaactctgaaattgaattgcagccaaatattcctctcagctgcattagaattttctaaagaacatgagacacataaacttagtcttcttagttca

SEQ ID NO: 171923 - DNA, 581 bp, Homo sapiens
gtactcagtggtgcagctctccctggtggcaccattatgttggaaaagcaatgcctgatgcatggtaagtactaaacagaggtcagccacaaatattgcctgggcactatgcattactgaggatttctggtggaaagataactcattctagattacctcacaggccctggccagcctagaggtgactttcattgggtcaggcactattcccttatctaagaagctccagattctaaacacaataaaataggggaacctctcagaatcatgaaggcatatcaagcagtccgaggattcttagagtggggcagtgtgatccaaatagcctggcttggactctacagtaatgctgttactacacaggcagagtatttcagtcttcagataggctaaccttaaacagaagagggcgcatttcagctgaagatagggagtgaggtaaaccaggctggaagaatcatgagcgtaagtacagatatgcagtttcattttgattgcatggcataaatatatacatttaattcatgcttaatttggacaatcccaaatttctgctacaacaggttgattttcattctttt

SEQ ID NO: 171924 - DNA, 1353 bp, Homo sapiens
gagaacaagaggctacctccagttaaccaggacataaagtccccagcggttcctgtcacacctgctcctccctccccagggtgcatccatgatcgtggatgtttgcccaggggtgaccatgtttggctggcttggaatgctgtgcattctcagagctctgttagtgtcccctcttgggggtcagagatgaggtgtggcagggtctagaggaatgagtgtccaggcagagttcagaaggtaggaatgtccctcttgatagggctgaatcaagggattcctggctttagaaagggtctgctatctttgcaaaaatgtgcaagtatctgtagccagtgtaatgaaatcacttccaaatccagcctgttacctgacttttgtcattgttttcccaaaaatttgaggtatcattgaaacaggtcattttaaacaaatctattacggattctcagggttggaaataattcgatgattgcttagtcctcccccacccctagaacaccccagcacatctgaagatgagcgcctctccctgggtacctgcaagtgatcaccttggcctgcttgcatacctgggctgataggaagcgcgccatccccaaggcagctcctgctgtggttggacagtgctgactgttagacagttcttccctatattgagccaaaatctgtcctgccacttgctggatcttggttgcagaccttcccattcacccagttatatatctttgctttcaaaatagtcaccttgagagaccagacatttttctgaaaacatcattactcagaattcagattcccctctgggatctgtcttcagaatcaaagttagctcttttctatcccctgtaagtcagtccccttttgttgtagcttcacctcgtttgtgacccccacttcacccaccttccccaccatctgtggctccatatacctttcgaccattttctgctggaagaggaagattcacggcccctgaggagatccagaggaaagagacggtctccaagggtgctgtgcagcaaggagcccaggagtggtatgaaccgtaacagtgcccttagagtaaatgtgcggcccctaagaccctgccctcaggaaggcggccttcccctgcagtcctgtgtcccacccctgggtctctgtagggtgccatccagggcaagcaacccaagcactgcttcccaccgggtgatgagccatgcaggcctccaaactgcacgtcatgattcatccctaaagtgagtttggccttgagagtccccagggtcctcccccactgggcaggggtcctcaaagccaaagaagcctggtgacacaggcacccatgggaggtgggcccagaaaggggcttcc

SEQ ID NO: 171925 - DNA, 1039 bp, Homo sapiens
gagaacaagaggctacctccagttaaccaggacataaagtccccagcggttcctgtcacacctgctcctccctccccagggtgcatccatgatcgtggatgtttgcccaggggtgaccatgtttggctggcttggaatgctgtgcattctcagagctctgttagtgtcccctcttgggggtcagagatgaggtgtggcagggtctagaggaatgagtgtccaggcagagttcagaaggtaggaatgtccctcttgatagggctgaatcaagggattcctggctttagaaagggtctgctatctttgcaaaaatgtgcaagtatctgtagccagtgtaatgaaatcacttccaaatccagcctgttacctgacttttgtcattgttcttcccattcacccagttatatatctttgctttcaaaatagtcaccttgagagaccagacatttttctgaaaacatcattactcagaattcagattcccctctgggatctgtcttcagaatcaaagttagctcttttctatcccctgtaagtcagtccccttttgttgtagcttcacctcgtttgtgacccccacttcacccaccttccccaccatctgtggctccatatacctttcgaccattttctgctggaagaggaagattcacggcccctgaggagatccagaggaaagagacggtctccaagggtgctgtgcagcaaggagcccaggagtggtatgaaccgtaacagtgcccttagagtaaatgtgcggcccctaagaccctgccctcaggaaggcggccttcccctgcagtcctgtgtcccacccctgggtctctgtagggtgccatccagggcaagcaacccaagcactgcttcccaccgggtgatgagccatgcaggcctccaaactgcacgtcatgattcatccctaaagtgagtttggccttgagagtccccagggtcctcccccactgggcaggggtcctcaaagccaaagaagcctggtgacacaggcacccatgggaggtgggcccagaaaggggcttcc

SEQ ID NO: 171926 - DNA, 1300 bp, Homo sapiens
aaaaactctaaatccctgttctggaggatggcaaaagttgaaaattggagacagaattaaattataatggtaacaggactagttagatggtggaattttcaacctggcaaatctgctttttcaagaccagtcttcatttggaaggagtaatacacagagacttggggatcaggtactcctgagtgattcacacacacaaaaagctttaatttccggattttcctgcatctgcggggcccataaaagtatcccaagcttctctgttaaagtgtagcattccctctttcttaaatatgattcaaagaccttgcaagatggcaccaaatccattatctatactcaccttcctttcttctaacctgagccataaataagattagtcacaaaacatcctaccaagaaaagtattatgcctattaaaagaagaaaggaactatacccggaagatgctacaagagaattacgggcctggatcttgacatactgatcaagaggagtaaaacagaaggtttgataacaaagcgttcatccatatgtgagcatactcccacagtacaagagttagcaccttgacaagcaacccaaggaaaggtgttaattgctgttagaatagcttttagaactttggataatgtgatgggctacactaggaaattagaaatctagaatgactaagtaggtggtgaaaggagaaaaaaaaaagctcagaaaattgaatgtgctagagtaggtgtactatataaggactaaaatcaatcaaacaaacaaaaaacacccgtccactatgttctgtggtagggcttgaaagtcactttttatcaaggcaataaaaaatatgatgagggtgaccttgatgccatttaaagtgtcatatggtgactgtcttctgtagactagagcttgtggtaggagatgctattacagacaaaagattctttacatcaaagtatctaataagattctgcagtaatggaggacagggagcaatgcttaaccatcttaaataaggtggatacaattataaaatccgtgacaaaagtcagagtggcagcaaatttgacttgaacctcagagagttatgggatcgttaatcaaagatgatgttcttagggtcaaggaagactggaagctatcaagaatgctcaatccatgggaatcaagaacaatcaaagctgaatctgacaatcttcgccagattctggacttcagtctacattatttccagggatctattgattaaaggaaaagttaagactccaaaaggaacaaacctgaaacatgcatcaatctcaaagtgacc

SEQ ID NO: 171927 - DNA, 424 bp, Homo sapiens
cttctaccattcttccccctctacttcagccatattggcctctttgttgttcctcaaacacctaactaagcacattcctcaggacctatgctcttactatttcttctgcctggaacattcttccctcacatatcaatatggttcactctcttccctcttttggttctttattcaaatgccattttactgaggcttcccctggctaccctatttaaaattataaaccatcaacccttccttcattcttcttcataggattttttaccatttaacatacttcaaatgcagcaaattaaggagttaaagggagatgggaatggacattggcaataagcacggacccttctttttaaacagattgtgtggaaagagaatacaggaaactacaggaaactaaacaagaggtcagatggctaaagtatga

SEQ ID NO: 171928 - DNA, 456 bp, Homo sapiens
ttgagtttggggttcaggagacagccaggcaaagaagcttccagagcagagctaacttgactcagaaagctttacaaggagtgtctttctgtgacatgttttttttccctctcctttgaagaaggaagagatggcaaaactccaccatccatcttcagacacatactcttctcattaaacataggcctttcttcccaggaaagtgagcatttgctgttgcatttgcccctctggtgtgctggccggtgttcctgttttaattcaggatgctgttcacccctacagtgttctctttgcatcactggaagtcgttttggagtggaagtccatttggaccatgaaaacatttgatcttgtcgggtagtttaaaatttcatttgtcaggtcagtgttttgattgttttgaccttgaggctttttctcacggtcaataccttggcagttttagaaagaact

SEQ ID NO: 171929 - DNA, 481 bp, Homo sapiens
cggggaaccctgccccatgactgctgcagggagctggaaggctcccagcaacacagcctgccccctctgggcagccaaccagcagcctgttcagctaagtccaattcaatacatgttcatggagctcctcctaagcacccgacagagagaaattgtgtcttcaacggactcaaaagcggaggggagagaaacacagagacatgtctctttgtgatccccagcaagacaagcagaatataatggaaggccagccaaaggataggggagcacaggaaagagggaggcccagtgcagcttcacggtggcacagatatttgcatcatttgtgtcttgaagaataaagaggttgtcagcagtcagagaaggagacggaaaggccttctgggttacaggagcaacttgagcagagcccacaaagtttggaaatagatgggccattagggacaagaagggtctgtgtggttccccaacagggtttgtc

SEQ ID NO: 171930 - DNA, 309 bp, Homo sapiens
aagaccctggacaacatgctgaaactacctgtatcttgatgggacaatagcagccacagcctacagtgtggcttttgaactttgcaataagtactagttatgcatctgaagctatatgatccaccttcaaaatctgcattctcttttcatgaatggatatttcagaatctttttttttctttcatctaacgctgagataatagtaaataattcagaatttatttcagaatatttttgcaattgtcctttttgttgttgttaagggaagttgaaacaatctctacagaacttttttttttttttttgaga

SEQ ID NO: 171931 - DNA, 422 bp, Homo sapiens
ctcagaaaacagttcaaaaggtagaggaggctatgcatcctgatgcccccaccatacctcctatgtttgttaagtgcatatttgttatgtgacttggttggtttttttgttttttaaaccactccaattggctgttttgccaaaggccctccatttgagcttgtatcctaatattgccactcaggagaattactcctacacttcacaagcacaagaaaaaaaaaacttcataaatatttcatcaagtgattacactgttatttcttaccttcagaagtataactctcagcaccctagcacaaaatgactttgaggagacaccctcactccatctttgcttttggaaagatactctgtctatgagcacacttctaacactgacttttagagctcaatgccatagtcctggagtaactttctca

SEQ ID NO: 171932 - DNA, 382 bp, Homo sapiens
cctacaccaccaaataccagtagtacctttccctacttctaacaacctaaaatgtctccagccagatgtcccctaaggggcaaaatcattttcagtcagaaccactgtttagcagtaacctgtaagacaaaagtataccaaaaagtagaagtaactttatggattcctagatcagtgtgttctgctatcactgtcttctaggctgccaggatttacgcttttaatagtgtagtctagtactaccttgccattatgttcagaagtaaatgtgaatttaagttgaatagtagtgttttaaaatatgtaatccaaatattcctaattttttattttattttgttttgtttttagggacagtcttattctgtcacccaggttggag

SEQ ID NO: 171933 - DNA, 612 bp, Homo sapiens
gttccattaagattttttatacctattatttctgtcatcatcatgttcatatttacctctgtttttgagcatatggcatataatagctgttttaacatgcctgcctgctattctatcgtctttgttaattctaggtcagtttctactgattgttttctcctgcttatgggtcttattttcctcctcctttgcatgcctatattttgtttgtttgtttgtttgtttgtttgttttaacagcctgggcgacagagcgagactccgtctcaaaaataaataaataaataaaataaaataaaaataaaataaaataaataattagtatgtgaatgagaattttgatgaaattaatgacttatagaaaaatctccggaagagttatatttacattagaaataaaattttttttaacccatgggagaaattgagaaaactggtagagaactacttctgaaaacagtgtctgggtatttatcaaatatctggaagtatatgagaagggtctctttcatattactatatgcctctgtctcttacagaataaaactcatatacctgcatgtggttcagaatgtgtcacacacaagcaagaacaatcatcaaagtatagggg

SEQ ID NO: 171934 - DNA, 350 bp, Homo sapiens
gaagtcctgccccacctcaccccatcaccaggccatgtctctgtgcccccttagtgatcctactagactggggagcaactcactgtgttgtgccattgtctactcttttgccatgtctgcatcccccaacaggatgcaagctcagtgcagacaggagctacatctggggtcttgttcaccatcatctcgctcacacattccaaggcttggtacagagtaggaactcaaataatagctgtaaatggaatcgatcagaataacaataacagtctagagaaaaataaaaaatctcaccactccagggcgagcaagacaaatgggcttgtcccattgttgagacggaaagcttt

SEQ ID NO: 171935 - DNA, 378 bp, Homo sapiens
tctgtgacgggctcaggaacacctggttgctgctctccatgagctgttccaactgtgaagcaaaagcttcatgcataaaggcatcccaacgcagtcaatgacgcacaggagaaagaggacagagataagcttcttgcctgttccagacactgaggatcaggcagagagagaggctcctgccaggctgagcttttccggagtgtggatatgaacacccgtcgtgggtcctgaggtggaagccatgtgtggaagatggagggcatccgttagaaggagtatagtccctgatggtcactgagctgcagaaccagcgtgggctgcttcatgctggatgtcacttactagagagcgaaattaaatgtgcttcagatactgtta

SEQ ID NO: 171936 - DNA, 325 bp, Homo sapiens
tagcacgtacttggggctttaggtgggaggactggcagaggccactccatgaacgaaaggaggctgggcaccaggggctgagtaagaactgttttgaacagaatgggagctgactcacatctggaggagggttctcaggtggggtccctcggtattgctgtaactgggtcaatctgattgtctctcttcaacctttttcaaccatggtaagcacgaatgccctaagccattgactgtaattaatgaatttctctcctatgcatctggattgtacagtctagatgtacaagttgtactatccttgggagaactaagaaaatagttg

SEQ ID NO: 171937 - DNA, 316 bp, Homo sapiens
ggttgcagtgagccaagctcatcccactgtactccagcctgggcgacagagcgagaccctgtctccaaaaaaagaaagaaaggtcatagagtatcagacttgcaaatgtgattcatactctgccagtcatttcagggtgcattccccttccttattttgtaaacttctctccttactcaaaggttagttatctctcagatcagacaaaggagcagctgttattcaactatagatccaactagattcgaatatgttttccaactagattacatcctacaggtacataagtacagtggtcgatcatactatacaacta

SEQ ID NO: 171938 - DNA, 488 bp, Homo sapiens
tccctacaccaatagatgtggacaagtatcaggatatttttttacttaaagatatagtctgtgagcataatttctattttctaacacctccaattttgtataaagaattgggaagctgattttgtataaagaattgggaagctgatttttcagagctgaaataactctaaataagtttggcaggatccgagaagaaacttgcctcagctctgtcatctgctgcacagagcaacatatctgacttcacatggtatttttggaagccaagacaacttctttaggatggctgccacataaaatacataaaataactctaccccagatagaatcagacatgccaacactgattccactagaactgtttaagtattaagggaatttttaagaagtaagggaattttttctaaatcccagatggggttttttgtttgccaagttccttcttatttcttgtaatctttccttattgcatgtctgtgttgggctaa

SEQ ID NO: 171939 - DNA, 686 bp, Homo sapiens
tacatctaggagctaatggcttattggtgtcttttagtcaccagattcagatagtatatttagttgaaggttgcagcagcacacacttggctttctcatttgtgttagcttcacttctagtacagaattgaataggattgaagagacggttttcctgtttgtgtctgtggcaactttttcgatgatttgtggtttaattctttaaacatttttgatcacttatcacctctttctctgtgaaggcttaaagtattcagattctaatgttataatcttttcatcagattatttaattttggagaaatcaaggtcagaatagcagctgacacagttgtctctgaatagtgacctaaaaattataatacttctttttttttggcctggattttatggtctgcctttgtggcatcagatttttaaataagattatgtgattgtgaatcatgtatttcttggtctctggcctcttaaacaggtaactatatgacttggaccctttttaagtctgttttttaaaaaatgttaatctctcacatggtttttaaactgttgacagtattgtacttgacattaattttgttaggcagttaatgcattcttcggcataactttgtttcttgggtcttttcaagacctgtcaaagaaaacaaaatgctaacctgactttaaaggggcaagaaaatccc

SEQ ID NO: 171940 - DNA, 302 bp, Homo sapiens
cagaggcggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccgaaaaggtatagtttggcagtggggcctccaaaaaaagacccaaaagttaaaggtgtccaatcagcagctgtacaagcttttcttaaaaggaaagaagaggagctgagacgaaaaggtatgta

SEQ ID NO: 171941 - DNA, 299 bp, Homo sapiens
cagaggcggtgggagtggggctcccgaggcagtgcagttggctgtagctgggcgcctcggttaggtgcgctgtcagtcctttccgagtgcctggcccagtctctcccgcctcggcccaacatggacttcagagaaattctcatgatagcttccaagggacaaggtgtcaacaatgtgccggtaagtagcagctggggcatcaatgtaggggaccctagtcttccaagttcggaatgtgtgtggcccatggaacttctgggcagcccgctatcggctccgggagaggaaagacccggacg

SEQ ID NO: 171942 - DNA, 433 bp, Homo sapiens
agagacagggtttctccacgttggccaggctggtctcaaactcctggcctcaagtgatttgcctgcctcagcctcgcaaagtgctaggattacaggcatgagccatcatacccagccttaaatgtatacacaattaaaaaaaaattactagaaatggaggtatttataaagttccttggcaatcctgataccatggccacagtgaaataatgagtataatacacagcagcttccagctacactcaaaatagaagcatgtgaatttcatatagtaagtttgaaatctaaatgtttaaaataaataaaacgttaactgctatcctggacatttctcatgcttgatgataacccaacatcttttaattatcttttccaatgattggcaaatttctcccattctaagttcacctccttgaaggagaaaccagaaact

SEQ ID NO: 171943 - DNA, 571 bp, Homo sapiens
gcgactctacaggatcccgtgatgttatcccaccaccaccatgcccagctaatttttgtatttttagtagagatggggttttatcatgttggccaggctggtcttgaactcctgacctcaggtgatccaccctcccccccggcctcccaaagtgctgggattacaggtgtgagccatcacgctgggccaagcaatcctcttgtacctcagccttccacgtacctgggactacaggcatgcaccaccatacctaggtaatttttgtttttgtatttttttagagatgggatttttccatgttgctcaggctggtctcaaactcctgagctcaggcaatccacctgccttggcctctcagagtgctgggattacaggcatgagccattgtgcctgatcataccatattttctttattcagtctaccattgataggcattcaagtcgattccatgtctttgctattgtgaatagtgctgtagtgaacacccttgtgcatgtgtgtttatgacagaataatttatatttctttgggtatatacccaattattaggttgcttgatgaaatggtaat

SEQ ID NO: 171944 - DNA, 434 bp, Homo sapiens
ctgagccatcctcagagcacagctggtggggaacttcacccgtctggtcactcctgaagcagtctggctggcagccacaggctgggatcccagttgttggaggtcagtgcacacagcggctatctgctgtagcagaaagaatttaggggaggaaaggcttgagaaggaagggcaagagagagcagactttgtggcatcagtcaggtatatgtgcttgtattaacatgaacctgagaggctgatggtattacatggaattccaagtttcgactgcatgaattctgtctcttgtggtttatctatggccaccatcaaccgatgttgtgtgataaaacgtttaaagtatgtacaactgaaagtggagatggatactaggggcatttaacgttttaagctttcctccagggttttttcctcagttacatggaggatgg

SEQ ID NO: 171945 - DNA, 673 bp, Homo sapiens
tatgggcattcagagtaaatgtatgagagatagtaattagttgatttattttctgtctctgctgaacttgaacctgctaaaaagtgagcctaggtctttgttaactggcatcccgagagtatgagaccagtgataagatctaagcaaaaaggtgactcacctcttgtttgaaagggcagacatactcagcagtgatgggctgcatctatgacctctccctcccttttggacttaatctgtgacaacaaccttggctaccaatcagcctcttaaccaatttagtcaggaaacaagcaaggctggcaaaggcagacaaaacactgtctctgaccctcaaagataagcacaagataaggcaaaataacagaatgagtctttgtcatttaactatacacaaattgaaggacagaagaatctctgcccatcacacaggacagaagaaaagcttataaggtatgaaggataagaatagtaggaactggccgtgtgcagtggctcatgcctgtaatcccagcactttggaggccgaggcgggcagatcacctgaggtcaggagtttgggaccagcctggccaacatggtgaaaccccgtctctactaaaaatacaaaagttagctggccgtggtggcaggcgcctgtaatcctagctactctgtatgggggatcacggag

SEQ ID NO: 171946 - DNA, 214 bp, Homo sapiens
ttatgcttccaagtctggcctccccatcaaaagagtgcttgtaccccaagattgccgaagacataaaacactcctccgcaaattttggaaaatacagtgatactcaaacccactgcagatcaacatcccaactagatatgatgtgttcattatcataggccagctctgctgcattttcttataacactgatttgcaaagcccaaccatgacaac

SEQ ID NO: 171947 - DNA, 440 bp, Homo sapiens
ggaagtagagtcgagtttcttgagagttaagacatgattgagattgtatttttgttaaggaagcgtgaccaagccagaagaagcaaggaagctgaggatatgtgcaaagaagtgattataccgatttaccatggaatgtaaactaagcttcaagggcatcacatgggtgtgggccacagacggcctggatcgctgggttggaggtaccaatgagtcagcagtattattgctctgggagatcagacaggctgaacaaggaagagaaagtggggaccagaaataaatgtttttggtgctattcgaaactgtattttccttaatagaagattaattcttcaggaatcagaccttcagtgtatgtgaattaagatgataaaaggaaaggaagggactgttggatcaaataaaaaattatttattcatcatttactttatgccct

SEQ ID NO: 171948 - DNA, 449 bp, Homo sapiens
tggcagaagtacaaatggcacctttaccagaaggacactgtaaaagttcagtgaagctctgcggtttccggtgtggctgtcttcatccctaatcctaaatgttaactttgcaaccctgtaagatttcatgtctgtaccagaaactttttgtgaggaagccttgactggccattagggagcagaacagtgagggaaagtctcaagagtaatatatccgcgtgctgagctgtggaaggaatgaacagcggcctttctctgaatggtaatgtagctctcaaaaacgctgcctggttcttaatccaaatgtccagaaccattctgtgcctggcagcacacatccagacaaatgaaagagggtctcttcacttgctaaaagccattataaggagaaataaagaaaagggaaaaaattaaaagaggatctctaaaggaactttcgtattgcctgc

SEQ ID NO: 171949 - DNA, 3175 bp, Homo sapiens
ggcaggatcgaggccgcgggttaagtcggcacgaggggcagaagcgcatgaggctgtgggacttgccttccatttgatttctgaattgtgaaggtgcatgctttctggaggcctgcacagacctttcccacccgctttcctgaaagaatttgacagggaaagtgagaccgcaggaaggctttttgggggaaggtttcttcaatgctagactctctcaggcagagctgcatcgggccccctgccttccctgctcccaatttcctgagaccgcccgcccccacccagaattggggatcttgatcaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggcattgtggcatctcatcaactaccaggatgatgccgagctggccactcgcgcctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaag

SEQ ID NO: 171950 - DNA, 365 bp, Homo sapiens
ggatggtgaaattgctatggagtgtgagattgctgtagaaggtgaataagaggcctggactaagccaccaatactcaaatggcacttcttttgtcctcatgtcaattatgtgactttgccagcctctctcagcccctatgattgcacctgggttaccggaggtggagagaggatgcctgtgttggtggcagcaaagaggtcaagattcaaagcccaccccgcatgcattccgtgggccatcctgagcgtcaaaaaataaaatagattcatcaagggaccaaagaaaaataaagaccacagagtataaatatttgactactactgcctactgcttgtccttttttttttttttttttgggggaaaa

SEQ ID NO: 171951 - DNA, 444 bp, Homo sapiens
cgggtggatcacctgaagtcaggagttcgagactagtctggccaacatggtgaaatcctgtctctactaaaaatacaaaaattagccaggactggtggtgagggcctataatcccagctgctcaggaggcttaagcaggagaatgacttcaatgtgggaggtggaggttgcagtgatgagccaagatcatgacatagcactccagcctaggcaacagagtgagactccatcaaaagaagacgaagaagaaaaagaagaagaagaagaagaagaagaagaaggaagaggaggaggaagagaaggaggaggaggaagaagaagaaggagaagaccaccaggtaaagaaataaggagaacactatccaggcctcaagttcaaagtcatagtgttgtaaaaatgtgatgtggatttaagttgggaaagcaagaggctttactagctga

SEQ ID NO: 171952 - DNA, 465 bp, Homo sapiens
aaaaatcctctgtgctcctacctatcctttttacttaaaaaaaaaaaaaatgtagccactggggctgggcgtggtggctcacgtctgtaatcccagcactttgggaggctaaggcgggtggatcacctgaggtcaggagtttgagaccagcctggccaacacggcgaaaccctgtctctactaaaactacaaagattacctgggcatggtggtgcacgtctgtaatcccagctactcgggaggctgaggtaggagaatcactgaacccgggaggcggaggttccggtgatctgagattgcgccatcacattctagcctgggagacagagcaagactccatctcaaaaaaaaaaaagtagccactggaaagatttaaaattacacgtatgggctgggcatggtggctcacacctgtaatcccagcactttgagaggctgaggtgggcggatcgcttgagcccagca

SEQ ID NO: 171953 - DNA, 372 bp, Homo sapiens
actaaaatacatgtttcatgccattacttattttgaattcctgattgcttttagacatggaagaattgggagaaacaggtagtatgaaagtatttgggaaaacgaagtgccttaacaatggatgcatagcatacttccactttctgaggtgtgccatcctttgggcctttacaggttaagttccttacagagatagtgatgtggccaataggactttttttggttgcccagcagtccaggttaatgtgatgatcaaataggagaaagcttttctggaagaggaactggggatagaaaatataatagacgggtttagttaatctagccttctcaactgagaagtatgtgagaagaggaaaaggaaattaggag

SEQ ID NO: 171954 - DNA, 451 bp, Homo sapiens
gactctcagagagattaaataacttgcccaaggtcaaacaactagtaagtggcagagctgggattaaaaatcaggtttatataaacttgaatacttctgtccttatctgtgaccagtccaataagaggtatttcctctcaaatgaactggtggatgggagtggttaatagcatggctactagagatggactatttggtttgaattctggctgctccatttactggcttatttgagaagtcttctaacttctctaagcttcagttaccttatctataaaatggggataataatacctaccttttagaggtgttgaaaggatgaagccatgccgggcgcggtggatcatgcctgtaatcccagcactttgggaagccgaggtgggcagatcatgaggtcgggagttcgggaccagcctgaccaacatagtgaaaccccttttctactgaaaaa

SEQ ID NO: 171955 - DNA, 645 bp, Homo sapiens
agctatgagtatcataaggaaactaaagaacatatgggaaagattgataaatatttctgtgaaatttggtagaaatataactaaaaaattggggaaaattataaagattaggaatttggcactaagctttctttgtaaaaacctaagtattttcttcacattaaagaatcagaaactaggccgggcacggtggctcacctgaggtcaggcgttcaagaccatcttggccaacacggtgaaaccccgtctctaccaaaaatacaaaaattagctgggcgtggtggcacacacctgtaatcccagatacttggaaggctgaggcaggagaattgcttgattgcttgaactcgggaggcggagggtgcagtgagctgagatcatgccactgcactacagcctgggcaacagagggagactgtgtctcaaaaaaaaatgacaggtgcggtggctcacacctgtaatcccagcacttggccaaaatattactattatacatgttcgctcatttatgaaccactaacaaaaatacctgttacgtacaaaagagaaatctagccaaagggcttctcctctttataaagccaccaaaagtaacccttttctgtagctgatgaactggaatacctgtctcttcctcactgatgc

SEQ ID NO: 171956 - DNA, 164 bp, Homo sapiens
ggaagaaaaactcctgtggatccacctctctgaaaaatgagattgaaaccctgggccttcctttcttccatgccagtcaaagtgacccagcgtggcaggagtaagaaaacagtccaggttttgaatgtctcttccaacggctgacatggtcctgcccctcagcg

SEQ ID NO: 171957 - DNA, 371 bp, Homo sapiens
gccgtttggaatttcattttgaaattctctttccactaacatttatagttttggcacagttgccctttaaaaagacagcgtatcaattgaacataaatatattgtgtttaaactatatgcctgcttgaataagtgcagtacttatttgtcagggcatatattatgttggagtatgatgtcatgaggcttaaggaaactaatgcttatcatttgttagtgcttaaaacaaagtagagatagccaaatgcatttctctacttccttattgccatacagctctccttgtaagttaataagtatcttattgcaaatcagccctgtatctgttccaaattcaaatgttgatggttgagcttccagtattttctccc

SEQ ID NO: 171958 - DNA, 273 bp, Homo sapiens
gaagagaagagatcagaggccaggagttcaccagcacagccccagttccttgcaccaggacagtttcatggccaagccctgctaccctgttagtcagggtacccggccacccttgagactcattggctaaagaattcactcactacaccgctgtccggtatggcttttgtcctgttacaaaaacccccagtttggccgaaagataaaaatggaagggaaaaagaagtttcatggtattacttacataagattaaactaaaagttaacattctc

SEQ ID NO: 171959 - DNA, 175 bp, Homo sapiens
gcccactacctcccctatgggccctcacactccaggccactgttcccctgccctaatccccctagagccaggtgacagacaactagagacagcatccaggccccagagccggctaacattattcaaacagctaatcctaaacctgctcaacctgcctcgcccattccctcccaca

SEQ ID NO: 171960 - DNA, 745 bp, Homo sapiens
  misc_feature (457)..(457): n is a, c, g, or t
  misc_feature (474)..(474): n is a, c, g, or t
ttcagctctccggtccgtgcctccaagatgacaaagaaaagaaggaacaatggtcgtgccaaaaagggccgcggcacgtgcagcctattcgctgcactaactgtgcccgatgcgtgcccaaggacaaggccattaagaaattcgtcattcgaaacatagtggaggccgcagcagtcagggacatttctgaagcgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtaaggagctgagttcttaaagactgaagacaggctattctctggagaaaaataaaatggaaattgtactaacaaaaaaaaaaaacncacaccaaaaacaaacntttgggggcgccctatgggaccccggaaaaagagtttccaagaaccctcgggtgtggggcgcggcggcgcccaagataggggtacgtggcaacatggggccacaaggggggtccccaagagagagacacgcggctccagaacatgggggggtggttttccccacccataaaaaaaagcgcggggggacaaccgaagggtctgggaacaattcccagaggagtcccgaggactacggggtgcctccaacggggtgcccacggaacgaataca

SEQ ID NO: 171961 - DNA, 714 bp, Homo sapiens
tggcctagagaacactcttctctgacatgctttgcttctttaacacctacttatctttcaggtctcttcctgtttctctcatttttaaatttttattttaagaatttataaatatatacaaaagtagagagtatgatgaatccatcaccatttctatgtatccattacccaccatcaatagctgtggggatttgatctctttaaaaattaaaaaaaagttttcttgaaatcccagtaaataccttttatttttttcttcctagcacattaacacaatttgcaatcatgtatttaatgtctcttttctccattagtttataagctccataaaagctgttttctatattgtgatatatccagtgtctcatacagtgcctgaaacatgataggttctcaaatgtgaaaggaatgaattatttaataactgaaaacgtcgctaaggggtttgaaaagacgagcatttgatgaaaactttttgaaaaagattggtaagaatgacttaggcagctttatattaaaacaataggtaccgttaggctcagattcatatacttattaagcaaccttgtgctcttaatttttttccaagtaagcttctgtgtaaagcaaactcagtgaccttgtgaagagaatattatttgagtttataagatattgtccatagtaaataactaaattagctttgggggatcactcttgggcaaggtaaaatga

SEQ ID NO: 171962 - DNA, 206 bp, Homo sapiens
gagttgggattgtgatgcccaacccatagccagatattttctcaggacgagaaaaggaagatttttggcactggattacatgcttggatcattggaaaagttagagaagtgattattatttttgttgtcactagagaaaaatctgtttttgcagcaccagagtaatgctgagagtttgaattagaagctttaatgttaaacagctg

SEQ ID NO: 171963 - DNA, 1303 bp, Homo sapiens
ggtctttaccgctcagcttcccggagtccgcgcaggagcgcgtctgaataggaagcgttttcggacgtggatgcggcgttttgtcgctgccagtggtgtctggagaggttcgggctcggtcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggagagacagggtctcttgagaggccgaggcaggcggatcacttgaggtcagaagttcaagaccagcctggccaacgtggcgaaaccctgtgtctactaaaaatacacacaaaaaattagctgggtatggtgctgggctgttgggagccgaaggcccatgggatgtgaccaactcagcattccactggaggctatatgatcaaacagcaaactttatcatgaatgcacgatgtgggcaaactcatgactgcttccgctgccagaaggtttgctgagggcaatcgcttcctggtgctgagctccttgaggttatctactgggacatctagagaatgccatcttgcaaaccctactctggactgagtagctgaccccttcttccacccgccttctcactatctcttttgcctaataaatatggagggctgtgtaaagctcagggcccttgtccactagaggcaaggtgtcccctgatcccttcttccaaatat

SEQ ID NO: 171964 - DNA, 1636 bp, Homo sapiens
actccccagacattccaagctagaatttctggggatggggttcggactctgcatttataaaaagagccttcttaaatttgaacatctctgccctaaattgtggattggtgctcccatcaccattcccacactgtaacaggatggattcagggcagattgtctccagcaatgaatcagacaaaagtgctccaccaaccaggcccttgaatcaccttccttgtcccgtgaatcagcacagcctgccacggcaaagttttatcagcccactcctggaaatgatcagtgaaggtcccatcatgggctgctcatagtcctgtggaccaggtgctaaacttacctaccagagattaacattccagatgaacggggctgaaatttaatcctggatggaatatgttataacactcaagaaatacgaacatgaaattcttattctctagaaattacaaaactcctcaggtcctggctcccagaagcaaaataactcaagtgaagcaatgaaggaagaagaaggaggttgctggccttggatatcataatttctggggacaactttaagtggacactaatatttctgactaggaaaacttcaaaaacttcatggcaaatgcagaagagacaaagacgtatagtccatgttatccactattttctgagcacagaagaaaatgatcaagacccaggaatcactgaccctggaggatgtggctgtggaattcagctgggaggagtggcagctcctggacactgctcagaagaacctgtaccgggatgtgatggtggagaactataaccacctagtatcactggggtatcaaactagcaaaccagatgtactctccaagttggcacatggacaagaaccatggacaacagatgctaaaattcagaataaaaattgtccaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattggagagacagggtctcttgagaggccgaggcaggcggatcacttgaggtcagaagttcaagaccagcctggccaacgtggcgaaaccctgtgtctactaaaaatacacacaaaaaattagctgggtatggtgctgggctgttgggagccgaaggcccatgggatgtgaccaactcagcattccactggaggctatatgatcaaacagcaaactttatcatgaatgcacgatgtgggcaaactcatgactgcttccgctgccagaaggtttgctgagggcaatcgcttcctggtgctgagctccttgaggttatctactgggacatctagagaatgccatcttgcaaaccctactctggactgagtagctgaccccttcttccacccgccttctcactatctcttttgcctaataaatatggagggctgtgtaaagctcagggcccttgtccactagaggcaaggtgtcccctgatcccttcttccaaatat

SEQ ID NO: 171965 - DNA, 235 bp, Homo sapiens
aacacgaacaagagaggaatgtagcagttttggttaagaacccatccttaggatacgcagtcttagaactacttaaggaaatacactgaatttgatcttgcatgttggatgaaatcgattacagactaaatttcaagtagtctggaagagggaatacttagtcttttctagactaaagatgtgtgtgtgccagaatctgtgtagctaatggtgttggggataaggaggggagtgt

SEQ ID NO: 171966 - DNA, 627 bp, Homo sapiens
actttgtcatctggctggagtgcagtggcgcgatctcagctcactgcaacctctgcttcccgacttcaagcgattcccctgcctcagcctcctgagtagctgggactacaggtgtgcaccaccatgcctaatttttgtatttttagtagagatggagtttcaccatgttggccaggctggtctcgaactcctaacctcaagcgattcacccgccttggcctcccaaactgctgggattccaggtgtgagccaccacgccccactctatctatctatctatctatctatctatctatctatctatctatctacctatcatgtatctatcactttcaaatgtcaaagagccctaccaaattatgtgcctgtttatcagtttaggaagtgtgagttgtaataacttattctttaccttaagggagatactatggcatgtcccagatgattggacttctaaaatcttcactgatgtggtaagttagtgaacattcatgaggtttatctccctctttctgtcactcatttgcattactatggcttctacagtgattgccacttcctgatcaccaggtcaaattagcatgattttattggtggaatgaaccagtgctatgttcttcagaatgt

SEQ ID NO: 171967 - DNA, 639 bp, Homo sapiens
gtgatacagattccttcagctctctcagatatgcttaactcttgagctagttagtgtgtaccagataccagaataaataattggggaagcctctcattggtaaacccttagctttctaatagatatctagagtactcatgatgtagtggggttgggggaaggtggtaactttgtcaagcaagaagagtttgaacaaccatagtttctttgagtctttcacctgtatcctgggaatcaatcacttggatgttttagatttgaattttagcttatgaattactaaaatctagtgtattatagtaagtataataaagcctatgtgtaacaggactgtacagtagagtaggttgttcctatttacgtaataacataatggtgaaataataaagttcaagtatttattgactctactaagagctccagtagggaatacagtgtcatagtccctgctcttaagatattcacaggcttccaagggaaattatgaacaaatgattaaaatgacatgttaatattttgagaagataagctcaggaaaggcatgtaggtcagctgatagtgttggggagaaggattattggaaataaatagtatttgtgtagtaaggcttgactatttacagagcatagttttcatttg

SEQ ID NO: 171968 - DNA, 187 bp, Homo sapiens
tcccggaaggagaagtccacagaaacctcaaatgcctgcgagaggaaggaacaaagggaggactcacagattgacacgctgggctggcggctggccctcgaatctatagggtctgggcttttaaacttcttttttcaaagctccgcctcaaaataatggctagagaaagaagttttggaggtggccg

SEQ ID NO: 171969 - DNA, 440 bp, Homo sapiens
tcagagccaaaacaagaccgtcccagattagttcagaggaagcagccgggcagcctggtgcatggtctctccaggagcaggctggggcgtgggagtcacctgtagcctctgcccttcatggtgcgctccgctcagcctgggccggggacaccgttccgtctggtttgtgtggtcgacgtcaggagactaaacatggacttcccagtgcccccgtccttcctgtgcctccggaagcgcgtgtgcatcaaaggtggcgtgtcttgaggcggccaggccggagagcacacaggatgcagccgtcaggacctggcgtgggcttcctgctgcacacagcgcgttgctggcaggccccgtgaggcggtctttaaagggagggctgcggagtcctcaaagtatgcccgaaaagaggctcaaggacagggcgatcatttcagccaccc

SEQ ID NO: 171970 - DNA, 582 bp, Homo sapiens
tgagactccgtctcaaaacaaaacaaaacaaaaacaaacaaacaaaaactctgctccccgattgctccaggggactgctttgagtaataatagaactccagtctcccacacagccagctctgcatgaagtactccttctctattgcaattcccctgtcatgaaaaactggccctgtctagacagcatgcaaggtgaacccactgggcagttacagaatcccctgacctttctccccatggtctccttctccaaagcctagtccaagccagtgagaaaggaggaaggaagaaaccagtcaggcaggcagttagggtgggtcctcagttgagttctttcaaatgaaagaacagcctgcaggcacagacaaaggaacttgcacaagggggcttgcctaagacgtgcctatagctgcatagacccagcaccttgggatgctgaggcaggtggatcacctgaggtcaggagttcgaaactagcctggccaacatggtgaaaccccatctctactaaaaatacaaaattagccaggggtagtggcatgcgccagtaatcccagctattcgggagcctgaggcaggaga

SEQ ID NO: 171971 - DNA, 428 bp, Homo sapiens
tgagactccgtctcaaaacaaaacaaaacaaaaacaaacaaacaaaaactctgctccccgattgctccaggggactgctttgagtaataatagaactccagtctcccacacagccagctctgcatgaagtactccttctctattgcaattcccctgtcatgaaaaactggccctgtctagacagcatgcaaggtgaacccactgggcagttacagaatcccctgacctttctccccatggtctccttctccaaagcctagtccaagccagtgagaaaggaggaaggaagaaaccagtcaggcaggcagttagggtgggtcctcatccagaccacaagagtggtttctcagacctcacacaagaaagatttcagggtgaacccatacagtattgtgaaagcaagtttattaagaaagtaaatgattaac

SEQ ID NO: 171972 - DNA, 1188 bp, Homo sapiens
ccagggaacactgatgtttaaaaaagtggtagagaaaacgtggggaaaggtcaacttttgttaaaatctcttattcatgtggctgtttaattcctctacatcacatcctctcttctgttcaccctggaggtgtaaaacactataccaaaggacagaacacactatacacgtttagaacatttcttctgaggatagttactgctgcggtaatgcaggtactgttgtggtgatgctaatgagaataaatcttgctaaaattaagaatcaagacagctgaagacctatggaaagcaattgaccgaacagtactacttcaggtcaggtaagcagtggcagtacaagaatgaagaatggattctttgttaccaagcaattaacaatctagttgggtatttactgggtaatacaatacaaagtaagcaatggtaattggttatgtgtatgtcagttgtggcatgatagtttctacctcggctatctgctgaagccctttctgtctgtcttctctccctgtccagctttgttcttgcctgcctttttattttttacagtccctctccttttttgcaggggggcggggcggtgctagtgggagtatacatacccctcgttaaccacctgtgatgtaagttaagatttttttttaaatgtttctgttttttaaaaacaagtgaatagagcatttattatcatggaggataaaatcctcaaagaaaaaatctgtttagcttttaaattcttcgtgaaatcgctaatctttgaggcgaaaaattttttcccgtaaatttaggagaacatgagatttgagtttttaaggactttatagcgtgcctatgtttattgtagattttaattccagagagctggtgattggaaatcatggacctatttgttccaatttaaactttcagcatttaaaaaggaagagataagagagaaccagacaggaggtatatagtttgtagaaagatacagatatttaatgtaatcccagcactttgagaggctgaagcgggcagatcacctgaagtcgggagtttgagaccagcctgaccaacatggagaaaccctgtctctactaaaaatacaaaattagccaggcgtggtggcacattcctgtaatcctatctacttgggatgctgaggcaggagaatcgcttgaacccaggaggcggaggttgcagtgag

SEQ ID NO: 171973 - DNA, 525 bp, Homo sapiens
ccttcacagcatgtgtcagaatgtattactaccatatcggacacagcagatctatcagaatttggccctttggttttagaaatattgatagtttgaacatataaatctgtcagaactaatgacctagcttttgaggttctggaaagagcagtttcattatttggcaaatcctttttttttaaaggaggaaagtgtacaaaaactgtctcaaatcagcaaaattgctgataaaaaacatataattcaaacgcccatgaactaacatgactaaatgacatctctatcttttctataatttaaaaagcaaagaagacaacaatactatcaaactagcttgtgaaaatcaggtaatattcaaacttttaagttgtctaaaatgctaagatttttaaaactgaaagtatagaatacaattttgaagtacgaattctgagattagaaggaaaactatacaaaatttgactactggccgaagcctacctataaacttttcaattgaattttaaatatccatctgtaggatct

SEQ ID NO: 171974 - DNA, 286 bp, Homo sapiens
tgcactccagccagggggacaagagggagacttcacctcgaaagacagacagacaggctagtacgttttccacaaatttcaattttactctcttcccccaccacacacacacacacaaagcatttgagggatgggaggaagaaactgagatcacagggaaaattgtaagagacattcagaaggacaggtcttagaaatttactagttttggggggaggtcagaacaggtgtatataaaagaatattaagacagttcccaggtttaggcatatgtgactagatagag

SEQ ID NO: 171975 - DNA, 328 bp, Homo sapiens
agatacaatgagataatgcctgataaattttcagaaatgacaaaaggcatgaattcatagatacaggaagcatactgtaaaccaggtagaataaataaagagttccacacttagacaccttggcatgaaactgaggaacaccaagtcaaaaggtattgccaaagaggccagagatatatcacctacaacaaaaggcaccatactgatttctgaaaaacaacaatggaagccagaagtcagtaatatgatccagtatttcattaactttaagatgccatcaatgctaaatcacaccactattttatacagcaccagtaaagaaaaaaag

SEQ ID NO: 171976 - DNA, 616 bp, Homo sapiens
tagccgggcatggtggtacatacctgtagtcccagctactcaggaggctgaggcaggaaaattgcttaaacctgggaagcagaggttgcagtgagctgaggttgcgccactgcactccagcctggaagacagagcgagactgactcaaaaaaaaaaaaaaaacaaaaaaaaaaacagcaaaacaaagttaatgaactcacaggtgttcaagaaatcgccatcattttgaagaatatgaacactgtgctctaatggattgaaacttgaatcctcaaagtagcttatgaactactatgtggtctaaaataaaagtcaacaactacatataggaaatcatgtgggtttttttcttgacttaaaaataaaattaagaaagctgtttttctaaagaaagcatgttatgcaatataatttcttccattagagttaattcttcttatttaaactttttggaagtttggtttttctaaataagagtttctaggacacgtatccagaataacaatcaatctggcagaaatatctcgtgcttacaataagcagtggcatgaatttcttactcttctctgtatgtgattcgggtaatgggccttccttggccaacctacacgtttaa

SEQ ID NO: 171977 - DNA, 330 bp, Homo sapiens
actgagggagtgttctgggtacagcctggtgggcctgtcggtattgacactgcatgtagagtcctctcaggtcagcagggcttcccgcagggactctgaacccagaagccccaaaagctagatcctgtgctcagaggtaaatggctttgctggagttctgaattaggagagactaaacaatcatcagattccaagcagagagcatctctctaagcctaatgaatctcctgccaggcagtgggatgctgagcaaaaaatgacctggagagaggggctgaatgtgagggaagaaccccgcatctgcttgtaatcctggttctacctcggact

SEQ ID NO: 171978 - DNA, 782 bp, Homo sapiens
cagctggtacggcccgcgtttgatatgtgaccaggcctcgcgcacgcgtgcgccacgcgtcgcccacgcgtcgcggacgcgtgggctgaaaaaaggtatgattatctggaatttaccgacgctagaggtcggaaaacacgctatgacacaaaagttggcactgataaatggcccaagaaagtgaccttcaaggccggtcctcggttgcagttcctctttcactctgacagcagtcacaacgaatggggctacaaattcactgtcactgcctgtgggctgcccgatgttgccgtgtcttgggggctggatttacagctcctcgtctcccggctgatgggacgcctggcttcccagtgcatggcgctcaagtctgtgcgccagttaggaagtaacatggtagtacctcaggcaaaaatggcattagtcctaagctccccactgtggaaacctgtcttcaggcatcaggtttgtccagagttggaattagaagcaagctggcccactcacccacaccggaatagtaaggagggtgaagtctaactcctcaatgtgacagtcaaggctctctgcagtctcctttcaccttacctatctgactctagttcccatcactccccagctgagacttcaggccaggttaagaacattcctgacgacccctgccgccattttcttcttgattttgcccagtcagagcctgctcagaacttctgtgggccatattcagaacttttcaaaggattcatacaggcatgtagaaaacaggccccaaagacagatat

SEQ ID NO: 171979 - DNA, 663 bp, Homo sapiens
cagctggtacggcccgcgtttgatatgtgaccaggcctcgcgcacgcgtgcgccacgcgtcgcccacgcgtcgcggacgcgtgggctgaaaaaaggtatgattatctggaatttaccgacgctagaggtcggaaaacacgctatgacacaaaagttggcactgataaatggcccaagaaagtgaccttcaaggccggtcctcggttgcagttcctctttcactctgacagcagtcacaacgaatggggctacaaattcactgtcactgcctgtgggctgcccgatgttgccgtgtcttgggggctggatttacagctcctcgtctcccggctgatgggacgcctggcttcccagtgcatggcgctcaagtctgtgcgccgtaagtgcacatccctgtgctttcccttcttacaaccacggtgaagtgcaagatgcgcgcttgccctcttgtaggtcgtttccacgtaatggcagggggttaataatacgccttttcagtttcctttaaaccgaaagaataaagtgtccactcaataccattgtcacgaagctttttgccttagactttggaacatagcaggaaggctgccatgggttctctgtctatggaggataacagcttttttttttggcaacattgtcatttttttgcaagtaggtgta

SEQ ID NO: 171980 - DNA, 168 bp, Homo sapiens
tctgctcactacaacctacacctcccaggttcaagcaattctcctgcctcagcctcctgagtagctgagtagtataacttctcatcatttgaaactactggcaattgagcttatctcagtttgtttcctgagtttgcacttgaagagaattatttgtgtgtatttttt

SEQ ID NO: 171981 - DNA, 338 bp, Homo sapiens
atatgtctttgtatatccccaacacctatatgatacctagcacaaaaatgttaaatatatgtttaataattaaattacattctctagtcagtgcctagagaacacatatactacgtcatttagtaaacagtgagttacctgcagaggtatcagacctccagggaggaaagttaacattgttttaaaaaccgcaaagtcgccgtgcgcggtggctcacgcctgtagtcccagcactttgggaggccaaggcgggtggatcacgaggtcaggagatcgagaccacggtgaaaccccgtctctactaaaaaaaaaaaaatacaaaaaattagccgggcatg

SEQ ID NO: 171982 - DNA, 481 bp, Homo sapiens
gatccttaacttcatcacatatgcaaagtcccttttgcaatgtaaggtaatgtttcacaggttctaggaactagggaatgcacgtcttaggcgggggacattattctgcctgctaccccagattcaaactagagaacctggtctgaaacaggtggcttaggaaactaccctgcggccacaatgaaagatgaatgtaatgagtgatggaggctaccttaccttctaatctcaatgagattttgtttcataagccccagcttttcattcatagtgatcagagcaattttagatcatatatttaggggttgtttcttgtctatcttattcactgaactgtaagctccatgagggcagagactatgcctatcttattcatcactatctccctcatgcctggctgtggcaaacactagaggtagcctcccaccagctatttctacctcctctttttttttttttgaaatggagtctcactctgttg

SEQ ID NO: 171983 - DNA, 278 bp, Homo sapiens
agggtatagtaagatcagaacggccaccatgaggctttcctccacctggctagtgcattttataggcttcccaatttgtaagagaaccaagaccacagagaaataaagtcattaattctaatgctaaaatcagttttatgggtgagaaattcccagcaaaccactgggctagggctggggaaggaaataaagcctttacctagtcttctgactagttactgggcagagcagaggctccataaggaccctcactagacgtcagtaggttacagagtgtg

SEQ ID NO: 171984 - DNA, 286 bp, Homo sapiens
ttcaatatcaattcaagctactaaaggattgtgataacaaactgacctgtaaatatgaatgaaatgccaatttcagacccaaaatgattaaacatgaagtgtaaaatagtgggtaagaggacatgagaggagaaaaaaggaaactggtaggagctacatataaaagacaactttgtaacactttttcaaaattgtttgtgttttatattactaccagggttacatcattactttctttggccctaagatttttgttcttgtaaactcttttttccgtaaaaataaa

SEQ ID NO: 171985 - DNA, 285 bp, Homo sapiens
ctggactttggggctatgtccacacccttgagcaaggtggagagttaagccaattatttaaaatttgtttttgagaccgagtctcgttctgccacccaggctggagtgcagaggcgtaatctcaactcactgcaacctcacctcccgggttcaagcaattctcctgcctcagcctcctgagtagctgggattacaagcgcgcagcaccacagctggataatttttgtatttttagtagagacagggtttcaccatgttggtcaggctggtcttgaacgcctgacc

SEQ ID NO: 171986 - DNA, 498 bp, Homo sapiens
agtatgtagtatgttgctttggttagtaggtaaaatatctgcagcaagcatagtttttctttttttaactagaggggtgtgtatgctcccagtgactcacatattcatgcagtaagtaatatagctttagatccaaaatatttatcttcattttacttagtaaatggtgagtaggtatttgaagactaaagaaataagtgagttttagtccttaaaactgggtttgtaatttatgccatttagagaatggcatcttacaagcatgtgaagtactaaagttatttctactttcatttatgttgtatcttggggaagggaagggcgtttctctggagagacttattggcttattctcatgttcccttcatggactctgtgccattcttctttatattgcaatataggtatacaatcctgaaaactgatattaccagggcaagtaacacaggatcccgttgtcagaatttgctgcctgaaacggtgaaaccaagggccatt

SEQ ID NO: 171987 - DNA, 304 bp, Homo sapiens
aaataaaacagtctatagcacaatttaaaagatagcatttatcctttgtgtcaatttagaagatataattacacgaagcaatgctgtctggtctgtaagcatttctacatacccaagattgcgtgaatgttaaaggtgttagggtttgtttatggggcaccagaggaggtaacaggagtgaggctggagcattaaagagaaaaataagaaagaaagcaaaatcgggatatggacaaatgatagagaaacaggaacggaaaatatgacggaattctatgcaccaaagtccacgccctataaaagg

SEQ ID NO: 171988 - DNA, 420 bp, Homo sapiens
aggaagaattgggcaatagattcgtcttgttttatctctttttctaaatcctatccaaagctccaaaaagatatatgaagctagtgtcatttgaaaaaaaaaaaaaaatgaaaaagctcacccctctaaaaaaaatggcaattatttttgaagtgcattagagttgtggcactaaagactgaaaacacctgaggttgcatgccagcctgtgacaggaagctgtcatctcaatgacttctgacaaaagaattaaactagacttggtgatggctgggcgagagacaacaaaaaattgagctagtgccatttcatactgcagaccaattttgaagatttaaaatgtaaatgcagtctaataaaaatgttaatgcacacaccctttgacccagcaaatccatttctaggatttggatatccaaa

SEQ ID NO: 171989 - DNA, 166 bp, Homo sapiens
catagagagagagacagagaaaaacagagagaatcagacagagagacatacagagagagagagaatcagatagagacagagagagacagaaaaagacaatcagatagagatagagagacacagagagagacagggagaataagatacagagagagagagagacagc

SEQ ID NO: 171990 - DNA, 473 bp, Homo sapiens
caggtggagctgacccagagctcgacccgccccaccaggagggagttccccagagctcagagtgttccagcagggcctggaaattctcttctgtttctaagattctgccatttgattctaaaattctaaggactctttattcttttttgtttgctttaattaacttttgaccatgtaatacatcgacatgattcaaaatacaaaaagcacaaaaaagtatacaaagaaagtctcctcactatctttccagacagattttaagcacatgcacatgtacatatgcatttcctttttcttttttctttaaacacaaacagtcgcctactccaccctctgttccgcaccttaacagaattcttggagctccttcttcgctgcattaaagcatccctgttggtatccatcccttgctcctgctccctggtctggatattccctgattccctaggcgtctagccagttccctgttgata

SEQ ID NO: 171991 - DNA, 528 bp, Homo sapiens
tattctgctttttcactttcagttttcaataaattatgtgagacattcaacacattataaaataggcattctattagatggttttgcccaactgtaggctaatttaagtgttctgagcatgtgtaaggtaggctatgatgttcagtaagttaggtatattaaatgcattttcaacttgtgatattttctatttacaatgagtttatcaggaggtaaaaccaccataagccaaggaacatatatattacctaatgtatcatcttctgaacatctcaagctactatgacaaggattcattttcagaagtttaatccttctaatccacaaaattaaagtgtgtacagttatcagaaaaataacacttcatatctttagtaagagtacaaatttgttgaatatttttaagggcgaatttcccaatatctactgaaagtttatgtgcaaatatcctttagcccagcaatatcacttccaggaaataacctgtagatattctcacagaagcaagcaaaaatacatgcagaaaca

SEQ ID NO: 171992 - DNA, 308 bp, Homo sapiens
actctcagatcagaaaatgtgggtgatacctagaaaatataaaacaaccgagatccaactaagaaaaagtaagcaaaggaaactgcagcaaagatagtggtttaggtcttcccaaaggagataaagagaggatccaagcttaaaatgcaaagagcaggggttaggggtgggatatcatcaattttatcatgtaaaatttgcattccaaatgacttagccaactaggcctctcctcctcttcttgcttaaagagttgacagcaaggctgtcagcttcaggattaagcccaggtactggtctaaagtatt

SEQ ID NO: 171993 - DNA, 806 bp, Homo sapiens
atgagggtctccctggttgccagaatggtctcaaactcctggactcaagcaatcctcccgcctcagcctcccagattgctgggattacagtgttttaagatttgaatgtgacgtctccaaattccagacacagcccctcatttgcccagtttgctactacaggccggcgataggcacagtgcggggaacctgcccagaagcccaggggcagatcagggaacgggggtgtaagcaggcaggaaaagccaaggcaaggggggggcgcgagaaaacctaggcagaagcatttcttgcacagctttggacgcaccacacacacaagagacaccactcgggcggccagtcacctggttctaggtggagaataggaaagcgatgatagaaataggctctctgagtgctctgcatctctgcaacagagaggttaaagcaaaacccaggcaaaggaaaaggagaaaccaacagaaagaattaaaaagaaccactcaaagcaaccagcctaccaaggagtagaggcgggaatgcaacatggcgcggggctgggaccctgggcttcgaggctcggggctgcccttgactttcccacacacggaaagcgctccgcccaggaggacccggccacggtgtgtgcgcaaggcagtggcctcctgtttcggtccgaggagccctctctcatgggagctacagagggcagagaccacctggcctatgtcagggggcacatgtgtaccccttgtttggcagctcggcccactgtggaggtgggaagatgaccagccgcaaccaagtggaggcagggggcgaag

SEQ ID NO: 171994 - DNA, 360 bp, Homo sapiens
tcataccaatagatgcagaaaatgcatttgacaaaatccaatacctattgatgataaacagcctcagtacactagaagtagagggaaacttcctcaacttgataaagaatatcttttaaaaaaaaaaaactcctatggctagtaccatacttaatgctgaaaaactcaaagctttccaagaatgatcaggggaataaagtaaggatgcccctttcaccactgcttctcaatattatcctacaagtcctagttaacgcaataaaatgaaaaaaataaaaagtatatatattgggaggaaagaaacaaaactgcttttgttcacagatgacatgattgtgtaaacagataatctgaaaggac

SEQ ID NO: 171995 - DNA, 393 bp, Homo sapiens
cttccagtttaatctctctccaatgtgaaaggcaaacaattctatactattgttgtttcatttttgcttcatcttaaaatttctgggaaaatataagcagaaataagcatgtttttgcaagacaatcaactggataggtagccaggaaatatcaagtcttaaatttaagaacaagccttaactcaattagagctccaattaaaaagtggaatattcaggaagcattcagccttccccaaaagaggttaagaggggaatggagagatcagaaagcaatggatctccactgggatgtccttagaaggataggtttcaggagaaaaatagacattttactaatcacctcataacctcctaaggcaggtgtctaatgtatgaactaccaggatggtc

SEQ ID NO: 171996 - DNA, 601 bp, Homo sapiens
gcgtcagggattcagagggccaaggcaagcacctgtgcagaacactagcaagctggtatagctgggagcatctgcgtgcacatgaaggagggtgtaccactgggaaaggggacgtgtgcacaagagaaggtatgtgtgcatgaatgggtgtgaactgggtgtgtcacatgtgagggttacatgtatgaaccagggcatacaccctcatgagtaggggaggaagggtgacacacacaggttgtgaacgtgcatgtgtgggaatgaatccaagtgctaaatctgtgtgtgcatgcacagttaagtgtgagctgtgaacctgcgttgacacaagtgtatgaaagtgtgagagaaaatgccagtgggtgtgtgcatgagtgtgctgtgctgcttatggaggctcagggaaggagccatctgctatggcaggcaggacctgagatgtctgctcctaatttcatctttctgagcagactcagaagaaacaccaaaacttgggacgggagaaagaagcctcatcttgaaccccagatgattctttggaaggggtcgggagcctgccttttcttgtccccgaagtcagccgaggtgccagtgtcctaca

SEQ ID NO: 171997 - DNA, 465 bp, Homo sapiens
taattcacactctttccctaagtgattacatggttaagtgttcttagtaaaaaacaacaaaaactgctcctacctgatataagcaaaaaaggggtttattataagaatagtaggtagttgagctatagactgagacacagaggttttggagtgaaaaatcacatctagaatcactacccagaactaatcagatgacacccctgctgacactgatgcaagggctggatgcagtagcctacaccactgatatcactggcttggaaactatcacgctagcctcactgccttcattaccccagaaattcaggcccctgtcgctacttccagagaagggttctcatcattccagatgttctgcatcactagtgtctaattcaaaatatggagcagttgcatctgattggcacagcttaagtcatgtgcccacgtctgagcttcaaggaaggccagcaaagagtatagtaa

SEQ ID NO: 171998 - DNA, 189 bp, Homo sapiens
acaaataaattcacgtcttccaccatttgttttcaaatagggtaaaaccaagattaaagttccctgctcaactgctatgtcataggtttcagtgtttcccttccttcttaatttgcttaaagaaaattccaagaggttattaaagaccttgatgccatattaagaatatttcctgggaaaaatgtatgt

SEQ ID NO: 171999 - DNA, 505 bp, Homo sapiens
atattaatatagccatacctgctttcttttgctgattttttgtttgtttagccaaatatgtgtgtgattttagtctgatgtagcatgtccatctcttcattgttaataacttgaataatttttccttctacattttaaacaacatgtatgtcctaaaactttcatttcaatgccattttcaaacagacactgtaacagtggattggtaaaacatcagtccagacaatgatttgatttttgcagtttacctccttttaagccaataacaatcctgcattttgagttgtgacctcaataaactaggctctcactggttgttcccacagctcttcagggtatctccaggtcaccagcgtgttaatggaccctgatggtattaaaaagaagagacattcaacaaccaggctccttttccctctcatgtttaccgcattgtagctttatgttttgatttaaaagttttttccttactggggggagaaagtatcatttttcatattcaaag

SEQ ID NO: 172000 - DNA, 172 bp, Homo sapiens
tggatccaagagatcctcccaccttggctttccaatgtgctgggattacaggcatgagccactgtgtccagcctgagtactggcattgttaactgagggtgagacactagggctgaaagtcaagggccacaccggtgtttgagatgagtcaggctgggagggttccacggca

SEQ ID NO: 172001 - DNA, 373 bp, Homo sapiens
ggagaatcacttgaacctgggaggcggaggttgcaatgaaccaagattgcaccactgcactccaccctgggcaagagagtgagactccatctaaaaaagaaaacaaaaaaagaaaacaccattaaacaccagtccagggtggctctgacatcccggggtcttgttctagcattgaacctggcagtgcttgggatcatttcagcttgttaacgtgcatggtttagctctcagagtgttttgttttgtcttgttttcattcaggtgcttcatttgaaaattaatagccccatttaaaaacagcagtatttcctatgaaaatccagatttctagccagtcttaaaaaatctgaaggtccattaagtctgtgcctga

SEQ ID NO: 172002 - DNA, 473 bp, Homo sapiens
gtgatttattgaggtaaatgtttcgaacccaaatgaccactcctttcttctctcttcaaatcctcaccactcccagcccaatcttattcctcaataattatttatcgtctggaagagtcaggtgtttcaaatgaggccagcatggacttttcccaacagggaggtattttttaatatctaaatgtcggcctatggcccttgctgttaaggctccagatcaaataggggcaaaaggaattgaaagccaaatcacaaaaataagtaaaaactccaactaacaagaatttcacaacagacataagctgatgactattttattaaagcaatgtggagtactactaaatgctactatgttctggaaatgtaggaaattggttgaagtcgtttttctcttgttagtctcatgttaagctgttcatactaggatctcttgggttattttttcccaattaatacagttgtctactaattta

SEQ ID NO: 172003 - DNA, 453 bp, Homo sapiens
cctttcccttcttagggaaatcatatatataaaatcatatatataagagactaaagcagcatttaaatgtggcatgttattaaaatataaacatacaatatatgaaataatagtattaagtatagttttaaaaagtatcctggttagtcttacaagtcaagtattagcagcttcattaaaggagcattctacagcttgctgtctgtcacgaatagttttcctatttgttgttacatgcttaaatttgataataagaatataataattgaggctggaaatagcagtaaccttccctaagggatcacatgttttattagctgtgggtaaaaaggattcatttgtggaccgtatctgtttcatcacaaagtcctcacttagggtcatgcttttaaaactaaaatcagattttagttttaggaacattagactacctccaccagatcctgcacagta

SEQ ID NO: 172004 - DNA, 203 bp, Homo sapiens
cctaggtgatccatatccgatggctgttagatgttggagcataaaagtgaggatatctttgttcagttcaggaccctctgaaaagttattcctgctccagagctcccctggggtcaaggaaggctatctcaagcctgaagtgcagtacaacttctccttctgcctaaacctgcctcctttctctctcttttataaatgttaac

SEQ ID NO: 172005 - DNA, 677 bp, Homo sapiens
caggcttgcaatttggtgtcagcagagacatcctcagcctagatttggtgggacttggtgcaggtgaatacagggattgatgtggctgtgaatgggggtggggtggtggctgagccagattgcaggagaacagggaggaatgggaaaggaaaagagggaaacccccaccccagggaaacccccaccccaattcagggcatctgtcagaggcaaggtggcaggagagaggaaagtcaggaagtatgatgagtataaacccactcaagaactgcaggggcctttgctgccttctgcccaattggccttttgtcccatgccatgttagcaagttcttgtcttttatggattaatttggtcatttaaccaatatttattaagtcactcctctatgctaggtgttggatatgcagctgttagcaaatcagatagaggttcagttctcacagagttgtgtccttgatgggggtaggggacaggcaaatgagcaattaaccagacatatggactggcccatcctggggcctctcaggacctggtggttggctgccccttttttctggtacttagatgtatgctatgtcctcacttggaagatatttctattcctcctgactgggtccttcacaatctgtattaaaactcacattgataaataaaaaaatttttttcagattaaa

SEQ ID NO: 172006 - DNA, 753 bp, Homo sapiens
gtttaatactgagaatcagagtccagccagagaccatgaaggcagaagggggcccatggggccatcttcccttgtcccctttacattatttatggacaggtcaaactgagaccctgagagggcaagccacttggccaaggtcacagagcagcttgctggcaaaaaagccgtatcaccccccacttcttgctgcaggggagttgcaccccatgcgcagctctaaaagctggtgcagcatttccaaagtgtgttctgaaggacactttggagaggaacagtgggcttggtggctttagaggcctgtgtccacagctcacaccaggcaatattctgggcttgaattgcagctctgcacttcggccagtgacttgtgcctcacccctactactccctttttttaagataggctggtgatagtatgcagcctcagagggttgtcatgagccacttagagaacacagcctatgcaaagtaaatgcttattaagtgtaggcattggcccagaactgttctaccacggggtgtggggatgtggagacaatcaggaagactggtgggcatacactgagcggctgcagaagccaggagcctcagagatgagaccaacgtgtgtgcagcactctccacaagctggccccagtcacttatgcatcacatcggtacagcaacccttatgaggctggccttgcggggaatccctgtactacgggcatagctgaacctacccgccgacacttccttccaaggcaggcc

SEQ ID NO: 172007 - DNA, 426 bp, Homo sapiens
gaagctaaaatataaaacttttagaagaaaactaactcttttgacctgagttaagcagtaaatctttgtgactttgagttaggcagtaatttctttgatgcaacatcaagagcacaaataataaaagagaaaaaagttgataagttgaacttaatcaaaataaaaaacttctgtgcttcaaaggacaccaacaagtgaaagaacagccccacagaatcagagagcatatttgcaaattatactatctgttaagggactagaatataaaaaacacaaatcaataagaaatgacaaatgatctaagttgggaatgggcaaaggattacaagatatttttcaagagaaaaatatgcaaataagcacatgaaaagtcactaggaaaatataaatcaaaagcacaatgagatatcaattttcacccactag

SEQ ID NO: 172008 - DNA, 661 bp, Homo sapiens
tcatagctgttctagaggtatcccggtcatgcgacaaagatgcccacctcatcctaattccccaaacctatatgttttctttcatggcaaaagggaatttgcaggtatgattaggtcctgatacagggagattatcttggattatctgagtgggaccaatataatcatgagggtctttataagagggaggcaagagaattagagtcagagtgtattactcagagctttccagagaaacaaagccaatgtaaagtgtgcacatacacacacacacacacacacacacacacacacacacacaaagagaattgttataaggaattggcttacatggttataaaggctaaggagtcctaagatctgcagttagttattcggagacccaggaaagccaatggtgttgtttcagtccaagtctgaaagcctgagaaccaagacagtctgttgtgtaagtttcagaccagaagccacaggctagagactcaagaagagctaatgtttttgaaggaaaacaaaacaaaacaaaatgaaacaaagcaaaacaaaacaccaatgttccagctcaaagtggttaggcaggaaaagtttcctcaaacttgagggagggtcagcatttttttctattcagctttcaactgatcgagtgaggttcacccacatt

SEQ ID NO: 172009 - DNA, 525 bp, Homo sapiens
cagcattgtggctgtccccacagatttcaatgtggagttaagctgccgagacccccacctgccctcctgtgtgcctcaggcccctcctggtcccaggtcacccacaccgtctggcttccagcgagcgcttctcggagaaacagccggctccccacagccagtcttggtcagtcctgagctcgggtattccacagtaaagtgagcgacatcacctgtctgaaaagcataaggagactcccacgtggcggtgctgaggggccacatcctgggcaccaggccagccagtgccccgacatgagtgttgctggctgggaagcagctggcatttggattgaagtcctgcaaaaactgccatggccagagcctgccaggcagagcctgcacagagtggcccaagagctgggcacgtgctgggcctgggtggatgtggaggctgtgccatggggtgcgggggaccctgctcacagctcaccttgtggtcacccagcactgaccccgttcacagctcgccttgtggtcacccag

SEQ ID NO: 172010 - DNA, 1052 bp, Homo sapiens
  misc_feature (598)..(598): n is a, c, g, or t
  misc_feature (771)..(771): n is a, c, g, or t
  misc_feature (1009)..(1009): n is a, c, g, or t
gaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaantgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccggacttcaaatggaaggaggaagagctngatctgaagaatgctgaagtatgttgaagacaactcctcacccagtctctccaggactagtatctgatagtatatgatctcttaccttttattttctcataattgactattgggagatcaggagtcacaaattcctttttcttggcagtttctccatctacctctgacttagagtttattaaaaatagcctattcttcaatatttcaagatagaaagtcaattcatagccctttgtgnaggaacaggtatacctgaagaatgctgtactaatgaatcatag

SEQ ID NO: 172011 - DNA, 1124 bp, Homo sapiens
  misc_feature (598)..(598): n is a, c, g, or t
gaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggaaatcaantgaaaattctcttaaaaggttaagtgtctacctagaaaacctccagaaaccaggcttcaagtctttgaaaccaactcagcttacattttatgtaagagaaacagaccagagttcctccgatggccaggaaccttttagtacttccgttatctgtgaaacatatcaaagttgaatactaatatgcataccagctctcaaagaagctaaaaggaggctgacaggcccatcaatggacaagtcttattactccttacctttatttacaggaccctgcatgaagaccttgcaccaagtctcgagagtggacaccatcttcaaggcttacgggagaattgagtaaattctctgggcacacctggaaaaaattctcgcttgcttcaagttatgtggaacgaacataaatctgttaccccgggaaattgtgacgtctcgtttttctcacaaagtggcattcgcaacagatcacggcgtgactgcaacagagtgtcaccacacgaaatagtaaacgtgcgagtgaaatggggcg

SEQ ID NO: 172012 - DNA, 980 bp, Homo sapiens
gaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactcaattaatggatgcctcgaagttgacgtacatatatattcagaaatgttttgccacctgagacctatgaggaggttatgtctagagaagatatttccacactggtttcccttttcaagagctttatcgggagctgaagcagtcaatgccttgaggcctttctattttgcagtacatccagatttctttggacagcaccccgtagaaagggatgatacatggaagagttttcaatgccctagtgatttttccttatgatgcatgctgctggaccactcccctacaacatcagttaatgtgtgctccaggaatacaaactgatatgaaaaatgacttatggtagatgtagttaagacagtcaatatattttaacattagaaaatacagtcagtccttcatatccatgggttttacatccatggattcaaccaacctcagactgaaaatattaggggaaaaaaatacatctgtactacacatgaacaaacttctctttctgtgtcattattccctgaacaacacaggataacaactacttacatagcacttacattatattagatattataagtaatctagaaatgacttacaagtatatggg

SEQ ID NO: 172013 - DNA, 1193 bp, Homo sapiens
gaaggcctggcacgctccagccaaccagggcgtcacctgcagctcgtccccctgcccgggcttgcctcgagcgccctgccgccgccggagcggggagggtgttgggggcaggtggagccgggagggcccagctgagaattcagggttgggggctcagagggcactgcggctaggagcccgtcaaagcctgtcgcccaccggggcgagggcaggtgggagcgcctggccgtgcgtcgcgcgctggttggccagctgacgccccagtgcgcatgcgcgtccgaacagccctgcgggcggagcgactgtcctcccttctggtgtactgggtgggaggtggaactagtcggacaaagccctcgcgtcggacccttgccagaactgaaaggcaccatttccttagagaagaccttcctgagctctccccgccccattccaagtgttgcgtctgggagtttctcatattctgtgcatgtttgtattattgcatttactgcgttgttttatacttatctgcttgtgtctgtttttacactcccccctccctctaaaagtcttttgagtattagaattgtcttaataattttctagtcccaatgctttacgcaggacctggcccataagtggtgatgaatgggtgagttaaagactcggtatgcctcccaagtgtgataagacagtgcaacctcttcagttattttatagcattttccaagtggaagtatagtgggctaagtgcagtatggacaggaaccacctatgtaagaatttatctgaagacgagaagcctgcggttgatgtggatgtcccagacttttggagctagtgtctgaatgagagcacccaactctactctgaagcaatgtgtcttcagtcagctgatagtaatttgattttctgtgtagctagtcctgaaagaggaagaacattagatctgaatcttctagttgtcttagcagttataatctcaaagtaaatttacagattgacattccagttatcaggccttctaatttagcttccccaaggcccacgtatttctgtcttgaagtgataaaattgggttctgttcttacaaggttgaagactaacccaagatctgggcgttgtgaagcggcaggcagccatgcctgccaacctgctggacattgtctctacttagaattttggtttttttaatctgaaaagtacataaa

SEQ ID NO: 172014 - DNA, 543 bp, Homo sapiens
ggaatacaataaacaaaaaatatgaccgtgaaacctcttctggtcatatggtcatgtgtgtagagtggtactctgcagaacatacttcagaaaccactgacaaaaaagaataccaaatgcgaatacaaggaaaatctcagtttcatgaactaagtacagcgcatagaagtagttttgttaaaaagaaacattttagagcttgatcttagagcatgaaaagtctcaaatgaggattccactcattcactcagaaaagatcctgcaggatatggtaagaaggaaaggaggaaaggaaagaagggaaaacatttaatgaacatatgctatgtgcaaatcatgacaggaaaaaggacagaacatacatgagaagcagcaagcaggtcatcctggccaaagcataatatagtgaaagacaagactagatctaatatctgactagatagaaaaggatttaaatacacagtttagatgctatgacagtcactaaatttgttttttttagtagaaagacaacatgagacttgtcatatcataaaagcaacc

SEQ ID NO: 172015 - DNA, 259 bp, Homo sapiens
tccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccgg

SEQ ID NO: 172016 - DNA, 249 bp, Homo sapiens
ctggaagagttaggggtgctgagcaaggagcaattcagaaggtggcggggagttcccaggactgcacataaaaattaattacagaaaagaaatacatcattaacgtcagatctcacaataggtcccagtgtgactattatgtgaaattaattactccctactttatttttttaatcaccttctccgtactctgaaaatagtcctaattactgacattagttgtttaagtcattaagggtgatcatgtta

SEQ ID NO: 172017 - DNA, 187 bp, Homo sapiens
acctagatcctccataagagcagaatttactgataaattgttttgattttaggatactgactgcagacctgggactagggtaatgtaagtgaggctcacagggtgcaacatttccagaagcacccactcgcaggtgctgaccctgcaggtgtcacaaatctgagaatccatgcctctgtaaaatttt

SEQ ID NO: 172018 - DNA, 224 bp, Homo sapiens
gaaacagattgggagcaaaccacagtagtataatggggtattgtgtaatgtccttccctgttcacgtgaggcctggaagtagtttaaagtagtcaagtagagcttctcaaatgaagaatttcattcagtctctgctaaactacaaaatttatgactcaaattggaaacacggtgaaaattttgagtcacagttaaatgtttaagtagtttaagataaatctgtt

SEQ ID NO: 172019 - DNA, 1935 bp, Homo sapiens
  misc_feature (1384)..(1384): n is a, c, g, or t
gttacatgccaagcactaatcaggatgctaaggataccgcagtgaaacagtctccgccccgtggggcttacattcaggcggggaatactgtcaataaacagcggtaatggagaaactacagcagggcgaagggaatggacccgagacgttggtagctacttgattttcaagtccgagagggcctcactgataagaacactggagtattacttgtagtctgaacttgtgcatttcttttgtgtattccatttgggcataaaagaaggaagattagtaaaggcagtttatgggtgtaaaattagagcagcagcacttattgaaaacataaacaatgaagttatggctgatattgaccacttatacctcaagcaccgtactaaggctttacatcgattattagttatgttaatttcccaccaactctaaggggtaatcctattattattttattgataaaaagactgagacttaaatttgctcagtgctacattaccaaagtgaccggactggaatatgaacccagcccccatcgtgtgctcttaacaccgcaatgcacagcacagtaaccaggaagccttagctgtgtttggtaggcactcatcatttaagatgctgtatgcggccgggcgcggcggctcacgcctgtaatcccagcactttgggaggccgaggcaggtggatcacgaggtcaggagatcgagaccaccgtgaaaccccgtctgtactaaaaatacaaaaaaaattagccaggcgcggtggcgggcgcctgtagtcccagctgactacaggctgaggcaggagaatggcgtgaacccgggaggcggagcttgcgatgagccgagatcgcgccactgcactccagcctgggcgacagagcaagactctgtcttacagaaaaaaaaaaaatgctgtatgctgggactgtgctactagatcttgtttattccttccaaaagccaagtgaggaaggtactgatattgacctcattttacagatgagaaaacagaggttttgtatcttgcacaatcagtaagtggtagagctaaatattaaagctcatgatttattcactatcatacactatttcgtggttactcattacgtctctaagttttgtcagccaacgtgtgaatgaaaatacaactactcacaaaggaaggccaaatgagcaagtgaatcagcacaaacttattttcttagttaaaagactcaaggaccatatgatttcccgagtaatcaaaggacctactcttaagttttgtcagcagtgtggctttaaggtttttttggtttttttgttgtttgcattatagtaggttaaactggctttatcaaagatatagtatttcaggctcacagttacagaaataatactaattattnatttgatgcttaatgtgtatgaggcactgtggtgatttttcatattccagtactccagcctgggtgacagtgcgagactctgtttcaaaaaaaaaaaagcaaaaaaacccccaaaatttatatttcaacctaagatgtatttttatatctctacacatacatacgaaagaaaagtttcacaaaacaatgcctaactttgcagcatatgagtcatgctttttctattgtttttactttttaaaaaatgctaatcaagatctactcatggggctgggcctggtggttcacacgtgtaatcctagcactttgggaggccgaggcagagagatcagctgaggtcaggagttcaagaccagcctggccaacatggtgaaaccctgtctctagtaaaaatacaaaaaactagctgggcgtggtggtgggagcctgtaatcccagctactcgggaggctgaggcaggagaatcgcttgaacccaggaggcaaaggtttcagtgagccaagatggcgccactacactccagcctagacaacagagcaagactccgtctc

SEQ ID NO: 172020 - DNA, 453 bp, Homo sapiens
aggctctgcactttaaagcagtgtcatcattctgtgcagtgcggagctctgaggaggtctggtaggcacagcaagtggtaggaaacctgttaacagctccaagaaaaacaggtatgtaccattcctgcggttgctgacctctttgtggggtaggacttgactgataattcgggaggcatgatgcatcctcactagaaggttttgggggtgggacagatgatttgggcatgggaaaattagtcataatcataattacaaactttaaaggaatgcttatcaggcaccaggtactgtgccaagagctttatgcgtgccttcagaagttcatgctttcttagcattttgcttctatctagagatgtgctgtcttcctgaagaacaaatccaaatgtgcaggaaagtcagcttgatgcttaaaatccatcatgttggaaataaatggtatacaaatca

SEQ ID NO: 172021 - DNA, 334 bp, Homo sapiens
cactttttacatatgagactaccatggtatgaagttcaattatgatgactgatttataaacatcatttcttgtttaacgtgggtaatttttaaaagtatgaactggtgagaatgtcaaatggtgcagccaatttggaaaagtgtgacaggtcctcaaacaactagacatagagttactgtaggagccagcagtttcactcctgggtatctgtcaagagaactgaaaacagatgtccacacaaaacttattcatgaatgcttacaacagccttattcataacagccagaaggtgcaagcaactaattgtccatcagctgatgaatggataaataa

SEQ ID NO: 172022 - DNA, 330 bp, Homo sapiens
aagaggcaggggagctatgttattcaagctcaagaaaagtatgaaagtaaaggcttctgttatgacactgggttttacctgctttcccattgttgtgttacaaaccaccccttactttttattcttttcacaatctctttccacgcagacactccatgtggttagcttggacttcctgacaacatggtggcctcaatgtatctggatttctcatatgaaagcccaggactcttcacgaaggccaagacggaagctgacagtcatgtcaagagctaggcctggcagagtgtctttttccactgaactcagtgcaagcagggtgaggtcagc

SEQ ID NO: 172023 - DNA, 515 bp, Homo sapiens
tgcacacattttgtaccttttgatatttttctaaagatcactgaggctattaattttttcatatttttttctcctgttctctagattttgtaatttctatggatataacatcaagtttctgtgtccttcttctgacataagctgttggtttctttcaggtgcctttattagattgaagaagtccttttttccagcaccatttattgaagatactattctttcctcattcttgttcttgacacctttgtagaagattagttaaccttatatgagtgggtttatttctgtgatttcaattctgttccattgctctatgtgtgtttttatgccagtactctgttttgattgctatagctttataatagaatttgaacacaggaagtgtgatgcttctggctttgtccttactgtatggttctctttctgttttttaaaagtcagtgttggttgagctttttttaaaaaaatctgcaattcaatatttttcatcaatatttttttctctccctttttgg

SEQ ID NO: 172024 - DNA, 248 bp, Homo sapiens
tgtcccagtctgtgcttaaagcaggatgagaaagctttgccacaggaaatgagataatgcatgtacaaactcatttatcttctcaggaaaatacattactttaagttgtatctttatgctctacacattttaacagacacacagcagttacccttggtttttcttctttactgtcactgattcacaatcataattaaaaatgccaaacgcatctttatgtgaaacaaaataatttttttcttattttt

SEQ ID NO: 172025 - DNA, 173 bp, Homo sapiens
tggaaataatatactttactctctggctcactgtaaatgtgcacagactccaagcaaagctcctgtctttcgggcttgagttttagagacaaaggtttgccatgcttacaggctgaatgtttttccctactgaacaaactagccagcctttatttcaagccgaatcactttgt

SEQ ID NO: 172026 - DNA, 393 bp, Homo sapiens
agagatcagagacagagcgacagagcagggaatagagacaggagaaggcagagatgggagacacagagaagtggggatggacagacagagaccaggagtcgcagaaagacaggatggtgaaaggcagagcagagaagagacagaggagagtgaggaacacccagcagagagacagagacacagagaagaggaaacaaagagacttggagaaccagaggcagagatagtgcaagagcagagatcagaagagcagtggcgggttgggggccggagagacagggagacagagacacagagggagtgaactgggcagaggcacggagggggacaaagtcagcgaaccgcttctgctccaggtcccccggccaggctgaacgttttgggaggggctgg

SEQ ID NO: 172027 - DNA, 607 bp, Homo sapiens
aaacacaaagcataaaagatcacagagaaacctttacagtcactgccacataatgacatttcagataacaacagactgcacaaatgatggtggtgccttagattgtaacaccatatttttatggtatcttttctatgtttagatatacaaattcttgccattgtgttacaggtgcctacagggttcagttaaatgacatgctgtacaggtgtgtagcctggagtgacaggctattccatatgccctaggtgtgtagcagactaccacctaggtttgtgttaagcacatgccatcatgtttacaaaacaacaacattgcctaacaacacagctctcagaacgtaccccctcattaagtgatgcataactgtatttaaatggaaatcttattttgaagtgctttaattaaaataagatcttatgaggctatactttttaccactgaccttttaaccaagatcttatgagactacacttttttccactgaatatgtaaaagaaaactaagaaaaaaaccaaaatactctactttttaaaattttcccaagacattagaaaaaaacctaagtaccataatcttctgctttagtatactgttatttatttaa

SEQ ID NO: 172028 - DNA, 134 bp, Homo sapiens
gccactcctgggcgcgtcccggggggaagacgccaccgccctggagtctcaggggtcctcgccccatcccggtccaggccgtttgtgtatctttgtaaactggcaagcgcggtaacttccttccctgaattaaa

SEQ ID NO: 172029 - DNA, 266 bp, Homo sapiens
atgccccagcgcccacaggcacccagaggctgcgtgcaccctggtggtccctgtcgaagcggtcacggctcaccgccagacacccttggtccttacagctctggctctgccagccacagacatcttcaaacagagcccatgaaaagaaacactgcttcagctttgctcccaccgccatcctgggacccagggtccacaaggagaatattttcttaaagtaactccctgatttgcgggggtttacctgccgtaggggaaatttttta

SEQ ID NO: 172030 - DNA, 545 bp, Homo sapiens
ttggataaatagctagaagaagatgagtggatcttacattaaatcttgcaggaaactgttactctgttttctcaaatagctgtaccattttgtatttccactagcaatgttcaagagttctagttcttcagcaggggcacagtggctcatgcctgtaatcccagaactttgggaagccgaggccgtcggatcacttgaggtcaggagttcgagaccagcctgaacaatatagtgaaaccccgtctctattaaaaatacaaaaaaattagctgggcatggtggtggacggctgtaagctactcaggaggctgagacagcagaatcgcttgaatctgggaggcagagattacagtgagacgagatagtgccactgcattccagcctgggtgacagagtgagactccgtctcaaaaaaagaaaaaaaaattctagttctccaacattctcacctacactagatatcgtcagtatgttttttttttttaacctacacattctaataagtgtgtaggtgtatctaagtatggtttcaatttgaattttcc

SEQ ID NO: 172031 - DNA, 392 bp, Homo sapiens
ccaggaagcagagttatgaagcaggtaagggataggtgtgacctgctgtagggagtgataccgaaaatgacggagtgtttttgataagcatgtaggtggtctacagagctctcagttgccaccagggagaggaatgccaaggtggagaaaagcatctcagacactctaggatcgactgtaggcagctgagaggatggtagtccactgacttacacagagagaaggaaaatgtcaaatacattcctgcacttgctgtggaagcagggaggtgtaggaggcaggagtttggaaacaaatatattggtgagaactagcagagcagagttttggagaacacggacgtggttgcaagacctaaggaaaggtgtgtagtgtgagatgctacgaggaaa

SEQ ID NO: 172032 - DNA, 228 bp, Homo sapiens
acaggcgcccaccaccacacccagctaattttttgtatttttagtagaggtgaggttcaccaagttggccaggctggtcttgaactcctgacctcaggtgatccgcctgcctcggcctcccaaagtgctgggattataggtgtgagccaccgcacctggcccagtgtgctcatttaaatgaacatctcctgtctcgtaggcattgttctagtgttggggataacatca

SEQ ID NO: 172033 - DNA, 309 bp, Homo sapiens
atctctaaatcaagaaaggattcctgttctcattttctcccctacataaagccaagttcaggatgaaatctcacaatgatgtatgagaaagggtacactttctagacccagtgtacaacaacaaatacaaatttaattacatcacttaccggtttaaagtccctccagtagcttcccaaactctacacagtaaaacacaaattctgtcaatcaagcttttgaaagtttctttatgacctcctcatcgtttcttccccagtcataggtgtcagtactcaagacttcaatttgggtacttttagctcccca

SEQ ID NO: 172034 - DNA, 675 bp, Homo sapiens
cagatgagacctctcccccttgggcagggccatctgctttacttagtctgctgatttaaacattagcctcatgcagaaacacccccacagagacacccaggataatgtctggccaaatatctgggtatcccatggcctggtcatgttgacatataaaattaatgatcacatgaagtagttattgcagggggctgacacctaagggctccccacagcatccctgcaccagggaggggaagacagatgcttggagctgggtggtggtggtggtggtggaagtggcaaaccgtggtgacattctggctgtattttgcaagtaagcctacaggatttgctcgcatagcagatgtgggcgatgaatgaaagagagaaatcaaggaggatacccaggttttggtctgagccacaggaaagacggggctgccactgcctgagaggggaggactgcaaggaggcaggctgggtgaccaggagctcaccgtggacgtggggggtttgagagcctgttcagcatcccatcaggggtgtcaaagatgcggttggatataggagtctggagttctgggaacgactaggcaaggggtgtaaacacggacatcatctgcagatagggtagaatctaaagacagcatctgaatgagagcactgaggtagggaggagccttcccctggccg

SEQ ID NO: 172035 - DNA, 433 bp, Homo sapiens
tgtgttttaatcatttgtggtaatatcgtataatttatgacctcaacttttgttaaataccttcatggcaaaggcactatcagaagctgctgcaaaacctcacaccatcagcactggtgaaggagaaagccgttgctttctgctttcttctgtcttcctaatcttgcatgagtttatctcactggaagaacatagatcacatctggaattctagaggcaagagggtctaaaaattgtagtgctgaggcttccagcctctgtagcacaaaaaagagcatggggcacagaagaatacttataacaaaacaacaacaacaaatgatatccagcacacttggttttttaaacaattttttatttttattttttagagatgaagtttcatctcgtcacccaggctggagtgcaatggcgcaatctcaactcactgcaa

SEQ ID NO: 172036 - DNA, 201 bp, Homo sapiens
ggcatctgctaggccttgttgctttgctcatagcagacattaccaacctaagccttcctgctaagcctagacttagcagactacattattacacaaatcagtcagcattggcatctatttgtcatctattgttagtaattccctaagacagctgaactaagacctatagaatgagcagaaaagaaactgactcagagcggg

SEQ ID NO: 172037 - DNA, 489 bp, Homo sapiens
cagttctagactcctattctttagcattccgttacgtccagaccatgtgacaacctccattctacaaatatgtaaccacaaagaaggtgagtggggaggcaataagaacccagactaacagaacatcagaaaagctggcatacgcacacataaagaagggggagaatataggactatatgggagggaggaaggtcacagaaaatgattacggttttgatgttgtatttgtgaaggtgaggaatactaactatatttctttagtctttgaagatcaccatatttagccattatctatcaactgttaagccttgggtaaacttcatgtccttgcaccactcaagttacacattggctctgtgaaatatttgcaagtggtctggcgcggtgggtcacgcctgtaatcctagcactttgggaagcccaggtgggagaatcacctgaggtcaggagttcgagaccagccaggccaacatggcgaaatcccgtct

SEQ ID NO: 172038 - DNA, 220 bp, Homo sapiens
atgcctggagagggcctggaagccctgtgccacacccccatgccttgccctatgtacattttcatctgcatcattggcaacatcctttataataaaccagtaaaagtaagtaaatgttttccagagtcttgtgagccattatagcgaattatcaaacctgaagagtagcttgtgggaagtcccaatttatactacaggtgacaacttggtacttttgaca

SEQ ID NO: 172039 - DNA, 367 bp, Homo sapiens
cttcagagctggcgtgtacagtgctacattttaaatacctgagaaattattccagggacatactgggaagcattcttccaaaagaggaacccttttccaaattaaagatagacaggtcactaacatagttaacatcaactaatcatagaaaagcctaagagtatttgtcaaaagattgaaacatttggcaaatctaattaacatacagaatagctgtgtaacgtttttttttttggggggggcatattgtagatgaaattgcaatcgcaaaattacacatacaaacacacttttcagggaaaaagttatttgggtttcatcaaattcacaaaggaggggccataaacctgcaaaacataaaaatgat

SEQ ID NO: 172040 - DNA, 317 bp, Homo sapiens
tgagggaaggagtgactcctgcggtggttaggaggcaagtgagacctgggcatctaagaccctgtagaaagcaatcgccttttgtgtttgtgatagagactcagaagctggtgctgcttctgtccctctcagtatgaccccaagcctccccagaaaaggtctcttccaactctaaagtgaatattagaatgtgagttattcattttctgtgttttctgtagcagatttttgtcctggagattgccttctccagccctctgcacactttggtttgctttcccttttgatggttagtgactgcttaatgaatgtaagta

SEQ ID NO: 172041 - DNA, 170 bp, Homo sapiens
agtctggaaagatggcactgttgaagatgtcattattattataggaaatgccatgaaagtctaaacaaaagatttctatgggagaaaactgtgtccagacgtagtacatgatttcacaggatttatgatagagccagtcaaggaaatcatgaaacagattgtggatatgg

SEQ ID NO: 172042 - DNA, 352 bp, Homo sapiens
tagccaaatggctaatttcccacatctataaagagttcctgcaaatgaataagcaaaaagcaatggcaaaaatggcaaaagatatgaagagacagttttatagaaaagaaaacacaagttactcaaacatgtgaaaaatgccgaatctaactcacccgaagggaaatgcaaatgaaaactacagcaaggtaccacttttcacccatcaggctgacaaaagccaataaatcagctgatgctttatgggcaagggtgtttttatagaacaactatccattgctaagagagcatgaatcggaggcacttggcaaggaggccatttggcaagatcaaaatgatgaaagtacacatt

SEQ ID NO: 172043 - DNA, 425 bp, Homo sapiens
tttgtagtttgggtaatatatcctctctgctgtaaatgccacgtgtagttttattttcatacttcctcctttgcttcctgcacattcagtgtgtctgtaagtcagtgttagagtttctgcaagagactgaatcctgaatgagaagaaagtactgctaaaactaaaaacatttttctttttccctcagttgtggaataaactagttttcagtggttgaaagcaaaaatccacatcttgttctatcttgatagtcttagaagtgcctagggaaagaagtaagaaatgttcattttagatttctgtaacctcagtagtttgctggtagcaaacatttctttttgtgtctagcaagaatagggtcttgtggactccattctcaagaatggaaagattaagtggttttttctccttcatcttataagtgt

SEQ ID NO: 172044 - DNA, 178 bp, Homo sapiens
ccaagtagctaggagtacagttgtgcaccaccacacccttataatttttttttctcttaaagccctgagcttacttctctacaagctaatttaaaacatttttttgtagagacagggtcatgctatgttgtccaggctggtctccaacttctggctcaagccccttagcccccatttc

SEQ ID NO: 172045 - DNA, 346 bp, Homo sapiens
atttattgtctgtctcctctatcagaatataagctccttgagggcaaggatctttgtcttattctctgatgcatcttaagcacctggcacatagtaggcgctcaataaaagtaactggatgaatgaatacatgaacacattaggtatactgtacagcatactgttcaaggaaatgctatataactgtatctttttgaaaatgttacctgttgccctacaagataacttatccaagttagtgacaaattatttttcttttctcttttatctgcttagtagttcagacattctcatttttagacatttctactagtggtctgaggctatgggatacacacgtatatat

SEQ ID NO: 172046 - DNA, 367 bp, Homo sapiens
caactttggtgctaggggaaagatgatattttctccaccagatctgtgattaaaatggatgctcccgtgcgggtggtgcatgtctattacaacccggtgggggatgctctcgtgcgggtggtgcatgcctattacaacctggtgggggatgctctcgtgcgggcggtgcatgtctattacaacctggtgggggatgctctcgtgcgggcggtgcatgtctattacaacctggtgggggatgctctcgtgcgggcggtgcatgtctattacaacctggtgggggatgctctcgtgcgtgcgggtggtgcatgtctattacaacctggtgggggaacaggtaggtgcatgactattacagcctggtggg

SEQ ID NO: 172047 - DNA, 464 bp, Homo sapiens
aaagccacgactgcttcaagtttaatgaaaattgatccccatgacaatagagagtgacgactctacaggtgcgctgggttttttgttctacttaatttaaattcctgaaatgggagagagggaagggagtttaggaatttatttctattagaatatagaagttattgcaaaaccctaactgtaaaaacgcaccaatataatcggactttgcatacagtagctaagagaatccaaacatttcagtgaaacagtgaatttgcctggagggcagtgaacaaggagaggcctgtgagtggtctcagagagctagtcttagagcaaagggaatttcctctccgccctctgaagtttccataactgagtctgctgtcatcaactgacagtagaccaattaactggagaaaaggcaaataaagttattacctgtgtgggggcacacagtactcacaggaaagtgagtaccc

SEQ ID NO: 172048 - DNA, 220 bp, Homo sapiens
tttccatggctgggtcgcgtcccgtgcgtgttggtccttcggtctacggaaggacactcaggatgctgctagtttgtggctgttgtggtcagttctgctgtgaacatccacggatgcgtctttgggtagatagactttttcctcttcttctgggggcgtttcttgttaaagtttatcctcaggtgttactggtttttgtttttttttttttggagagtgt

SEQ ID NO: 172049 - DNA, 414 bp, Homo sapiens
ctgcgcatcctgtctggggttcatacacaacaaagacctgatttctctcctgtttcccctgggttccagtagaagcccaagcccctccaggaaccccttactgttactgtgaaggcggaatatggctttggttaattgaggccaactcacagtgctagatcaatccccctaaaccacaagggcggagggtgggaccagataggttattaagggaaatttgggtactcttttacccagagggtgaacagatgctaaatggcccaactatgcacatgtgtagccatccactgcaacaatgcgtagtagttggttaataaatttattttcatttaccaattgatttatcagcaaaatgaataaaaactaagtaggctacctgtaagaaaaggtaataaaatatgtaaaaatgaatta

SEQ ID NO: 172050 - DNA, 401 bp, Homo sapiens
gggcgtgagcatgagtaggaagaggttataagattaggaagtacccagagttctgtattataacacattgatttgatttgtggagtccaggccttaagtagataaaacagagcactttaaaagccatgtctgctgggtgcagtggctcactcctgtaatcccagcactttgggaggccaaggcaggcaggtcacctgagtttgagagttcgagaccagcctgaccaacatggagaaaccctgtctctacgaaaaacacaaaattagcctggtgtggtggcgcatgcctgtagtcccagctactagggaggctgaggcaggagaatcgtttgaacccagcaggcggaggttgcattgagccgagattgtgccactgcactctagcctggcaacacagcaaga

SEQ ID NO: 172051 - DNA, 614 bp, Homo sapiens
ccatgctaactctggaagaaactgtgtaataaataactaagggattgaaaatggactctaaattcatttgttagcagtatgacattggaaaatataatgcaacttctttaaatctcagttcctcctttgtaaagttgcgatactccctattagaagatcaataagtcctcttccaggctccaagcgcaagtgttccggggaatgagatggaagctacatccctttatggtccagcctcagcagtcacctggtgtaacttccctgcactctgttggtgacagtaatgccagcctgcctagtttcaagggaaggacttagtctacctccagataaggaaatggcaatgtcacattctagaagggcatattgctgtgagatgtgtgatacccatctttggaacatatgccacatcagatttctgttctgtgaaatgaagaaaaatgagttggggctggagttaattggtaagacctcttccaacattagaatgatgcaattctttaaaattaaaatccaattttctttaaaaaaataatttacaaaatgatgatatgcttttttagagagtctactttaggatatctttaaatagagaggtaccctggtacagtaag

SEQ ID NO: 172052 - DNA, 481 bp, Homo sapiens
tcgtcttagagcggatcatcttgtaaggatgttggtgatcttaattttttatgcttttatattttgcctcagtttaagtgtaatcagcaggaagcagaaaatatattcatcattttcaaaaaatatttaaaaattcaaatattaaaaaaatacagagaaaagttaacaaagctactgtatacatcatctggctccaactgttaccaactctgaggacctttagtcatccttactccatgctctcccctaccaccggatgtactgagcagcagagaatgggacctgggagggggcctattccaggtcaaaggggagagactactcctggtcaacggggaactactctgggtctatgagaggactagttcaggtagatgagggactactccaggtcaatggggaaccactctgggtcaagggaagactattccaggtcgggcaaggggagctattccaggtgaagaaggcggatgcaggggtg

SEQ ID NO: 172053 - DNA, 245 bp, Homo sapiens
aaggctgcagtgaacagtgatcccaccactgcactccagcccaggtgacggagtgactctgtctcaaagaaaaagtacctgcacaaaccaaagccaattactctgtcttcagaatagacatccaaaaccaaggctacaatccaagtcttcaataatgaaagttttctggccaggtgtggtggctcgtgcctataatcccagtattttggggacagaggtgggaggatcacttgggcctaggagtt

SEQ ID NO: 172054 - DNA, 337 bp, Homo sapiens
aggaggatgcatgggcttagagtgatgccaagaaacatttggtctgaaaagggctcacttttatagagtttgtcctttgtctgaggtccttaagttagtgtttggcgtagattgcaggctgacttttgagagttggtgtagaattaagccttgtgtgccttcacctatgcaagtaaacctggacagaggcctagagaccaggccgaaggatgttaacacatccctgtcacaagcagtttcctacatgctcattgtttctgcttcaatatccccatcacttcttcactttggcgtcctgcctggaagtggagatttgtgggtgacagatggtggggag

SEQ ID NO: 172055 - DNA, 332 bp, Homo sapiens
gaattcctatatgttcaaaactatcgtttgtagcctttctgtgtgaataatggcttggcttgttttaaaacaaaaaatcactggctcatactttattcatttgtttttttgagacaaggtcttgctctgttgcacagactgaagtgcagtggcatgactacagctcactgcagcttccacccctggggcccaagccgtcctcccaccttagcctcccaacatgtgtgcgccaccaagcccagcgaatttttttttttgtagacacagggttggggtggggagggaggagtctcatgttgcccaggctggtctcaaactcctgacctcaagtg

SEQ ID NO: 172056 - DNA, 366 bp, Homo sapiens
  misc_feature (192)..(192): n is a, c, g, or t
attcgcgaatcaccatgtagtagtctttaggctgattcacaaaagtagcgctggagagaaatctggatggtattagtatatagatggtatttacaaccaagggaaatggatgagatctcctagagaacaagtatagagtaggaggagaagaccacactccaaggaattcaagagaaaatgtaagagcttgtngttagagaaaccaacataggaacatatttcaggaagggagtttgagatcagcctgggcaagacagcaagaccccatctcttaaaaaaaatgttaattttcaaaatgtggttccacagcgttgatactgggaatatttactagacatgcaaattcttaggccccaccccaaacca

SEQ ID NO: 172057 - DNA, 409 bp, Homo sapiens
atatatacgacctaattgttgctttctctggatttccttcaagaagcaaaaattgggtaggtgaagttagaatctttgaggagtccccatctctgccagaaatctgaaccaattgagaaataaaacaaagtggcagatcaaatgggggccaaactatcacctccattaatggtaaagccaatattaaagtagtaacttaaattgatgggcaagtgaacttcctagtattgaaacatagacagagttggctttgtggacatgccttcaggtggcatggggccccatgctaaaagtcccacagttgggattaaatgttctgtggtcacattgttaaaattcttaacaattttatctttgaatttgtgttttgcaagtgaagttcaatgtgacaaagaaccatgctctgggg

SEQ ID NO: 172058 - DNA, 384 bp, Homo sapiens
ttgcatgcctatagtcctaactactccagaggctgaggtgggaggatggcttgagcctgagaggcaaaggttgcagtgagcccagatcacaccactgtgctccagtctggtgacagagtgagatcctgtctcaaaaaaaaataacaaacaaaactaatctatagtattagaagttaagatttattgttatctctttgaggcaggtgttttgattagaagaggacataaagggggcttcaggtaaacttgaactagtctatggtttaacctcaatgttgattacatgagtttgttcactaaaaatttgacaagctgtatacctgtaacttgccaatttcttgcatttatattacacatcaataaaataagtttaaaattatgttg

SEQ ID NO: 172059 - DNA, 620 bp, Homo sapiens
gacttgtggattttcccttgttgggtgctggttatttttgcattcctataaaatatctagctttattctgagatgtagttaagtaatttggaaactctggttttttctgttcttgctgtttagatttgttaaatggaaccagagtgttgttattcctcattactgaggcaagactgagtactcttcctaatcccactgcaatctccgccgcccaggttccagcaattctcctgcctctgcctcccaagtagctgagattacaggtgggcgccaccacgcccagctaatgtttgtatttttagtagcaacagggcatcaccatgttggccaggctggtctcgaactcctgacctcaggtgatccgcccaccccagcctcccaaagtgctgggaatacaggcgtgagccaccgcatctggcctttttttttttttttagatggagtttagctcttgttgcccaggcggaagtgcaatggtgcgatctcggctcactgcaacctccacctcccgggttccagcgattctcccacctcagcctcccaagtagctgggattacaggcatgacccatcacacccagctaattttttgtatttagtagagatgggttttcaccatgt

SEQ ID NO: 172060 - DNA, 108 bp, Homo sapiens
ccatcactggcaaataaagccacaaccaagggtaagcttatgcttctgaatcccctatctaggggagcagacagatgtgtaaacagatttaccgagggccaggtaggg

SEQ ID NO: 172061 - DNA, 256 bp, Homo sapiens
gttggcaattttttttattaccatttaaatattgctgcttggttttggtctgtttggagtttctatttcttcctggtttaggccaggagggttgtatatttccaggaatttgtctgtttttttctaggttttctagttaatgcatgtaaaagtgttcatagtagccttgaatgatcttttgtatttctgtggtatcagttgtaatatctcccgtttcatttccagttgagcttatttgtatcttctctctcctttt

SEQ ID NO: 172062 - DNA, 275 bp, Homo sapiens
tccacaacctcctgtcttacccagatactcctttctattgattccaggtctttagctaataactctttcaaccaattgtgaatcagaaaatattttgccaggcacggtggctcatgcctgtaatcccagcactttgggaagccaaggtgggtggatcacctgagatcaggagttcaaaaccagcctgaccaacatggtgaaacccccgtctctactaaaaacacaaaattagctgggcatggtggtgcatgcctgtagtcccagctactcaggaa

SEQ ID NO: 172063 - DNA, 481 bp, Homo sapiens
aaagagttatacagtctctgtcactttgtattataatttttatacctctctcttcctcactgaactgatctcttgaggaaataaattattctttacttatctttacagttctagagactatcaaagtcctgaacacttagtattatagaaactaaacaaatggtccaatactataatcttaaaacattttttaaggaatagtttgtttactagagaatactaacccaaaatagaaattatccatctagtttcataggaaaacttaatttatatttttaaaccattttctgcaatctgctgaaccccaggaagtgacataagcctcataactgctgccaaattaattttcctaaggatcaacctgatcatattgtttcttggcttaaaaccacatgtcatttcttggcttcctttcttgtgctgagaaagataatgtccaaatttggttactggctaccaaggccctctgagattgggaaat

SEQ ID NO: 172064 - DNA, 346 bp, Homo sapiens
cccaatgtcctttcaagttaaaatgttatgctctggctggatgtggctcacgcccgtaatccaagcactgggcgccgtggctcacaccggtaatcccagtactgtgggaggccgaggcgggcagatcatttgaagctagtagttttacaccagcctgggcaacatggtgaaaccccatctctactaaaatacaaaaataagctgggcatggtggcacatgcctgtaatcacagcttctcaggaggctgaggcaggagaattgcttgaatctgggaggcggaggctgcagtgggctgagatcacaccactgaactccagcctgggtgacagagcaagactccatctc

SEQ ID NO: 172065 - DNA, 771 bp, Homo sapiens
tgagtccataaaaatccctggattcgtacacacactcttcgggatgacctgcctatgcatgaaactgaggattggtagcccttttagaggaacacgtgcttccagaccaggttggagtgcagcagcgtggtcccggctcactgcagtcttaaccttccctggctcaagtgattctcctacttcaggttcccgagtagctaggactacagactgctgtgctatgtggctcaggctggcctctagctcctaggctgaagggactctccccatcctcctgcctcagcctcccaagtagctggaactgtaggtcacctctgagatagcaagactaacccatcctcttcctcctcctcctcagcctacttgatgtgaagatgatgaagataaagacatttatgatgatccacttccacttaatgaatagtaaatatatattattttccttatgatgtcttaataacattttcttttctttagtttactttgttgtaagaatacaaaatatgtgtgctaatgagctgtttatcactaaatcttcctttcaacagtaggctattagtagtataagtttggggaaagtcaaatgtatatgtggatgttcactgcgtgggagttagacctcaagcccgagttgttcagggtcaactatatttgttaagggtctatgctgtatacagaggtggaactaaaaatcttggagccaaacagtacgtaaattgggttggtcaatctaacccaagggtgagggattgaaattagtcttgaaatagg

SEQ ID NO: 172066 - DNA, 489 bp, Homo sapiens
atggtggggccaatggaatcattacccaagacgggcattttcagggaaacagcttagataaggccaggcgtacagtagctcccacctgtaatcccagcatttggggaggctgaggtaggaggactgcttgagcctgggagttcgagaccagcctaggcaacatagtgagaccccatatccacaaaaaatttaaaaaaggagtttgtgttcctgtagtagcatacttgggaggttgaggtggcagtatcacttgagcccgggagttcaaggctaaagtgagctgattgagccattgcactccagcctgagcgacagagagatacgctgtctcaaaggaaatacaaattaaaaaaccagccgggcatgctggcgtgtgcctgtagtctcagctacttgggacactgaagtgggaggattgcttgagcccaggagttcaaggctgccgtgagctatgattgtgcctctgcactccagcctgggcgacagaga

SEQ ID NO: 172067 - DNA, 122 bp, Homo sapiens
agagtattgggtgatttaagaaaaatgagaacaatgatatttcttgtgaaaaattttaaactactgagaagtacttgatctttcttgagagatagataacatttatggaagaataatgtaga

SEQ ID NO: 172068 - DNA, 540 bp, Homo sapiens
  misc_feature (48)..(48): n is a, c, g, or t
  misc_feature (54)..(54): n is a, c, g, or t
  misc_feature (59)..(59): n is a, c, g, or t
  misc_feature (72)..(72): n is a, c, g, or t
gagccatcgcccaacacataccactcaattccctgacctcaggtgatnctctgnctcgntctcccaaagtgngggaattacaggcgttagccaccacacccggctatatgaaggattttaaatagacactcgttctctttttaaagtaaatatagtactatttcagttttatagctagcctccttggcctcccaaagtgctgggataacaggtgtgagccaccgcgcctggccaagacgtgcttatttttttaaatagttgaacaatattctgtagtatggatgtaccatgttaagttgtttgattttcttaagatgtctggttagtatattaggcagtttaaaagagccttagggcatattgtgctacgtggaaggtgtctctttccaaatgtatttctccacagagtgagtttttctggttatgatggtgtttgggggattttgtttagagttttttaaaaaatctgtacttatttctatttgtatatggtactgatggattaagcagataatttttattcctgccttactttgatta

SEQ ID NO: 172069 - DNA, 204 bp, Homo sapiens
aaaaaaatagaatataacccttgagatcatgaatgtcactgtaaaagcacagacaagtttatttaaataaaattataaagtaagtaaaagtattaagtggtatgtggaaattataaaattgcagagatctatgcaaatgattaaattcgggccaaaagtggattagagggagaatggggaataactgccaatgggtacagggtt

SEQ ID NO: 172070 - DNA, 598 bp, Homo sapiens
  misc_feature (163)..(163): n is a, c, g, or t
gggactacaggcgccctctaccacgcctggttaattttgtatatatagcagagacggggtttcaccatgttggccaggctggtctttaactcctgacctcagtgatctgcctgcctcggcctcccaaagttctgggattataggcatgagccaccgcaccagncgcaaaaggtttaaaaatttaacctggggcatgggtgggtgcgtgcgggtagacccgatctactgtggcttcacataaccctccttcttaagcctcccaaagcactagtattacaggcatgagccaccatgtgtggccaccactgactttctgaaccccgagtgtattagccaccataacagacaccttttgtctgatacattctgtggatcatattccttttttatatataattttaccttttattttagatttgagtggtacaggtacaggtttgtttcatgggtatatcatgtgacactgaggtttggaatgcagatgatcccatcacccaggtactgagcatagcaccccacaggtagtgtttcagccctggcccctccatctctccaccctctagtattccctagtatctactgttcccaactttgtgtg

SEQ ID NO: 172071 - DNA, 589 bp, Homo sapiens
ataaatccagtttgttggtatatgatgatttattaggggaacttacagacagaaacgtggtcttgggtggctgcaagacaggtcgatatctacactgttacttcccagacccaaggcttgtataccataggggaaaggtatacatgctccagcaagacaattcaaggcaaccctccagaacaccaagaatgttatatgtgtcatagcctataatttatgtgataacatcaaggttgctttgatctaaaatcgggatttgtagtgagcacatattcttacactaaggacaataaattaagaagaaatcaggaggcattcacagaaatggggtcattcagaagtcaatggtggattaacatccaagatggagtcattttgtctctacacaaagagatctggttatttttgtggcatacaagatttaacattacgattatgactggtaacataaaccaagacatatcagatttctaggactcgcgtactattttggaacacatattacacatttatacaaatataactcaaggaaaactaaacaccattttgtatttgccaatgcttcccatgtgattttaacatactgagt

SEQ ID NO: 172072 - DNA, 109 bp, Homo sapiens
ttaaaattattatttttactccctcttttcagcaaatagaaaagtttctttgctcattttttcctattaaaaatgtagttcatgattattccagaaaatacaaataaca

SEQ ID NO: 172073 - DNA, 455 bp, Homo sapiens
gatcaggagagcaatggtgtatttccagtttgagtccgaaggcctgggagtcagcagagctgctggtatatttatgcccaaaggccaataaactcaagacccaggaaaagccgatgtttccatttgagtccaaagcaatgctacaagaaaaacttggaactgtaacatccccctgcaaactgggaaggagctaagagaccaaagaatgattcagacaagtccagcttgatgagtagatgagtctatcaggacttatgtacatggcactcctggatagcggcaggacagcgctggagatctgcgccacctcccgactccaaactgcttttaaattaatttcctggctctttgcctactgtgtttgagtgatgagactgtttttcttgatcggttctcagatactcactgggatgtttgggttcttagagacacctgctcctcggttgggcaccctg

SEQ ID NO: 172074 - DNA, 105 bp, Homo sapiens
cttaactttaggcaggtgattcgggccacctttagaaacacggagaggggcgccctcctgaccacccactacatggcagaggctgaggcggtgtgtgaccgagtg

SEQ ID NO: 172075 - DNA, 736 bp, Homo sapiens
ggagtagcttttgtttctcctgtaataaacttgcattcactttactctgaatttgccttcattcttgaacaagatccaagaaccctctcttggggtctggattgggacccatttccagtaacatcttcctggcaaaccaccaagggacaacactggagaaaccccgacccaaaagaatagactgcagcactaattggccaactttgcactacggaaatgacattagacaaaaagcaaatttgagcgattttcgtatcaaagttcgaaatgggtcataaagcagtggagacaactcgcaacatccacaatgcatttggcgcaggaactgctaatgaactgacagtgcaatggtggttcaagaagttttgcaaaggagacaagagccttgaagatgaggagcacggtggccagccatcagaagttgacaacgaccagttgaaagcgatcgtcaaggctgatcctcttacaactacacgagaagttgccaaagagctcaacatcaaccattctgtggtcattcagcatttgaagcaaattggaagggtaaaaaagcatggtaagtgggtgccttatgagctgagtgaaaatcaaaaaaattgtcattttgaagtgtcatcttgttttatcctacacaacaacaacaaaccatttctcaatcagactgtgatgtgtgatgaaaagtagattttatgcaacaaccggtgacaaccagttcattggctagactgagaagaag

SEQ ID NO: 172076 - DNA, 666 bp, Homo sapiens
acatggcaaaaccccgtctctactaaaaatacaaaattagctgggcgtggtggcgtgtgcctgtaatcccagctactcaggagactgaggtgggagaatcgcttgaaactgggaggccgaggttgcagtgagctgagattgcgccatcatactccagcctgggcaactagagtgaaactccgtctcaaaataaaaataaaaataaaaataaaaggaatgatcacttcctgtttcatgaatgaggaaactgaggctctgggagatgggaaatcctgcccggaatctcacagctggaggccaggccgggctttgaatccaggcaactgagtctgagtggatggtgtgtgctttgtgttggagctggcccagggctggatgaaggcaacatttaattaatgaaaaccactaccccctcccggctgttacctcttgagcgcttttctatgaagcatcctgtttaagcctcgcactctgtgatgtggaggtgcagtaattatccccatttcacagacaggatgttgaggtcagaggggttgagtgattgtcatgggccaggtctcagccaggcttgctaaccctggagtctgccgtctgctctgaagtggtcactctcagctggagagctgacctggcccttttgcctttgtgatgtacggtcctgaaaaa

SEQ ID NO: 172077 - DNA, 352 bp, Homo sapiens
cccactgcaggtgaccttgatgccaacaggcggcgggccagggggatgatgttgatgacaatcttcaactacacttgaggatgaagtgagacatggggtctcacttcgacagggtgagaatgaattggcccagaaagcactcatttctcctttcagcaaacattctttgtgaggtcgccacagtctttgcctatgttttacaaatgtgactgagaacagatgaaagatctgcccaaggtcacactggattctaaaacctgtttctaactgtgtcatcctccagaacgtgaatgtgcatctgggaggatgatccccaaccaacatgtgatctgaaagtacatattgcccatta

SEQ ID NO: 172078 - DNA, 154 bp, Homo sapiens
agtccctgcctaataggccttcctgaatcgcctgaagaacaaaatgtgatttgtgtgggttgtttgttagtttaagctacagatagagtaatacagtttaagcctggtttgcctggggcattccagtatatacaggtatcccagtgtgattgtt

SEQ ID NO: 172079 - DNA, 567 bp, Homo sapiens
aataaaaatctcagtagggtttttttttctagatacagacaagctgattctgaagtttatatgaaaaggcaaaggaactagaatagctaaaacaatttcaaaaaataagaaaaaagttggaggaattacaccatcttaagacttagtaaatacctacaataattgatcatgtagtattggtgaacgggtggacacagatcagtgtaacaaaataaagagaccttacaaatacggccattacatttttggaaaggtgtaaaggcaactcaatggtaaaatgacagtcttttcaacaaacaaacagtgttgcaagtgaaaatccacaggcaaaaaaagaacctcaatctaaattttacatcttatataaaaactaactctaaatggattacagatctgaagtaactacttttaggggaggattctaggaacatggcagagtaggaagcactaggaatgtttcccctcttagaaaacaattgcactggcagaatctgtctgatacaactattttggaactctggagtctattgaaggcttgcaaattccagggggaggcttgaacagtaa

SEQ ID NO: 172080 - DNA, 142 bp, Homo sapiens
tctgtgtccagagaccatgttttgcttatccatttcttaagttcatggacatctgaactgtttccactttttggccattaggaataatgctgctgagcacattcgtgtacatgtttttatctgtacgtatgttttcatttct

SEQ ID NO: 172081 - DNA, 254 bp, Homo sapiens
ggaattatgtaaagccccacatctaggagccagacattaaggagcttcctttactctatctctactcctaagatcagttctgcaagcttaatctcattttgaagattgagaaacagagactcagatttaataagtttcatcaaattccttataaacaatcaatatacccttgagttctagcctctcacacattctaatcatggctggcccgtaatcattccttcagcattcctaactccagatggtcattcaca

SEQ ID NO: 172082 - DNA, 514 bp, Homo sapiens
agtccacccttaagatccttgccacccattattttgtttcagaacgcttaatccatcaaggaaggttaaattggattaccccagtagggaagggacgggggctgtaagcatgagggattatccctgtaaagggctcgtggtgtgtgtgtgtgtgcgtcctgctagtgttgaatgacggagacctgagtttggattctgaatccaggtgtattcgatgccgctccggcgtagaacgggttaaagatgcccccagccaggtagagccagactgggagttgtgcaaggtctcaaccccctaaaagcggcccctcaaattgaagatgagtaaatcatagttcgtaaatcagaaagattatccagtactacgttactctgtttatttccctttcgtcatccctgagtcttgggtcaagtccatcccagctctgtcctccaggaatcaagggaaatacgcaaacccgcggtgggttcgcagccgcaggaaggacaaatcttgcccccgccgcggcggccg

SEQ ID NO: 172083 - DNA, 353 bp, Homo sapiens
tgccgttgacaagctgtgtgacacaggataagccacaaccctctctgaacctcagtctcatcctcagtctcatagcgctgatgatgcatactgtgtaatactgttgcaagaatggaataagatgaagcagaacaaatgtccaacccagcaactggcacatggcaggtgtgcgcttaatccctgcattcttagtgggatcagtattcccaagagagtgaacatttatgggaaagaaaagaaatcttactctttatgaataaagtacagatataaaatacaatacataagcagatgtacaatttatctgtggaattaaaatttcatggggtatgtagctaataaagaatctttag

SEQ ID NO: 172084 - DNA, 663 bp, Homo sapiens
taccttaataaaagggactttacagatttgataaaggatcttgagataggaatagtatcctagattatccaggtggcctcaaaatacttgcaacagtctttgtaaaagggaggcaggcggtcagaccggggaaaaagtgctaaactgctgacttagaagatacagaaggaggaccctgtcagggaatgaaggtggccccgagaggctggaaaagatggaaacacattctccccggcagcctccaaaaggaacacatatccctaacaataccttgaatttatgcttctgccttccagaattaggggaatccgtttgcgttgttttaagccaacaggtttgtggtattttgctgcagcaacagtaggaaacaaatgcagccatgaagtgaatgtccttctgtacctttgagtgtatgtataggtttaaaaaaaaaatgcccacctacactaatcaatacggacaaacacgggattgtctatgcgtattactttgtgatttctctcttcatccaatttgtggtgaacaacagatacgttgtgaacaactttctatgctatgtattttaatggctgctccctcgcttaggaatagttgatgcagtatttattttgttttcgtattcttttgctgatggaggctggccttgctggctgtacatttatt

SEQ ID NO: 172085 - DNA, 460 bp, Homo sapiens
cccgttctgctgcttcctgcttctggccgcttcttctgctgcttcctgcttctgcaatgggccagaacttcctttttaaggctgaataatattccattgtgtggatagatcacagtgttgagcagcgattcatcaaagccaaaaagtcggttccacactttgacagtcgtgagtaacacagctgtgaacatggtacatgagtccctgtgtagacatgctttcctgtctctggatagataaggaggctccatcttgacataggcacccactgtcaccaccgcagggaatgtggcacctgccttttactgttcagcagagagtgacacacatcatttctatctcatctcattgccgtgccatggctgacttcagaggaggtgggaaaatgcacttctgtcataggcctagaagtgggtgaactggaaatacttggtgactaggatcagtactttagaagaga

SEQ ID NO: 172086 - DNA, 1327 bp, Homo sapiens
aggagactccgtctcaaacaaacaaaaaccttcatcttaaaattatagggtaagaatttagaaatacaaggaaaaatggccagccagttataacaagaagctttaagacatctcttttcagaatcagtggatcgactgctgcacacacactagaatggctaacattttgaaatgctgataaatatgcagagcaactggagttcctcacagctggtaggaatgcaaaatgactcagtcactcaaaacagtttggcagattctttaaatgctaacatacacataccatatgaccaagcagtcccactcctgggtatttagagagatgaaaacttagttcacacaaaacctgtgcgtggatatttatagcagctccattcatagtgaccaagatgtcttccaacaggtgaatggatagcgatgtatccatatggtggcaaacatgccacaattcggatgaatctcaacatcatatgctgagtgaaaaagccagtctcggaaggctacattctgtatgattccatttatatggcattcttgaaaagacaaaactatagtgacagaacagattggagattgccaggtgttggggttgggaggagttgattacaaagaggctgtacaagggagtttgtttgtttgtttgttttggtgatgaacagttctgtatcctgattgcggtggtggtaacgtgagtctatacatatgttaaaatttatagaactgcatactctcaaaaaaattagttttactctataataatattagagcttaaaaaattcatccctcttgcccatcagtagatcaggatatgaaggataccattgaacataaatattttgtatccatgatgaatacaaagtatattctcctggaaaaccaatagaacattcatataaatgattcctatgaaggtaaaaaacttacaaaattcaaagatcatacagatcatgtgctctgtataatgtaataatagtaacaaaaggcctgtccacttggaaatttttaaatgatcttctaaataactcatttaaaggagaaatcaaaataaattgcaaattatttagaattaataaaaacttctctaaagctgaggaattctaccaaagaggtgttagaggaaattgtatagattttgatttactttccaggaagaaagaagacaaaagagatgaattaaacatttaaagctaagaaagagataaaccaaaagaaaggtgaggaattggtaaaagcagaaatgaataaaatagcaaattttgatcagtgaaacacaggtttttaaaaatgaaagataaacctttgtaaaatatgataaagaaaaaaaagc

SEQ ID NO: 172087 - DNA, 205 bp, Homo sapiens
tttgaaacctggcaaatcctcctgggggagactctgccagaacgtttcatgtcatccagccatttctgagaggagaaccggccttccaagcagaagtccctgggtgaacactatcgcggagtcccgtaagttattttaatgtagacatcactttaaactaacctttcaccatctgttctgtcctctaataacaaatgcggaagag

SEQ ID NO: 172088 - DNA, 576 bp, Homo sapiens
gatcccaggcaaagctatatggaagtgtattgacattgttaaaggtagcatacattttgtttctgaaacactgttcataatggtaagatattgagtgagatcctcattttcttgcatagaaaatggatttatgtctgagagagcaaatttgtttgaattaagtttttaatgtgtggataatattcattgctgctgccatttatcggagccaccttttataatcacgctttaaaggaggagttgtttacgttgcatacaattttcttaggaggcttataagtacatactttttttctcttatggattaaattaatgaatacagtcaacagatcattacagaatacctactgtgtgaatgactgatcttcatgttaccttttcagttctctttgaaagtgagtgaaggattgtgtctctcatataactggaaatacctgtcttaaaaaagtatttgtatataaacttagatgaaacatatctaggatcactatctttcagtttttagaatctctacaatttattaattattccacacatgttgacatgagactcttaccatttgattaagcaagaaaa

SEQ ID NO: 172089 - DNA, 244 bp, Homo sapiens
aatggttcgacactgtactttcactcaattttgctgtgaacctaaagatgctctgaaaaataaagcctactaaaaaaaagttgaaaagatgccatgtttgaagaatgctgtccactaagcacaatctcttctcccttatagctactgttcttggcagagctacttggattaacaatggtgcctggcagagtaacacagagaccataggaatagacattttcttgagtacagtgatcgaagacca

SEQ ID NO: 172090 - DNA, 1115 bp, Homo sapiens
tgggggtggctgggccggggaaatggcggcttcaggagagagcgggacttcaggcggcggaggcagcaccgaggaagcatttatgaccttctacagtgaggaataaagatggcatatagcataccagagattcattccaactagcattccaactctgacagtgacaccaagaatgttttcctgggactgcctggtgcttgttctccctggcattgtcttcaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaacaggaaagagagagaagccaaagagatgcatgaaagaaacgacaaagggaaagaagcacgattgaagctcaagaaaaagccaaacgggcacacacgagagtggcagaaaaactttgaggcaagtcgagatggtcgtgtggacagctggcgaaaacttcccagccaatacgaaggggaacgaacagagagacacatcggactttctggggaccaccgaaggtacaactggggcacgtggagtgaaacggaccagggcacacagggcagaaacctttcccgggaaaatcacatacgggggtggaaggaagcaatctttccgcacagttcaccgcacatgagaagacatatgcgcgtcagccacacggcgtgcaacagacataatgcacagcagaagacctgtggcacgagaagcgggggcggcaaacacacctcctcgacccagac

SEQ ID NO: 172091 - DNA, 906 bp, Homo sapiens
tgggggtggctgggccggggaaatggcggcttcaggagagagcgggacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaacaggaaagagagagaagccaaagagatgcatgaaagaaacgacaaagggaaagaagcacgattgaagctcaagaaaaagccaaacgggcacacacgagagtggcagaaaaactttgaggcaagtcgagatggtcgtgtggacagctggcgaaaacttcccagccaatacgaaggggaacgaacagagagacacatcggactttctggggaccaccgaaggtacaactggggcacgtggagtgaaacggaccagggcacacagggcagaaacctttcccgggaaaatcacatacgggggtggaaggaagcaatctttccgcacagttcaccgcacatgagaagacatatgcgcgtcagccacacggcgtgcaacagacataatgcacagcagaagacctgtggcacgagaagcgggggcggcaaacacacctcctcgacccagac

SEQ ID NO: 172092 - DNA, 993 bp, Homo sapiens
tgggggtggctgggccggggaaatggcggcttcaggagagagcgggacttcaggcggcggaggcagcaccgaggaagcatttatgaccttctacagtgaggtgaaacaaatagagaagagagactcggttctaacttcgaaaaatcagattgaaagactgacccgtcctggttcctcttacttcaatttgaacccatttgaggttcttcagatagatcctgaagttacagatgaagaaataaaaaagaggtttcggcagttatccatcttggtgcatcctgacaaaaatcaagatgatgctgacagagcacaaaaggcttttgaagctgtggacaaagcttacaagttgctactggatcaggagcaaaagaagagggccctggatgtaattcaggcaggaaaagaatacgtggaacacactgtgaaagagcgaaaaaaacaattaaagaaggaaggaaaacctacaattgtagaggaggatgatcctgagctgttcaaacaagctgtatataaacagacaatgaaactctttgcagagctggaaattaacaggaaagagagagaagccaaagagatgcatgaaagaaacgacaaagggaaagaagcacgattgaagctcaagaaaaagccaaacgggcacacacgagagtggcagaaaaactttgaggcaagtcgagatggtcgtgtggacagctggcgaaaacttcccagccaatacgaaggggaacgaacagagagacacatcggactttctggggaccaccgaaggtacaactggggcacgtggagtgaaacggaccagggcacacagggcagaaacctttcccgggaaaatcacatacgggggtggaaggaagcaatctttccgcacagttcaccgcacatgagaagacatatgcgcgtcagccacacggcgtgcaacagacataatgcacagcagaagacctgtggcacgagaagcgggggcggcaaacacacctcctcgacccagac

SEQ ID NO: 172093 - DNA, 651 bp, Homo sapiens
actctattgatcccccacatattttctatggccttcagtcaatttttttaaaggatttaataagttcaaatatgtatctatggcttaaggttacaaagaatatttttctttgcctccagtatactttgtattaaaaaaattataaaaggccataggtattcattttcaaatatttgaaaaaaaaaggcatggcacaattaaagcatatgcagaaccaacttggattattgctatatttctttctttctagtgtgtacggatattgatgacatttttaggtggctcttaacaagaacattttcctctctttagatgtgaatgcatagacagatattttctatgtaaacttttcatcagttcttgatagcaatagataacatttcctataatattccacacacacattcagccttcatccactggagcctgttatttagtctcctcagatgagctttcttcacgttgggcaattttcatcccttattgattcctcatgtgccttgcttttcatgtaaagatgtattcctaaatgcatcaagcagaccctctataacacatccatgtgttgcaaggtcctggtccacatgccatacaaaattaacttgaataatcctgtcacctatttagaagtcagcatggtggtcacccctg

SEQ ID NO: 172094 - DNA, 792 bp, Homo sapiens
agctggagaaggtagggaaaatatatccatcctaggcacattgaagtccatgaagaagaaatccaaagcattggaacagaatatattttaaaaactaattcaagaaagcttttgtgaagtaaaacaagacacaagagcgtctgccgtttgcaggtacgcaccctataccggaggaagtggacaggaaacagtgacgatcatctgcacgtgccatgagtggcttgtaagggaaagttcgttagattcttcagggcagcgttccgtgccagggtcttagaggcagcaacacgagaggcccaaggaacgtggaagccaaaatattatcctagctttggagtccctcatgtaaaatctgtcaggttttgaagactcaggtgtagggagtctgagtgctgtgccccatgaagactccaccatggtcggctttgtgaccagctcccttcgctgcagactcttaattttgcagggcgttttcatgtgacacattgatggtttctaatacacaggtgtgccgtctacatccagtgactccgtgaggtctttcagaaacgcttcgcaggactctgttaatcatggtgccataactggttagggtcaaaggagcaagtgacaaaatgaacaaataaagagataaagagaggtgcacaggtgtgacgtccatagtcagtacatacaggctgaactagggcttaggacaagtgctgtgggctgtgtgtgacaaccagttgtggttttgtaatgtggcatctgtaagcagcctgtgtctcaagaggacattttttagcagattgg

SEQ ID NO: 172095 - DNA, 326 bp, Homo sapiens
ggcatagtctttaagggctgcagactaagttcatctttgtgctcccgtgctgcttccatttcaaaggcttcgccagcgaatcccgtgagtcattcctggaaccttcaggagtctccatggtgatggggttgagtgggcctgggggaagccagcattcactccacttcctaacaagttcctcttttctgatttttttttcttttttttcaatagagactggggctgaggcttgagcttttttgtttttttaaacaaatcacaaaataagaactccctaagccttctttccccatttttttggaaacccattctagataaatatataa

SEQ ID NO: 172096 - DNA, 246 bp, Homo sapiens
aggacaaaaatagtttacccagcatttatactatgctctttggagctcagggtcaaagatttcagcaggagttttctttagtaacctaaatttacttactttcttttactacatcaaaatggttttaagtgtctattcacataacaatgaatgtgagggtctatccaatgccaacaagttggatcactactgaggtggaaatagcgtggcttaaacaaatcgacagcatataattgaggtcacaaa

SEQ ID NO: 172097 - DNA, 191 bp, Homo sapiens
ggattgggacccctttcctgtaacatccctagtgcttatagaatccattaagtcatgttttaaagcacaacttcccctgaaacaacctccaaaccccttaccagagatgctcttcaataattaaaataacaaagaagaggccgggtgctgacatctgtagttccagcactttgggaggcagaggcaggcag

SEQ ID NO: 172098 - DNA, 120 bp, Homo sapiens
tccatgctccagccgcccggagatcagagcttgccacgaaaggctgcttttagccctgatcacagggcagaggattctctagaagccctctcaggagagggtcttctgggcgggaagcgt

SEQ ID NO: 172099 - DNA, 338 bp, Homo sapiens
ctacaacttttccttaattctttagtttagctactctactgtccctctgaggagtgccatcttattttttgtgtgtttgcttctaatatttcatggttctatttcttttatttctagcactagaatgttttctttcaaggatgactttcacctatatgcaaggtagacaactgtcttgcattttgcatgacgtacacttccctttatattgattatagataaatggttatctaaatgttttgaatactagttatttcatagctatctgattataacaactattagataaaaactattttccaaagactatcgagattacagctgttgcaataaacatg

SEQ ID NO: 172100 - DNA, 984 bp, Homo sapiens
ggcccatcctccacaccccctgctcccttactgtcaccatggctgaccactgaggagggagccttggttaccagcatccagggagcaaggcagcttgttagttttagtttggtgatttaggtcccttttcctataggccattgctcctcccagagcctggagagtttcctggaaagcaaacatttgtgcagggcagcagttggaagcagggccacacactcttcggatccctgatctagttcccctcagcctggctgctcagccactcacactcgagggtgtgcaattgcagggtcagcagccgggagtgaacatctccttaaattgtgtgccccgggtgcctcactcaccgcaccctacttccatttcaaacccgctacactgttttcaagccttacctttaaaagctattttcaggaaattcccaccccattctagttttgtgccctccttgcaccctggagttttaactcacagcacttacaaaactaaagccaaatgattattgatgtatttatcagtcgaatgcctgctttccctgctatgctgtgagccccttagaaggtcaggactgagtttgtattgtacatcccaaagcccaacatgcagtaaagaagtgattgctgaatgaacaaacatagttttcaaattttttgacactatttttcactggcctggagcaagagtgagcatcctctttttgccgataagaaataatattgcctgaaacgagagggtctgtggctaccaaagtggtctgtgtgtgtgactgtgtgtttgcatagtgcaaatgtgtggtgaatatgcatatttgtgggtcatggtatatgtatgttcgtgcatgtgtgttgtatatattctctgtgttgtgtgtgcattgcattatgtgtattaaatggatgtcgtgcatgtatgtgtagtacatgcaggtactgcgttatgtggtgcctatatgcttggtgcatgttactttgtgtatgtgat

SEQ ID NO: 172101 - DNA, 375 bp, Homo sapiens
aaggggcaccagccactgtgccatgtacttggcaggagcgagcgaaacttcaggacggccccgaggaaggcatctcttcatctctgccctccacactcggaggtgaagcatcttgcctgagggctccagctcgtacgcagcaggactgagatcggaagcaggcaggcttgttcgagaacctgtggctctcatcactgtgctgcagctaaacgcagaaaaaggaagcacagaccagcttcccgcatgaatggaagtgcagagaccctccataaaatcttagcaactagaatccagcactgtaggaaaagaatagtcacccacagtggcgtacaccagcggtgagaggctggttttgtgtcagtaaatccagtcata

SEQ ID NO: 172102 - DNA, 133 bp, Homo sapiens
tcatgtgctcggcccttcctggtctaaatgcaatacaaatatttttcaaaagatgctaaatattcttgggaattcaacacaataagaactcacatttatacagtgcaaaagattttgtgagtcgagcaatctg

SEQ ID NO: 172103 - DNA, 597 bp, Homo sapiens
ccatctacaatttacctctaatgaccctcaatgtcaattaacttttttggtctaacttcagagatggttagtatcaatgtgcacataaaagaataacaaaggatgatgccatttaaaccttataaattactaatgaagccacatgactaattaacctagataaaaaacaaacggctaaatacccaaccttcaaatctttgctcaaatgttagctcctcaattaagttcccccaatccatttaaaattgtaactcattcccctccccacactccctatacctttaatctgctttcttctaattccatagctcttatacactattatacataggctggtaatttaatgtctcattgtctgcctagtcacattagaatgtaaactccaaaaggacaatatgtttgctttattcactgattcatcccaaaaaccccatgtacatagatgcttcaataaagctgtattcaacgtagatattttaggcccttctacaagatatttaactgcaaaagatgaacagtctcactgaaatttaaatggaagcatgatgaacaactacattaaatcacagcacattttttttttttttgagatagagt

SEQ ID NO: 172104 - DNA, 394 bp, Homo sapiens
ccatctacaatttacctctaatgaccctcaatgtcaattaacttttttggtctaacttcagagatggttagtatcaatgtgcacataaaagaataacaaaggatgatgccatttaaaccttataaattactaatgaagccacatgactaattaacctagataaaaaacaaacggctaaatacccaaccttcaaatctttgctcaaatgttagctcctcaattaagttcccccaatccatttaaaattgtaactcattcccctccccacactccctatacctttaatctgctttcttctaattccatagctcttatacactattatacataggctggtaatttaatgtctcattgtctgcctagtcacattagaaggctggggttacgtctaggt

SEQ ID NO: 172105 - DNA, 527 bp, Homo sapiens
gataagaaacaggaagtgctcccccaagccaagttgattctctgagcaacattgaggggcttcaggaacactcctgtgtatctggccacgtactccttagggccttgctttgtgtgcatgtttgtaccttgtatatcctctgccttttccaattcctcacagcctccaggcgtcctgacacagaccccacctctagttaaagaataaaaaccagagctcctctctcttgcactccagcatctttctgtaaatgctaaatatgtaatatcacatttgacgtaatgccaaaaagttacatttttatggaaaaaactgagagaagtaggagttttttaattcactataggtccctaaccagtacatttcccggctctgagagagctgtttaatttcttaatgacttcaagttttacctttatatcatttgtgaaggagaggaatcataattatagcttttacaaaccttttttgtttttgcaaaacttgtatggtttgcaaacctgttttgtgactgacatttttactgt

SEQ ID NO: 172106 - DNA, 327 bp, Homo sapiens
agaagttcttgaatagctctctgttttctgagttaagattttgtgttttggtgtgtgaagagtaagaggggtatcatggagtagatgggggtgaggtagaatgggaggtgtgcaagagaggacacctgaggaccgtgtgaaggcaagtgataatcagactaggaagctggctggacacaaccttccagtgggagaggcggaggtgagggggcagctgcttctttaactaatcaagggctcaggttccagtaccttccttttatccccatccacagtttggcctgtctcttctcatctgcaaaatctcctcttttctttttccccctc

SEQ ID NO: 172107 - DNA, 410 bp, Homo sapiens
gggcagcagaggcagagctcccctagccagccgaggagaggccaggaggactcagcttctctgtagggtggaggctgggaagaggcttcttttaggcccagcaggcagagcaagaggaggatggagtttgctcatgatgccagagtcccctgaatatgctggcagtgcgaacacagggagaagagctgggccctgggcaggggggtggggtcaaagggcaggaggcaggctgcatctccctaccacaagaagcctgggtggaaggggccttgtgaaggtaatgtttggctgggagaagggagggggctcctaaaggagagtggataacagcaaaaaactcctggatggtcagcctagcagtaggcaaggacttgagcggagactgagatcacgatggatatctccaggca

SEQ ID NO: 172108 - DNA, 745 bp, Homo sapiens
cccaggctggcctcgaactcctgacctcaggcgatccacccaccttggcttcccaaagtgctgggactacaggcatgagccactgtacctgtcttaaacatctccttatatgattgctgaccattcattcacattcctcttctgtgttggtacaaaccttttgaccatttttctcctgtgctgtttgtcattttcttgtttatttgtagcagctcttgccacactgatagaaggagtggtggcagctgacctctgccgatagaacacctgctatcgggtttaagcaggtggattcactcactgaactcacagcggcctaaccaatgagggctgtacttattcccattttaaaggtgaggaaatagggctgggcacagtggttcactcctgtaatcccatcactttgggaggctgaggcgggcagatcacttgagcccaggagtttgagaccagcctgggcaacatagccataccctatctctaccaaaaattcgccagttatggtgggatgcagctatggtcgcagctactggggaggctgaggtgggaggatcacctgagcttgggaggtggaagctgcagtgagccatgatcacgccattgcactgcagcctgggtgacagagggagacctgtaccaaaaacttaagtaacaaaggtgaggaaacagaggcacataaaatgaggtaattttcctcccttctgtgcctattttgaaaacgtttttaaaatctttacaagaaacg

SEQ ID NO: 172109 - DNA, 463 bp, Homo sapiens
atgaccagggcgctgaggacagcaggctcttccacagggccttggggaggtgccagactgcaccacttcctccctctcattctgttcctgggttagggcaaaaatcaggaagctctcgtcttctgaacctcacagccacccctttgggctctcccttcagaaagtgtgttgaccggtgggggcgcggtggctcacacgtgtaatcccagcactttgggaggctgaggcgggcggatcacctgaggtcgggagtttgagaccaacctgtccaacatggagaagccccgtctctaataaaaatacaaaattagccgggcctgtggcgtgtgcctgtaatcctagctacttgggaggctgaggcgggagaatcgcttgaacccgggaggaagaggttgcggtgagccgagatcgtgccattgcactccagcctgggcgacaagagcaaaactccgtctcaaaaaaa

SEQ ID NO: 172110 - DNA, 278 bp, Homo sapiens
gaaaatatgaaaggctgcacaccaggttgtttataaggcagggaagaattgcaggatggggaggggcaatggagaaccaagcacaaaaggaaaagatttttaattttttttgttttatttaatttccaatgtgatcatattttcattttattttttaaaagacaaggtgtaatcatatttgtgctaaacatataaaaattgtatttgtgttatataaatatataaagctggattcagtgacacaaaagggattttaatgtttttagaccaatcactgt

SEQ ID NO: 172111 - DNA, 512 bp, Homo sapiens
tgtgcagtgcacagaatgtgcaggggcgtggtgaagactgcacacatttggtgtgtttgcacagtgcgtaaactctccggggcacgagctcttaggagcgcaggactccgcgcttggtgggtgcagggggcgcctgttgccaggagttggtggggagccacagtctccggctgggtatgggggcttgtcgggcgtacggcacttgttcctcccagggcagagcggctgtatccgaggcgggtttctggggctcaagccccaactccccagccgccgggccggctaatagctccctgtctgtctcccgccccgcccgctccaggtctggttccagaaccgacgcgccaagtggaagaagcgcaagaagacgaccaacgtgttccgtgcgcccggcacactgctgcccacgccaggcctgcctcagttcccgtcggctgccgccgccgctgccgccgccatgggcgacagcctgtgctctttccacgccaacgacacccgctgggtggcggccg

SEQ ID NO: 172112 - DNA, 167 bp, Homo sapiens
aaggttatgatgtcagcagcactggaggtgtaaaccggactgttgtgtgttaatggatttaatgggccagagtgggggcaaagaaactagcagggttagtagagctgccaaggagaccaggtatatcatcaactagccgtgttgacatttagaaagccctcttgtct

SEQ ID NO: 172113 - DNA, 155 bp, Homo sapiens
tgagtggattacttgaatctaggagttcgagaccagcctgggcaacaaagcgagaccctgtctctaccaaaaaaagaaaaacgattcatccattttgttgcacaaatcagtaatttgttcctttttattgctaagcatcacatggcaaaccattt

SEQ ID NO: 172114 - DNA, 365 bp, Homo sapiens
actggggcagatattatggagatgaaagattcactgcccttgaagagcttattaacctgggcaaagaaatgaaacaagagtatcagacaacatttaatcaagtgggaaactgtcaatctctaccaataaactggagattaaggaagaccacagtagattaacaaagcctcagttaagtgaaaagattgggggaaggagcactggaggcaggcaaatagatcaggttctagtttatgccttttctagtcagctgtgaggccctggacaagtcatttaacctttgtgaaataagcgaattgaacttggtgatctttaagatcacatctggttctaacttccaatgacttctgaatttgaagtcttgc

SEQ ID NO: 172115 - DNA, 651 bp, Homo sapiens
aatattcccaacacctctgtaaaatgggtattatgcttattttgcatatatgggaactgagagtcagagaggataactcagtaacttgtatgtcatatacacagcaaggctgaagccaggcattgagctcaagctgtctggctctgaagcctggattctcttctttctctgctgacttctacgatagtacattcaaaggccctgtgatgggaagaagcatggcatatgaggttctcaaagggattctgccttttacatggttaggttgatagtttagaagaagcaaggggcccaggttggtgtttcacccttgtaatcctagcactttgggaggccaaggttggaacgatcgtttgaggccagtggtttggggctgcagtgagctatgattgcaccactgcagtctagcctgggcgataggctacagagagtaagttaccacatttcaaatagccagtatgtagcaaagccaaaatttgaacctaggcacagaagacacaccaaccttctatacaaagtgctatctattgccttggtgctatggaagcatttctgtcacatgctgtgctttgatgtatgtacaaaaggagatgtgggaaacagaaaatgaaataagcagggtttattttattttatttttttcattcctaa

SEQ ID NO: 172116 - DNA, 508 bp, Homo sapiens
tgtctgctcaggcagagtgtcttgaggtggtactattatgtctagtgtttgctagaatcaggggtactattatgtctagtgtttgctatagttccaaaagctcgattttcccgatattcttggaattcatcaggctctttgactcccattatccacaagaacagagtcaaatacaaatcacaaggccaatttactaatttgtattaatacgttattttatggagctccaccccttaatatgtggtattggtcaagttacttcacgttaatttattctcctcttctgtgagaagggaattttaactagtagctacctgatgtgacacttcaatgagttaataacatagataaagtgcttagagcattgcctggtacacagtatgtgctccaagaatgtcaaccactattgttagcacgctaggtagagtgctccactctaatatttgaaataacctgtgcctcctgcccaggactccctttctggtaaaagaatagcttaaattgcaga

SEQ ID NO: 172117 - DNA, 316 bp, Homo sapiens
taaaaactgggtatcaccatgttgtccaggctggtcttgaactcctgacctcgtgatctgcccgccttggcctcccaaagtgctgggattacaggcgtgagccaccttgcctagccttgttctggaattagtggtgattgttgcacgatcttgtgaatatactaaaactccctgaattttatgtaaaagggtgaattttttggtatgttatgtgaattacatttcaatttttaaaaattgattctccaaattatgtacatatttaaagagtacatgaaagagagggagagaaagaaaagctggatgcgagatgccg

SEQ ID NO: 172118 - DNA, 404 bp, Homo sapiens
agtaatctaatcaaatgagacttcactgtcctttgtactattttaattttcacaaagaaaatgtaggcatatggttcttgaggaataatgactaacactcatttagacataccatgtaccagatactgtttgaatcattttacacaaattaacccatgcatttctcatcatagtctgtgaggtatatactgtgtctattcccaactgtcagatgagaaaactgaggcccagagaggctaagtaatgtaaccgggccacatagcctagtaagtgataaagcagaattcgaacccaggccatctggcttcaaagtccatgcactaaaccacagcccgtgggcccagactggtggtttttgtatggcccctgagctaagaatggtttttacattttcaactaattga

SEQ ID NO: 172119 - DNA, 502 bp, Homo sapiens
attttttgaagggagttgaagaaaaaggaaaagaggtaaaaatattgaatgtaatagttctacattttaaatttattgtactgatgtttgtcgtactatgtaccaggcattttgctaaacactgggaatatagtggtaactggccctattgctgcctttttcctaataagatgatatgctggctattttattatcttatggcagaagtgcttttgttagatacacttcaatatcgacttaagacccttagaatgccaagatttttatgtttctcatcagatattaatcattaagcatataactattataagataagatattatactgctattcaagccagaagttcatttagggcagaagatactaggtgcttcccgtgtttctcaatgttctgtgtcagcctgtaaggtgagatgtatatagtctaaatgatctttcagttctcttatatatagatgggtaatgcggacatgcagttttgtgaaacctggcacttcaaaca

SEQ ID NO: 172120 - DNA, 421 bp, Homo sapiens
ccctccccaacctgcagaagccacaagcagtcttccctctgaaggctgatcctgacccattaccctaccccacagcctggagacatccaaatgaccccagcacacaaatggcccttctctgagagagtgtcctcatggctggaggccagaatcacactccagcttgctcttgtggttccaaagactcccatttgtaaattcctccgacatgaagatgcaatgccagcccatctgctctgccaacctattctgcaagatgggaatgaaaatgacttggcaacagcagatccctgccacccccttagaattcttcagggccaaactggcaacagcctggtatctctacgaagagtgcaagggagcccacattttgactaacacctactgtgtgccagttggtatcttaggtgacaacaacaat

SEQ ID NO: 172121 - DNA, 351 bp, Homo sapiens
acatacatacatatgcatgtgtataaaatgggatttgaattatagacttagacctgtcttttcatcaaaataaataaacaaacatgaatttacccatcagaaaacttcagttgtcaggacctgtgtctgatatttagctggggaaatttcccctgtcactggggtggtggatgttgtctcagagctgaacactgggctggtggggtcatcggaggatgatgaggatgaatcaaggctgttctcccactttctccagggctgtgcctgggaccatatgtgtatgtgtggctgagaggaggcatgggtcccaagacatgggtcatcagagactgaagctctccagggcagcct

SEQ ID NO: 172122 - DNA, 231 bp, Homo sapiens
cagcccttcactgactcaacacctttcccaccctgttggccacccacagacatgcaggtgactcaggagctgcagtcaggccgtgggctcatggtcacatgtgtcacctatcacgcattcaaggactcacgaaacaggaaggctgggatgaaacctcaggctcaggaggccagtgaagggaaaaatgcaagagcctggctctgcggacgtgttgggcgataacatgagaca

SEQ ID NO: 172123 - DNA, 532 bp, Homo sapiens
acacatgtagaacactggaaaaaatttagagaaatctagaatgaggaagaaattcagctgaagaaattgtaagtgttgacctagagaagagaagacatggagtgttcctgatagctgtcttcaaatattagaaagaccttcatgtgaaaggggcctggggatgtcccacatggtttctaagaggactggaactggtgcacacttcagggaggcggatttgtgatgagcctaagaaaggatttcctgagagacacaactggcagaagatggaacagaatgctttaaaaagtagtttcccatcatttgggatgttaaaataaaggataggcaacaacatatttaagttgaagtagattaatggaattgaatccatctagagcttgaaccagattatctttatgattacttttataaatctatacattttatatagtggcaagtagttgatataatcattaatctatatcccataatactgtattatggtttttaatttaaaatttttactattaaagtttaaaggagccaaatt

SEQ ID NO: 172124 - DNA, 413 bp, Homo sapiens
ctcccaccagatcccacaacactgggaaatcaaaatgagattggggtggggacacagccaaaccatatcagggtgtaaaagagttatatcttcctttgaatttcctgtcattctcttagtttaattccctgaaaaatcatgtatattttaggtggtttgctcccttttcccatggaatccagtggtaaaagcttataatattctgtgtatttagggtagggtttccaatattaagacctaaaaatatatttgtattaagtattttcaagtttctttaatctctatttttcattagaaaaaatgtgtctattaaatttcttgtaacctaagggaaacctcatctgtgaagaagtcattatctagaaacttcacttatctgattatttgatatgatgctggaaaaaggaaaagcc

SEQ ID NO: 172125 - DNA, 638 bp, Homo sapiens
agatggagtcttgctctattgcccaggctggagtgcagtggtgcggtcctggctcactgcaacctccgccttccaggcccaagcgatacttcgactcaaaaaaagagaagttatctctaggtaagatcatgatggaaattttcatcttactttatacctttcactgttgaaattattttacagttgaagtaaaggaaattttacaatatccaacaagagccgatgtcatttatttaatatcaaaattaatattggaaaaatgtctatactttaggctaccacccatctgcctgaattaatcagcattaatacttaattttaaatattacctgtcaacgcaggtcactgaatgtgatctcctttaaggtattatcatgtaataaactgctacaaaaagtctaattctctcaagagttttatagtcatccacttcattttcaggtcaacattttaacatattttcccatatttttttctgaagctttaatctctgcaaagcccatctttaaatttgaaggaaaaggtagaagagtgaggagcagcagtaattaacttgaatttggaacttggatataactaaagacacattttgcttcttcatttttatgtcagtttgcaaaggaaacagttatgatttt

SEQ ID NO: 172126 - DNA, 641 bp, Homo sapiens
caccatgcctggctaattttgtatttttagtacgtatggggtttctccatgttgatcaagctggttttcaactcctgacctcaggtgatccacccgcctcggcttcccaaagtgctaggattacaggcgtgagccactgcgcctggcctgaaaaaaattttaaagtttgagaaaatacaaaattttcatagtctccaagtatttctcctaagatctttccccctatgagggggaaagatagtaactttacaatggagaaacccagcagaaacctgaaccaaatgaacaagttcaacatcatcagtaagaagaactatcaatgccataactctgatggaatgcactgggaaggattccacatcatttttgtgctgtaattgccaaaagtgtgtaacttcagtccaatcatggaaatacatcagacaaacccaaatcgaggaacatttgacaaatagtgatcagtactggttcaagatgtcacggttatgaaagataaggaaagattgagcgaactgttattgcagtcctacaaaatggcgagagactaagaaataactaaatgcagcgtgatcctgggtggaatttgggaacagaaaaaggacattagtggaaaaagtggtgaaactccaataaggtctttt

SEQ ID NO: 172127 - DNA, 443 bp, Homo sapiens
tctatccactatttactttaaacttcattttgtgggattctgttcctgctagtctttgtgaagcttgtgccaacgaacatgttttctataaacagcagtaaaaatgtattcctattttctgcaaataaaaatgccatccatccttctggctcattctattcctcatttgaactctccctctctctgtcaaccttctattaggtacaagatgaaatatgtatttaatcatgaggtcacttaatcagtagatggtattttcatgatttgtttatggtattaaaacataaaatcaggatcattaaggttgctaacacctcacagaaagtggaaagcttttaattctgctgtaagccactgaagaattgtgttctaagctgtgataagtacaaatcatccagattgctttaaacgattactgacttcgcagaagacaaatcttaggt

SEQ ID NO: 172128 - DNA, 462 bp, Homo sapiens
gggtcacggtcaaactgttatgtcccggagccagactgcctgggtatgaatactaactccatcgcctacccactctgtgacctgaacaagctgcttaacctgagccaccatttttcctcaataaaatggtgataatcataacaatatttacccaaaaggatttttgtcaattttaagtgctgacaaaatatttaaaccaagtacagtgcttaaaacagttcctagtatatcataagagcttcataaatattagggatttaattcttggcatcttccgacatactagtgatcaagtttggcaaagtcgccaagtcactaaatgtgtgacttgcaagtcaaactgcctaagttcaacatttaccagatgggtaatcggagatgaactgttcaagttttctgtaactcaagtatccacaactgtaaaacacgtaataatacttaccttataaagttgtcagaagt

SEQ ID NO: 172129 - DNA, 270 bp, Homo sapiens
ctcattggagcttctcttagaaagcaaaccttccttttccagggccactggctcctctcaggacatctcacatgcagtgcaagtggccccactgagaaacattccacctatccagctgcacttctttctaaattggaagagtaaaggcaaaagaacagtatctactataagatccctgagaaaagccatcaagagacacacattctaatgccactgagagttggtctcttaaatattaagattggaccacaaagctgtacagttattcta

SEQ ID NO: 172130 - DNA, 850 bp, Homo sapiens
atatcacctcagatgagagtctggccgcttctaaagccaccacggagacagaggcaattcacgtttttgaaaatacagcagcgtcccatgtggaaaccaccagtgctacagaggaactctattcctcttccccaggcttctcagagccaacaaaagtgatatctccagtggtcacctcttcctctataagagacaacatggtttccacaacaatgcctggctcctctggcattacaaggattgagatagagtcaatgtcatctctgacccctggactgagggagaccagaacctcccaggacatcacctcatccacagagacaagcactgtcctttacaagatgccctctggtgccactcctgaggtctccaggacagaagttatgccctctagcagaacatccattcctggccctgctcagtccacaatgtcactagacatctccgatgaagttgtcaccaggctgtctacctctcccatcatgacagaatctgcagaaataaccatcaccacccaaacaggttattctctggctacatcccaggttacccttcccttgggcacctcaatgacctttttgtcagggacccactcaactatgtctcaaggactttcacactcagagatgaccaatcttatgagcaggggtcctgaaagtctgtcatggacgagccctcgctttgtggaaacaactagatcttcctcttctctgacatcattacctctcacgacctcactttctcctgtgtcctccacattactagacagtagcccctcctctcctcttcctgtgacttcacttatcctcccaggcctggtgaagactacagaagtgttggatacaagctc

SEQ ID NO: 172131 - DNA, 398 bp, Homo sapiens
catttggtacagtagtaaaacacttgagactcgtcataaatttagccccaaaggttagagctttaggaatttctgccatgggttgccatggttctgccacaggctgaggcagaccattgagacagatgccagaatattgggaccacattgtattataacttttgatattttacttttgaggctgtttaaagtattgttgtgtatgtgtgtgtgtgcgtgctatttcaggagtaggagtagggggttgggctatttggagaatctgatggaaattatagcaccattttccaaaaataatacacatccacagacacacacacacagagtatttagaaacagtttcaggatggccaggttagtaatccacctgtgacttgctgtaagggtagaaacttttc

SEQ ID NO: 172132 - DNA, 263 bp, Homo sapiens
gcggccgcctactactactactaaattcgcggccgcgtcgacgaggctgtttaaagtattgttgtgtatgtgtgtgtgtgcgtgctatttcaggagtaggagtagggggttgggctatttggagaatctgatggaaattatagcaccattttccaaaaataatacacatccacagacacacacacacagagtatttagaaacagtttcaggatggccaggttagtaatccacctgtgacttgctgtaagggtagaaacttttc

SEQ ID NO: 172133 - DNA, 181 bp, Homo sapiens
ccgttctgcttctgccctcaccgaccctgttctcatataaatctggccaacgaactgtttagcaaactgttccactggagggcagccccagtgggtgacagctccccagcaggaccaaaacacagcgacttttagatgtggtggactccctgaaacatggttaagactcctcttctgaaat

SEQ ID NO: 172134 - DNA, 272 bp, Homo sapiens
acacattcagcagtgtaaggagaacaaatggtcaatgaaaaagacttcagtgacgtatggagacgacaatgggaccatgtgaaaaaatcaagtaagaagataattttaacattcatacctgagtgtcaaacattctataatgaggaaaattagacttaaataaagctactaggtttccttaatgggacattattggtgactttcaagataatcactggagaacaaaaatcgaggacagtaaattaaagagtgaatggaaagcgatgaagcag

SEQ ID NO: 172135 - DNA, 303 bp, Homo sapiens
ggagaaagagtgatagggagatatgggggaaggggcaagagtcaggaaaagagaaggccaagtgtgggggctctgggagagaggcacactttcctggactctgcctggcagccaactctctccatacaagtgcctttccaggttatggtcattgttccctcttgtctcttcaaacctaggagtcagggaaggcttctcacaggttccagcccccaaggcgctgtagtctccctcttgtttttcctaaaccccaccctcagtattgtaaatagtccctttattaaactcccctcaagctcctga

SEQ ID NO: 172136 - DNA, 299 bp, Homo sapiens
gggattgctggggtatataagaaactgcaaaactgtattctgaagtgattgtcccatttcacatttcacatttccatcagcaatgtatgaatgttctagttgtacatctttttaaaaatcaaccacatgtccctttttgcaatagttgtgacaggcttttcagttttatttagatagtgggtctcttcagtattcctgaaaagagtatgaattccccaggtagcctctgttgtggtattttttagaaagagacacggtagtactgtggcatatccctccctacactccgcctcttggtg

SEQ ID NO: 172137 - DNA, 459 bp, Homo sapiens
ggttcttggaataactagagattttcagttgaaacctggacattaattgaaacttgatcttatctaaattttctggtttagctggcttcctttcatactacttgaacagagaaaggtgaagtaccacattgtaactgccagttgtagatagaagttcagattcccactcagccgtcattgatatcctagctttcttactgctaggcaggggttgagtactggcctcctgctaggtctccattccctgtctgggaggtgtagaaatgccacactactgttccccaggtagcgacccctgagacatcaagaccaactcctcctcttcctctcctttctcagcttattcaacttgaacatgacaagaatgaatacctttatgatgacccacttctacttaatgaatagtaaatagattttctcttcctcgtgatggttttttaataatattttcctttctcc

SEQ ID NO: 172138 - DNA, 514 bp, Homo sapiens
gctttgtcatttatcagctgtgtgacatgaacctgctctgactcagtttcccacactgtgaagcacaaatgaatggcccgtctgcttcgcagagttgcttgtgagcattaactaaaacagtactttgaggcagccagcatcgctatgatgaactcaacggtgactccgccacctgcttcggagtcctaactctaaacctcacttgtctgtgaccttgggcaattccagtcacttgtcccagccctcctcactggtctacccagcaaatgagattaccatataatgagataaaataagatacctaataaaatgatacaaacgagatatacagtaagataaaatgagatagggtgagcactgcccaaaatatgggtcagggcttagcagttttgctgatacagcaaggtggggagatggccactaatgctccttcatgtctgggactcccgtgactcttttgggggcccagatacctctgaaagtggctaatgcacagggattatcctgccagctg

SEQ ID NO: 172139 - DNA, 401 bp, Homo sapiens
aaagcagtagtttttgtttagagagtgctaattgtgtgccaaagcactatcctaagcttcttatatatctttacccatttccttgcctcaatgactcattactcatttaattgtcttaataactccttgaagtaagtattattgtttccatctcacagataatgaaactaaaatttagccaggttaaatgatttgctcaaagtcacaaagctagtgagttggaaagctgggattcggacccaagcgatattcccctaaagactgtgctgttaaccttcatgaatgctgcattatttacagtgcgccagatatttagcaaaatactgaacattttgctgtttttctcactgttatcacaaggcatttcaactaacgtaataataaaagactctctcctcaca

SEQ ID NO: 172140 - DNA, 463 bp, Homo sapiens
tggatatccaccttcccaacctccacctgaaatgtgcccatcgagtcctggcaccttttaccatttcttcacaatgaaaaaaactaaacgatggaagggaagggagtacccacgatcaccaaaccctgtcctctgcaatgtgaaatgtgctttgaagtcctttcaccctgaggcttgcccgccttctgctggtgaaagaagctgggggctaggcgcggtggatcacgcctgtaatcccagcactttcggaggccgaggtgggcggatcgtctgagctctgcaacccagagagtgacctgcatggagcgtgccagctgaatcccttgtcctgtgtcttctggctgagttctaccataggaaacaccgccacgtgggagaacaggaagacattgatgtctgggtgcttattcctaaagcttcctccctgaggtcacctggaggttgctgcatctctctactgaag

SEQ ID NO: 172141 - DNA, 275 bp, Homo sapiens
tgtcactactatgctattgaaaagttgatttctctgcaatgaaaggaaaatgagcactgtttatattcctaataaactacaaagtatttcagattaaaaaaacacactggtcagaagctcactgtgaaataccattatctttatattactggccaggctttgctaagctgtcaaatactgccctcaggtggcattaatggctcaatgcaagatgcattatacagcgttgttaatcatgctaacaaaaccatgttaaaacaaataaaatcaaaacc

SEQ ID NO: 172142 - DNA, 311 bp, Homo sapiens
ccccaaccgcctctcagccatgcgggaggccttcgccaggagccgcagcatcagcaccgacgtgtgacctgggcccgcccccgggatcctggccttgaaggtcctgagacaatggggggattcctttggcacacccacctggccccaggccccaagtggggcttggctgagccctcctggaatccctgtcctcaggggaggcccaggcttggggagcccccaggctcgtggcagggataaggctcattgaacacaaatgtgtcctggggggaggcacagctggggcctggagctagaaggaccaggtgacc

SEQ ID NO: 172143 - DNA, 611 bp, Homo sapiens
cacgtcagcatgtcagcagcggtcatagtctacaggattgtaaatgaccccatatctttccttcagtaagcctcaaagcttaaatacttaatattacaaggcaattgatctagaaatagatgacgctggttgttgaagacctaggtcttttagcctgggtcaccataagtgatcttttttctctgaatttaaaaaaaaaaaaaagcataattacaaagcgtaattcttccctcatttttcataatcccacagaaaactgcgtgtagggcagctcaaccttatcaacttatgcctcaactacatgggaaaaaactccccaataataactccccagtaataactcaatcatcttttaaagctgggtaagaaacatgcatcattaacaagctcaatgctcacagaaagacatggctgaggtagagtcctgaagcacgtatggaaaattttaaccccaccagcaaagacaccagcgaggttacccacacacatctctaagggccaggagagtgaccatcagtcccctaaaaaattggaaatggataatatgaatgcaaaattgctttcttcttcctttttggactgtggccattaccacccaaaaggccactggt

SEQ ID NO: 172144 - DNA, 457 bp, Homo sapiens
ggagttctcaggtcagaattaattcagggcctctgccttctggttgaaggttttcttaattatacaattcaccacaaataggactttcaaagagttttcaactggatgtggacatgaaaatgccacgatcctttacacaatgacgtgtatgtcactcaaatttctaaaatagatgaaaacctcaaaactttaacgccttttaataagtcaagaccatctataatttctggattgtaaaaatcacatgaaatgtatgtattttgctttaaaatatttcaagcaaaaaaaggtaaaacaaattcggcaaataattaacaaaagtaacatttagaggatgactatatgggtgctaatcacactatactttctacttttatacatggttgaaattttttgattataaaaaattgttaatttaaaaagcacaggaggttgaggatttgcttttgtaaaaaaa

SEQ ID NO: 172145 - DNA, 167 bp, Homo sapiens
aagggagataacctaacaatgataaagcagtcagcttaatcaggacaaagcaaaaacaagaggctggactaaacacatgcaaaataatacttatttttaaaagatgcctcttgcatcaacattcttgttcctcctcatgttttagctcttatgataattaaataaaa

SEQ ID NO: 172146 - DNA, 324 bp, Homo sapiens
tccctcactttccagttgggaataaataaactccatatcctctaggattgtcgagtcagtatctttgacagaaaaccctggctgagaagctcccactgaggagcaccatctgaagggcttggcacaatgcctggcctgcaaaaggcatgcaggaaatggtacttggtattatctaagtccatctccatggcttcccactagagaaaaagtcattgtggagaacatacttggatgtatgaaggcaatcagaaaaccagtcaatggcgtgctttcctcttctctaacctcagagtggatttggatgagaagactgctcatccccaa

SEQ ID NO: 172147 - DNA, 169 bp, Homo sapiens
gggcatctgctgacagtggagagcagtggtgggggaaggggcttgaggaaggtggcacccagaggggtggagaggagatgtctgactgagggccatctgaggtcacggtgcatcctgaggacagagctgagattggatatcaacgatgtgggctcagcagccctggagt

SEQ ID NO: 172148 - DNA, 132 bp, Homo sapiens
gaggtcgcagctgcagtgagctatgatcactagtcactccagcctgggtgacagaataagaccctgtcagaaaagaaaagaaaaggaagggaaggggaacggggcaaagaaaagggaagaaaagggaaggga

SEQ ID NO: 172149 - DNA, 633 bp, Homo sapiens
aaacaaacaaacaaacaaaccaggtcccacaggagccagtgtctcttacacaactccatagactgagtttccagggttctgtaaaagctatgctaattaaaagagccatcacagggaagtcaaagctatagcttccttatgaggtatttatggttcatttatagttcttgagtcttgatgcaaatttactaatcacagggatcatttttactacaagtagtgttacctaataacagttgaggtacctagttttacagatggccagggaacagagccaaaagagttaactgaagcttaactctactcatacttgtattatctgcagtgcctttcattaagaagtattccataatatttcttttgcttattttgatgtaatgtttttactctttttaaatttattattattgttattattatttttgagacagagactcgctctgtcacctgggctggagtgagctgagatggtgccactgaactccagcctgggcaacagagtgagactccatctcaaaaaataaaaaaagatgagttatctatttcttcaggcaggttcttcattagtatttcttacaactgaagttttaatgagaattggaaagcaaaagattgaagttagccaattttgtt

SEQ ID NO: 172150 - DNA, 514 bp, Homo sapiens
cttataaactaccactgtaaatagacagactcattaaagtgaaaggacattttaaatcaattagtaagcaaatcaattaggtggcaaagacaagattatttttccttatggtagttgaagaataatgcttaacctgtcattctaattaccaagcacggtgttctctttggaagatcatttcaacaaaacattattttcatccagaatttgaaccttgagattgcatggtattttagaaatctattttagaaatctttggcaaaggttactattaaaacaatcgcattcatggaaaatcagtataagagcaactaaaataactcacaataccagtaaaatcactttgtcatcttcttaagacttttaaagagcatttgtaagtaactgaatagaaggccaaagggtgtgtaggtagcccagaccatcagtgggcagccagggccagggcaggggccacggttgcagcctgcattcttctaaagggcagagcaaattaaagttgaagcaggagcta

SEQ ID NO: 172151 - DNA, 206 bp, Homo sapiens
tggtcaagcttgtctcaaactcttgacctcaagtgatctgcctgtctcggcctcccaaagtgctgggattacaggcgtgagccacagtgcccagcagaatatcctgatttttaaacattgggctgcacgttagattggccgggtccagttttgtgtagaacctgggcctgagcatgtgaaatgtgagctgggggcggtcgggcagt

SEQ ID NO: 172152 - DNA, 647 bp, Homo sapiens
gaccctgtctctaaattaataaattaattaattttaaaaataaaagaatagttgttgcttcttccctcaattaaggatacctttaagattttattggtgtatttattattaatttaaggctgagtttgactagatcttactagggattcctttcagtatatcacaaactagttatcagtgcctaatatttatcacaaatgtcccagcgctcctatcctcctttgtcatggtttatttttccccaagacaactgaaacgatagcatgtacttccatcagtaactgtggctcaccatagcaagtgaaattttgaaatgttctttccaattagaattaacacctttagaacactgtagtagtccaagaagcaaattgactaagtaatgatgcctactcagctgacagcattttgtgattgtttttaaaatgcacacttgtcggccgggcacggtggctcacgcctgtaatcccagcactttgggaggccaaggcgggtggatcacgagctcagaagatcgagggccatactggccaacatggtgaaacccggtctctactaaaaatacaaaaactatctgggcgtggtggtgcgtgcctgtaatcccagctactcgggaggctggggcaagagaatcgcctgaaccaggg

SEQ ID NO: 172153 - DNA, 606 bp, Homo sapiens
gcacccgcccaagcctcaagtcttgtctagctttccaaatgatctgagaatttctgatcctttttaacacactccttttttgcttaattggccaaagttagctttagatcgcctgcttatgcttggctagttgctgtactagactcttccatgtctgttacaaattttccatccaaacaaccctgaggtaggaattattactgtcccctttttaccaatgaagatgcagagtcagagaagctgttccttgcctgaaggtcacatagctaatgagggccagagctgggacttggagccctacaagctggctccagggctctcacattgaacttttgtgctgatctgcttctcaccctggctattaggtccaggcagaatgactgccaaaatctctagtgaggagctaagtcaaaagttggctggaacaagccaagtataagaaatggggtattgaagaggagacattgaacgggatgccgctcctggtctgagcctggctgccaggttcatgccgtgctccaccgcacattggggagctcagagctggacagagctggaggctgctgcagacttgatgcctagagcttcctgtccaccatggagctc

SEQ ID NO: 172154 - DNA, 481 bp, Homo sapiens
ggaatttgtttgttgtttgttgtttccttttatctccttccacgggcaggcgagcgccgccgccctcactggccttgtgacggtttattctgatgagaactgggcggactcgaaagagtccccttttccgcacagctgtgttgactttttaattacttttaggtgatgtatggctaagatttcactttaagcagtcgtgaactgtgcgagcactgtggtttacaattatactttgcatcgcaaggaaaccatttcttcattgtaacgaagctgagcgtgttcttagctcggcctcactttgtctctggcattgattaaaagtctgctattgaaacttctaaaactaggcctagttttagaagtttcaatagcaatatctattaacattgtcatgtacgtgctttgtggcagaaatattcacaaaaaataactttttaatttttttttttttttgacacggagtcttgcactgttgcccagg

SEQ ID NO: 172155 - DNA, 2621 bp, Homo sapiens
  misc_feature (1)..(2): n is a, c, g, or t
  misc_feature (606)..(606): n is a, c, g, or t
  misc_feature (1722)..(1722): n is a, c, g, or t
  misc_feature (2252)..(2252): n is a, c, g, or t
nncacaggaatgactcaactcccacaacaaggcacatcctttgtgaaatttgagaatgcccagattaaaaagaagattcttagagcagaaacaggtcacattcgaagctcagaatagcatcagaattttcaagaaccacctctgaacgcaggatggtggaagagtatctttaaaaatgttgagggatttgtggccttcagtgctgccaaggaagcatcattcaagcctctcttcccactgtgggcatgtctaaaccagagtctcctaaagagcccgaacagctgtggaagccttgaaacagcgaagccttgaaacagccgagtccggggagcccttctgaaccatggggaatgctcatgactgtgtggtcctagacccagactccaagcactccgggggctttgggttggtcatctgccactgtggaggagatggatgcagccatgaatcagggccacaccaggtggttggaagagctgtggaacctcagagagctgtctgaagagaagattctcaaagactgggtgcccatgtgactgtggaaaagatatttgttggtggcattaaacaggacaccgaagaacatcacgtaagagattattttgnacaggataggaaaattgaagtgattgaaatcacaactgactgaggcagtggcaagaaaagggtctttgcttttataacctttgatgaccacgactccgtggataagattgtcattcagaaatactatcctgtaaatggccacggctgtgaagtaaggaaagtccaggttgcagcaagacatggctggtggctcatccagccaaagaagtaaaaggggtcctggaaactggtggtggtcgtggaggtgatttggtggaagtgacaagtttggtcatggtggctttcatgccaaccatgatggtggtggatatggtggcagtggggatggctatcatggatttggtaataatggaagcaattttggatgtggtggaagtgacagtgattttggcagttacaacagtcagtcttcaaattttggacctataaagagaaaaaactttggaggcagaagctctggcccctatggtggtggaagccaatattttgccaaaccctgaaaccaaggtggctgtggtggttgcagtagcagcagtaggtatggcagaggcagagggcattcatttctgccggaaacaaggcttagcaggagaaacaaggcttagccagagcagcgacagggaagccacaggttacaacagatttgcgaactcaaccaggcacagtggtgtcagggcctagctgcttcagggatatgcttcagacaatactcatgtgtatgggcaaaagactcgggggctgtaattgtataacagggcattttagtttctgttctctggaaactgaaaacagtccaacaaagaattttaatgtagactatttttgcacccatgctgttgattgccaaatgtaatagtctgatcatgacgctaaagaaatgtgtctttaaaacattctgagggaaaattgtctttttttttttagtttttatgtttttgtgacagggtctcactctgtcacccaggccggaatggagcgatgtgatccttgttcactgtggcctcgaactgctggactcaagcagtcaacctaccccagctgcccgagtagctggggctacaggtgtgtgccaccacacctagctaatttttttatgttttctagagatggggtctnaccatgttgcccaggctggtctggaattcctgtcctcaagcaatcctgaacctcccaaagttctgcaataacaggcataagccatcacacctagccagaaacttatttttaatgtataattacatacccaaacaatcaatcaattatgatagcagaagaaagatatttttagatgtccagcatctcagaaatttgacctccagtgtgtattttctcaaggaaagaaactattagaggattgtgccaccaagtaaagtaaaccaaggagaaatggaagacaccaaatataagaaatggaagattcagtgtggggaagagattggaagtcttaggacgacagctgcagcaggaccagagagtagccagcctgacatgtcatccagagtgctccaggaaggcaagggctccaagagagatgtcttcagagaaagatgcaaatcatagattccttcacatggttgatcttgtttaaagtattgctcagaaggggttcagaagaccaataatagtgacatagaaaactaagcaancaaaatataaattcataactccatgaaaagcaatttgtgctcaaaaggaaatatgatgacagctaattatagatatttttgtgatggacagtataacatgtccctggaaaaatttattttctacggaattgagccctaaaaataccagagcaaggaacctatagcttaagagagtcctaaacaacatgatgaaacctcatctctaccaaaaatacaaaaattagccaggcacggtggtggatgcctgtggtgccagctattcgggaggctgaggagggaaaattgcttgagactgggaggtggaggttgcaatgagtgcagattgcaccactgcactctaacattattgacagagtgagaccccgtctc

SEQ ID NO: 172156 - DNA, 723 bp, Homo sapiens
ttgcctttgtgttgcacacttatgcaagcttggttgcctggattcaggactccattggggtccaaattcttgcttcagagagtctttgttctgatggtaactttaattaagagctttgcaagtccctctgtgaagagttgctccattagaacttaagaactgtccccagagaggtcgttcctgtttccgatcctccaaactccaagcccagatttaccagatgcctcccttagagggctaacgagcaggcactatgggggcagagaggtcctacctgtacgggatacaaggattcacacttatcccatcatacccctgctgaagggcattaaatgcttccctgttggcctggcattcaaaaattggagaattgcattttgaacaccggcctctgcaaatggagtttgctagggttaaactgtgagggagatgggaagtgaccttgcacggtaagggagagctgcattggtcaataagacttcctagaggaagcagagcttgggcagccagtgcaacttgcagatgcagagggagaggaaaaagctgccaggcaggggatgcagcatggtgcagggcatggaggtggaacagggtgagactgagagatgggccacagaagctctaggtcaccacacccagcggcgttccgctcctctctctctttctctctctcatcgcttcacccctgtggtccctgcaaagttgggcccatttcctcttacc

SEQ ID NO: 172157 - DNA, 572 bp, Homo sapiens
ccaccatcaactttaggaggagggaaaggggtggctctgggaggaaaagccagaatcccctctagccagcagagagagaggaatggctgcatgttttctcccccaatccaaggcactaggttttggctaggttgcaggttccaagctgctctcctgctgtgtcggtgagttctggttaacctgcaacctcctgatgtggccactgcagttcatcgagtcttcagggactccccatggcctggagtactttgccttgcttacatgggagaggagaatggatttatagagaacatcatctaaatccaacttgaccattgtgtggccacacttgctagattgctatagtctaaatctagcattgtagaaagacgggggagcttggagctgcacaaacccaggtctggaacgggctccttaccttggaaggtgaatgatcctggtaggactcttagcctccctgggcctcagtttctttatctgtttcatgggaatgaggatctcggctggttggttgggtgatgcgggggctgtgtgaaaacagcttgtcaatacaagctgaaatagaaatattt

SEQ ID NO: 172158 - DNA, 970 bp, Homo sapiens
tatgttgaggggactccaaagtaggatttctcaccacactggtaaaatagggggactgcctattttagtctcatttagggataagtataatggctgtttcctaaattcagagttctgtagtaaactgataactaagagattcttttctgtcatttttcaaataaagcattgtgacatctggtgaaagaaaaaaaaaaaaaaaaaaaaaaaaaaaatgttggggggggccggggccctggaaaaagttttaaaacccattcgggtggggggggggggcccagtatagtgttaggtgtgaaccggggccaaagggggtcccaaaggaaaaccggggccaggacacaagggcggggctctcctcacaccaattaaaaaagcccggggggaaaaccgaacggttccggaacaaaatcccgaagagggcgcacgagggggaccaaaaggggggaccatcacaagcagggagtccaaaggaaagcgcgagaacattcacattaagccaggagcgcgggacacaaacaaaacacacgaaaacaacaacaaaacgagaaaaaacagagagagacacagacaacacgaaagaccagcagcaaaacagagagacaaagagcgaaaaacgcaaccagcaaacacacggcgagagccgaccgaacagcgagacgcagacgaaaagaagaataagccaagcgagacgagctacaaacacaaaaccagacaaagcacagaaaccaacacagcggaacaaagcacaaacaccacgagaagccgtaagagccagggaggagagacccgcaaaagagaaggaaacaggagcaggaagaaagaagcgacccgaaaactaacgaaaaagcggccgaacaacacaacaacgggcacaccacgaaacggaaaacagacaaaacaccacgcaacgcaacgacacagagacgaacagcgcggcaaagaggacacacacgagcaaacagcagaa

SEQ ID NO: 172159 - DNA, 251 bp, Homo sapiens
tgtgctaaggaaagaatgagcttctccatcatacacttggatggggctttctccactgtcagttgcccattgacttggtcctaaaagtgggtctgctaccttgttcctcacgtgatccccagggttgagtcttctggacacccctaggggagaaggcccctaaaggccaatggtgtgctcacatgtcctcctggaccctgctagaagtggggcagaggaagtccagctatggctttttacatgcgcaggat

SEQ ID NO: 172160 - DNA, 271 bp, Homo sapiens
gagtgataagtacatccactgagctatgaggctgctacgggtcacaggagaaaggaccaagccaagaaagatggcaatggggaagaacaggataaccccaccctgatcatctctatgtgtctttgccctgctggggccccagatggcggggtgtaagagtgctgatttttaactagataaaaattattaaatccttcctccttgggtccctctttggtgcccaaccatagggctgagccccatcagctcaagctcacatagtcacagaccg

SEQ ID NO: 172161 - DNA, 145 bp, Homo sapiens
tcgcttaaaatgagattagagaagagtgtgaatggaggagaggtctgaggactgagttttcaagtgccccaacattaaaagattaagaggaagaggaggaatcaggaaaggagactgagcagggatggccaatgaggtaggagga

SEQ ID NO: 172162 - DNA, 1244 bp, Homo sapiens
tgacctccagagctgtaaaatagtacatttgttttcagctggtaaatttgtggtaatttgtaacagtggcagcaggaaactaacacatcatcttgctccagatattgacacccagactcttacttgggagagaacaaaattctatcttgtctaagccaatgccactttggcctttgccttagagtcaagcctgccgaaggattttctgtttcttttgacaaagacgcagggattgaagggggtggccagttgctcaagcagtttagctgcatggcagaaactgctagttgtcatccctcaatatccatcctaccttttttccatagtaattgaatttcagctgggttcatcatcactcagaataaatactatatttcccagcttctgtggcagctaggaatggtcatgtgactaggctctggccagtgagacaccaactgaaatgttgtaaggctttgctgtttcttcttcagttcttcctttctcctgctccctggagctcggatgatgccatctttgatacaaggtcaagaccccagagcaacaaggtagcaggaacctgggcctctgcaccatggaaggctattagacaaccttgctaggcttctccaggaaaataaatttctaccttgtttaagccactgttattttgggttttctcccacttccagccaaaacaaatcctgacatgcagtcatttctggtactgcttctcaagcttttgtctccattcactcaagttttattctgaaggggatggttttattctcttggtaagtacatctttactagattcaaattttaaaagtattatgatgatgtctcttcctaaccattttacatggtatttagaccaccaaagatgacctcacaaagtagctttatacttctgggaaggaacaccaggccaccagcatgtgggaattccattggtggccagctgaagcacctggtctcattcactttactggcttcactgcaaactgcgtcagaggtttccactgaaatatcacccaaatgagcccagtgattatcctaaacacttgaatgaagagctgatacataggagccacttttgcttctgccagagtcccccagacttgttcctacctgcagatgccctgttattcagtccttacctaaatacctgctagagctgcagagtctataattcttactgttcatcctaggacacattcattacttgaactggagaggcagcaaggactgcccacacccccaaa

SEQ ID NO: 172163 - DNA, 345 bp, Homo sapiens
ttaatctgtaccctcccctgtctccctttcttccctcctcttccatccctatttctcttctctttgcttccattatggcagagtatcaagtcccacgtctcactctcatgtatccccagaggaaagagctgctcacattgaattgggagcgtttattctgcacctgagtggagcatcagagctttgcaatattttccgtgttgaactcatggatagaagtcagatgatcctatgaatgaattttaccttgggatgagttaatcaagactcagttccccagtcagttttctggaacgccataaaatttaggaagattagcttgtacttgctgcttgggcttaaaca

SEQ ID NO: 172164 - DNA, 1069 bp, Homo sapiens
  misc_feature (850)..(850): n is a, c, g, or t
  misc_feature (852)..(852): n is a, c, g, or t
gcacagaacaatagctctaagtttcccagaccctcgtgtggaggcttggtcaaaaggcgaaacctgaagaaatactttagcacaggatgaaggaggaagtggcagaagggtaaaaccaacccctgtcaaacttcaccaagtggctctgccccggactcagctccaccacatcctactcttattgggagccaagcaagaaggactaaggtgactgggacctgggcagtgggagaatgggcagtgggagaaagatcatgaggaagcagaaggggctttgttttggtccagggaaccaaatccagcactataaccgccaccagtcctgggagtcactggcagaaaaaatcagaacagggaatgcaaaggtgctgctctgcctctactgagcacccctccccatctctaagcctcattcttatattctataaaatggggattatgacatccacctgtgtgtcctgttgacctgtttgtaaaggtagaataaggtaagtgagtatgaaagcactttaaacatgtaaagcactatattacaggctttttctcactcaactgaccctagtcattaggatgggtagacatgacaagaaggaagaagaatgcagatgccggggagcagagactgtgaacatctcaattttgcataacagaactatggtgatggtcttatggagcagctagtccaggttctcatttgacaaggaagctaaagcccaaagaggggaatgaatgttccatggtcaagagatgatcagaggacaaacctggtcccacggatgccaggccagtcctttatcaacccaaactctggttgcccaggtgaaggtctctagaggagaacgcaggccanancaagggggcacaccggaaacgcgggaaagaccacaagaggacagagctcaggggggtagtagctacatggaaaaaagtgaagcacgaagaccaaaaaaacatataaaagaagaacaagacgcatacacagtaatgtcaacaagcgaacaaatactaaagcgactaaataaatatttatatattgctgttttttttttttcttcttttaggagacgga

SEQ ID NO: 172165 - DNA, 673 bp, Homo sapiens
gagagggaaggcggggaatgctacagccccaaccaggaggctgtttaccaggctatttgagaagaaactgataacaatatcaagtcacttcaaatagtagaaaaaacccacttgagttcctaagacaggaccagtaggatggtcccaaagcccaaccgaaatacaggtaacagtttcatatccatcgacatacagaaaccagtaattagtctgagcagaacaatattgacagcaaacaagctcttggcaaagaaagaggttgagttccagagtagaaagcaggagttttcacaaagaagaaaaacgacagagtgtaccctttcttaaaggctttgctcagctcacaggcccagcccagggttgaggcaggcccagggcagggctccctgtcctgctcgggggccctgagcaagccttaatattatggtcctccagcacgctgctgaagtcggcagttggacccttcctggctgagagccatggatacttggtggtgtgaacagacactcatggctcccgtgtgaggagcccgtttccccacagggatcagatccacagaatatgccgcctttggcaggctgtcaaagggttcctttattctcctggggcaggactggctgagctctgctctgtaacctttggcagagatagagcactgatgtcctctgacgca

SEQ ID NO: 172166 - DNA, 581 bp, Homo sapiens
gcaggtgggccatgtgtcccctgtccctaggccctctctgtctcctccacacagaggccaagagcctctgcaggatcttgaggcccatgatgttgtttgctcacagcccacttcactcactgtgggacctgcttggtgcctggtgaggactgttcctgcccctagatgtggtctccagcagatatttgcttcagcttatatttttggacaaaggaatggagtgacatggataatatttaaattggaatggactgtgccttttatctgaaaaagttctctaattatatttttcttatcctttttgatgtctcaagaaaactcactaagatccgtttatacaaacatgtttgaatttgacctcacaatggactaggctttgtaggagactgaactcatggtaatgaatattagtaattttggtggaatttttctgtggtaaagaatgaaacaaggaataccaggaggattgggccctaattttccccagaggggtccttcttttaggcctcactttatcttctagcaagacagctgtggtgttagacttctgctccttggcctaaaaaaagctggggccctga

SEQ ID NO: 172167 - DNA, 145 bp, Homo sapiens
ggtgattctagaggatccggaagctgcgggaatcatctagagcttccaaccaaagggaaaagaggaaaattttgctagctcaggctctctaaggatctaaaggaatggatttcacttttctgatattgcccagccccacccactc

SEQ ID NO: 172168 - DNA, 120 bp, Homo sapiens
aaagcaaaccatgctctgtccagagatgaagataaattgggcatgataaaaaagaatcttccttggaaaagaacgacctgacagtgtgatttcttctaagatgtttctatctatacaccg

SEQ ID NO: 172169 - DNA, 741 bp, Homo sapiens
gccacggtgtggcctcagcatcagggatatttgcaacatccatatggcttccagaacaagagagcagggaggtcggcatctacgattaataagacatagagaagtcattcaccagaagtcctcttagaaaaagcagtgcttttgactggaaaagaatgatgagttgcaaaagtatgatagaggaaactgaggtactgacaggtcagagcgcctccgagagaaaaaggcggtggccttggagctctggtctccttaactgcaccctgggaagtcttcacacggcctttcttcccctggtggtctaatctggagtcagatccagccgtcagctcttacagacggggaaggaccgggagccaacgggaaaacaacaggtttctataattcatcattcactcctttctgaaaacctagaatgaaaaagtttagcagctcagcgccgcggcctctctccattctctccccaaacacatcggcctgtttgttctctttcatccccgctcttcctgttgcattctgccggttcaatggggaaggagtgaaaccggatggctggacccagtgcggggaaatgacttcagagccacctttgtttccctcattcctttgagcgcacttggccctgcgtctctatgaaagggcttgtttgaaccattcggaacatccagcaagccagagatgctgcggccagaaccgctcgcatcttttcaggctgcctgagactctgggttaaactgccaa

SEQ ID NO: 172170 - DNA, 417 bp, Homo sapiens
ctcctgctttgctgggtatctctttccataaaacccacatctccacagaatctttgagcgggatcctggcggtcacctagcactcataataagtcaaaaaaaaaaaaaagtgaggactgcaaagaagtgacttgtaattcagtttaatttcaattcaactaatacttactgattctgagtagggggtcactgtgctatgctctgaaaaaggacaaaaatataagcacctcaggtccttcttgccaaatagggatatgaccattaagtgcacacatatatttaaaaaatcattctctttatggcttctggattaaggactctttctctactctgagtttataaacatactctccagtattttcttgtaatgctttagggattaggtttttgttatctaaaatacttttacaaaacaaa

SEQ ID NO: 172171 - DNA, 487 bp, Homo sapiens
tgatgtgtcacgaatcaaactgtgtatttgaaatcaaaaacagaataaacagtttacaagtaataactctacaagatttaaaagtgagggtaatgacttccatagatatgtctcctagagtaaataggaaatcgttaatgactatttcatgagtgaagtttcaatatattttttaaaattcagaataaacgtcaagatggacttcattttacctaacacaacaacttggtcaccctctcatcctaaaaatctctataagtaaaactgattataaagatacgttaaggcagtacatgacttgctatacagtttaaaaaattatatgattgatgtgctttctttgatcattaagtcttgcaaaaatacttcttcaacctaaagagagtaatagatttgtttctaaactacctatttattctggtttttgtaccacctagaacataaatgttaaaaaatcttttaatctaataaatgtaactatttgtta

SEQ ID NO: 172172 - DNA, 344 bp, Homo sapiens
gtaagggtacctggacttgcggctttttaggtcggcctggctccgctccttccgcggtgacgaggtcccccggcctcctagggttgggaagagctgctttcctgactctcgttccctgcctcaggcttcccttatcccaatcgcttcgaacccttggctcagcgtagaggagtcaagcctggattctagtcccaccttgcccattagcagctctgtgacctgggactgttcacttaccctctctcagcctcagtttccgcatctgtacaacgagaggtcctatctcttaggtccttacaatttttaaactctgggattcggtggcaattaaatgtgtaatgaca

SEQ ID NO: 172173 - DNA, 624 bp, Homo sapiens
tgtagatctttctccttcaacctacttttctcttttaaatattgaagccctgacagtcatctctggagaaaggcacagaccacagactctttctgtaatttcgtgttcttctaggtatgtccttaacattagctaaattcctaaagcaattgagacctgtctcagacactttttggtttacacaggaaagaggcatcaagaatgactcaagcctttaggtctgaacgctgttgattggggccatttgctaagatagagaagatgggctggagcagctaggcatgggaagttgtgaggcttgagaagctgcttagagaagcaaaggagatgtcaagaaaggtaacggagtgtaggagtctacatgggaggcatcttcaggcacagtgagttaccaggacatagagatgatatttagagacttgggtctagggggctgggcgcagtggctcctgcctgtaatcccagcactttgggaggccaaggcgggcccatcacctgaggtcaggagttcgacaccagcctgactaacatggagaaaccccattgttggggaccagcctcgacacttacccggaatgagaagagacaggttaagagctcataaaggtgggagccaggggacca

SEQ ID NO: 172174 - DNA, 153 bp, Homo sapiens
cctttaaacagggctccctcacaggtgcactgggaaggtttggggaagatgtaaatccaggtatctttttccaataattaaaatcagcaccttgatatgtctctggcattgtgatgtacattttaattcttattttagagacaaggtttcact

SEQ ID NO: 172175 - DNA, 147 bp, Homo sapiens
gcagatgatactgtcattcactaagactggaaacacctgaggatagacaagtctcagtgaaaagtggtgattccactttgggacccacttgagtttgagatgccccgagaacctcaagcggacacgcttggcaggcaacacagatcg

SEQ ID NO: 172176 - DNA, 650 bp, Homo sapiens
ccagaatccacccttcatgctgctgctaaacatcatcctttctaggttttaaaaacatttgatagctttccactgacaatagtgaagatttcaatttctggatgccatgcatgatcattataggatctgatcccaaattatcttttcagtctctcctgctaccatattctgtatacatacactatgctctggccatactgatcagtcacaacacatactgtcaatgcttccacgccacttgagcacaatatgtcgtcagcctacaatgttcttcctgcaaccctcaatctaattctaaggtatccccatctcaccccataagccccaggcaaagttaggaacatcctcatcagtactcaagttgtactatttatatacctttttttggtatttaatccgctagattttcagcaaagaactggagtttattcatcttttaacatcaccctatactttgaactaccatcctcaagtaagtgctcaataaatatttgttggatgaatgcaaacacactctttttaattcctacatcattataattaactgagaggttggagattttacaaggactctgttttatgtgtcaggcaagctaaagacttgaaaaaatagaaataaaacagaagggtaacagatatcttgaccaaac

SEQ ID NO: 172177 - DNA, 596 bp, Homo sapiens
ccagaatccacccttcatgctgctgctaaacatcatcctttctaggttttacatgcatgatcattataggatctgatcccaaattatcttttcagtctctcctgctaccatattctgtatacatacactatgctctggccatactgatcagtcacaacacatactgtcaatgcttccacgccacttgagcacaatatgtcgtcagcctacaatgttcttcctgcaaccctcaatctaattctaaggtatccccatctcaccccataagccccaggcaaagttaggaacatcctcatcagtactcaagttgtactatttatatacctttttttggtatttaatccgctagattttcagcaaagaactggagtttattcatcttttaacatcaccctatactttgaactaccatcctcaagtaagtgctcaataaatatttgttggatgaatgcaaacacactctttttaattcctacatcattataattaactgagaggttggagattttacaaggactctgttttatgtgtcaggcaagctaaagacttgaaaaaatagaaataaaacagaagggtaacagatatcttgaccaaac

SEQ ID NO: 172178 - DNA, 633 bp, Homo sapiens
gtcctgtgtatatgtatatttctcttctgaaatggaattaaatcagtcttaatactgaaaaatactagccaaatatttgatttcttttatcccttatatatttttcagatttcattattggtttttaaaagacatttatgtgtacttttactttttctaattactaagaagaatattcaaacctttgtccatgactttaaattacaggaaactgtttcaaaaacttatcagtagtacatgatatgagtatgatttgtttttagaagtttcaaatgagtcaccttgaagtcatggagaggctaccgcttaccacatttaccattctgattaatttttcttttggcaaagtacaaatcagtaataacctactaaagcctagtggttgctgttgatatttcagtaaggtgatgttgattaatcagagtgattacttaccaagtgttacagatttactcaaattattgggttttcttctactatagtaatttcatatgcagtaataatttgcttaagacattttgcttcatatgtgcgttgaaaatatcaatgtagaacttaaaatttgtatccatgctgcaagttaatgtggttgcctctgtgaccgttgaacatagtttcataataaagcctgga

SEQ ID NO: 172179 - DNA, 401 bp, Homo sapiens
gcggccgcctactactactaaattcgcggccgcgtcgacaatgagtcaccttgaagtcatggagaggctaccgcttaccacatttaccattctgattaatttttcttttggcaaagtacaaatcagtaataacctactaaagcctagtggttgctgttgatatttcagtaaggtgatgttgattaatcagagtgattacttaccaagtgttacagatttactcaaattattgggttttcttctactatagtaatttcatatgcagtaataatttgcttaagacattttgcttcatatgtgcgttgaaaatatcaatgtagaacttaaaatttgtatccatgctgcaagttaatgtggttgcctctgtgaccgttgaacatagtttcataataaagcctgga

SEQ ID NO: 172180 - DNA, 633 bp, Homo sapiens
gttttgttccttttgttccaaatggctttggctattttgggtcttttgtggttctatatgaattttatgattattttttctatttctgtgaagaatgtcattggtactttgatagggattgcattgaatctgtagattgctttgaatagtatggatgttttaaccatattggttcttccagtccatgaacttttactgtaacccatcagttttggtatgttgtatttccattttcatttgttttaatgaatttttcaatatccttcttaatttcttcattggcccattggtcattcaggagcatattgttaatttccatgtgtttgtatagtttccaaagttcctcttcctattgatttctagttttattccattgtggtcaggaaagatacttgatattatttccattttttttaatgttttaagactgattttggggtctaacatattctctattcttgagaattatccatgtactgaggagaaaaatgtactgagaagcagcagccaccattggatgaaatgttctgtaaatatcaagtatcaaatagaccatttggtctgtaatgccaattaagtgtgatagttcttctttgttggttttctgtctaaaggtctctccaatgccaaaag

SEQ ID NO: 172181 - DNA, 629 bp, Homo sapiens
cattcatacacaagtgtgtgtgtggacccatgttttcactgatcaaggcctaaatacctacgtggtgcttcgtgaaccctggatgctacagtctctggccacagcactaaatgtatgctgagatctggcttcacggtcgagggtgttgctggttttcaatgtgcctgacataggatcaatggtgaatgcaccacaagcctcatcagtcagaaaatactcagtttgcccattcaggccttcatccttgtccacagctgaaagcacaagaaccactgttcccacttcagcatcttctctcacagaggactggtaataaagtgtgggaaaagaaggactgtggtcattggcatccaaaactctaacttgcaggtgtattacagagctcctaggtggatctcccaggtcagagcacagaatgacaagggtaaaattgctgatttgctcccggtccaaagcacgagtggttgagagttctcctgacatctcatttatagtaaagcactcatcagtatttccatctattaaagaaaacaattacaaattcatttgaattgaaaaagtagcagctctttgctagcactatctatggtattcatttatacattcattaaaaatatatttattcccga

SEQ ID NO: 172182 - DNA, 120 bp, Homo sapiens
agccaaaggtttatgtatatgttttattcaaacactgtcttagaaaccatttgccctgaggatgtgtcctctattttgtcagtttaaaaaggattcttttcagttagtgcattctcatta

SEQ ID NO: 172183 - DNA, 170 bp, Homo sapiens
agttctggaggcttaaagtccaagatcagagtgccagcatggttgggttctggtgagggccctcttctgggttgcagactaccatcttctcatatcctcatgtggctgaaagacagagagagaggtctctggggtttcttttataaaggcattaatcctattcatgaaag

SEQ ID NO: 172184 - DNA, 559 bp, Homo sapiens
agtaaaagaggaaggagctcctgggtgacctgaagcatccatccctagacagcagggacattgtcagattccccagaatgcaaccacttctgatgagcctgaagttccagggaacacaacagaaggcttgatattgcctgatgataagtccctagacagtagctgcgagcttgagcactggggtctaatcagacactccagggggaaaggctccatacccacctgtccagagtaaacaggtatggctccatgccctggggttagacagagtcacctgaccagtgcaggcagaaaaaaggcccacagctgctccatagaaggaataggactctatcataaataagagccattgtccccaaaataataatattaaaggtaagggcaagacgctagccagtgcctgccttaggttgcctgtggttcagcctatccgtgtgctgtagtcacaccaattctgaacctgtccacatgcatcaggatgggagttgagcagaaaggccccctgatgtttattgctgctctgctgtaagcccagccaccaggttaacaggccactggt

SEQ ID NO: 172185 - DNA, 247 bp, Homo sapiens
ccttttgtttcccatatctcagttttctttttgtctcctttcttccttttgttgttcactaaggaatatttaaaaagtttcgagtattataaaacattcaacttttggggaatgagatggagatataataaatggagataaatatgtacatttaatatcttcattttacaaaagaatctaatcaccattaattacagtgttacagtatgccctgttacagctgagagttagggttttgcatccacta

SEQ ID NO: 172186 - DNA, 224 bp, Homo sapiens
taacactgtgttgaatagaagtggtgagcaggattgtggcgagggtttgcagttttgtcctgcagagggggtgctgggcttaaacaccaaatgaatggctcgtggaagagggactgcgatgtctgaggccctgaggcagaggactggggccaagaaatgcagctatgagggggtaactggaagatagcactgggaacagacatagacacaaggtgcatatagat

SEQ ID NO: 172187 - DNA, 419 bp, Homo sapiens
ggagtctgagaaacataaatgtgcaatttttctactctactgaaaacacatgtccaccaaaagcaattccccctttcttctaaagtaaaatatgatcatctttcaatcacttagaaactaaaagcttttatacattccaaaaggcctagtttctttgtggagcttaaacaattgtgtcactaccaaatcttctttcctactagcagaaagaaccacataggaagccaaatccaaattcagacttagactaacacagaacaggtctgtgataatataaagtctatccctgtacttatctttattaggtttctataattagagtcaagttgctttttacgagacaaaaataaggcaaatagctcagaaagaaaagacaaaataccttttagtttctaaatacatactttttttttttctgg

SEQ ID NO: 172188 - DNA, 229 bp, Homo sapiens
aaagacatttccctgtgggcatgtggtgccctccactggggccagaattcccaacctgcctcactctccccatctgtgaaattggctgattccctgaggtccctcccagcactgactatcaagtgacagagaacctagaaactccaggagctccatcagagccctgactacctgtccaagtgagactgtgggagcctcactcttctcacacctgtaaactgagggtgct

SEQ ID NO: 172189 - DNA, 448 bp, Homo sapiens
aaaaaaaaaatttagccgggtgtggtggtgggtgcctgtaatcccagctactcaggaggctaaggcaggagaatcacttgaacctagggggtggaggttgcagagagctgagattgcaccactacactccagcctggttgacaagagcgaaactccctctcaaaaaaaaataaataaataaataaaaataaaatctgtactcacatcctagatcaatactaacttaaatgtaaaaaattaaaaaaaatttaacctgacaatttatttacacaaaagacaataataagccaggctcagtagtacatgccaattgtcccagctatttgggaggctaaggcagaagtatcacttgtgcccaggaattcaaggctagccttggcaacatagcaagattctgtctcttcaaaaaaaataagacaaatgacaaaataggaaaaaaagacttgca

SEQ ID NO: 172190 - DNA, 510 bp, Homo sapiens
tacaactatctgatgacaatattcttcattcttgtaagctcagttaacatcttttcacttcccatctgataagtgctagctgctgatttttttgctcagtatctccatttatatcaatttattttcatctctagagcagcgcatcaggctgctctctcgtgaatatattgttacttttttctggcactggaatatacaactatccatgacagcaaaatttgagggccatattgagatcaccggctgatatggtgaccatgtaaatataagtttaaattgcttagttccacgttagaatagtttaatcaatttctgtcccagaaactggatatgaaacaggttagatgaggaagcttatatggaaaaaaattatctttcatcctctccacatatacatttttcctgagactaggtcatatgtatattcattttgtacacattggggaattggcatagtaatttattcaacaaacattaattagcaccttactttgtgacaaatctgtaaaa

SEQ ID NO: 172191 - DNA, 142 bp, Homo sapiens
ttcaaaagctaaaaaagaaaattcagtctcagtaaaaacaagctgtttcagcttaaaactagatgttgttcaaatgaagttctgcatacacatagtacttctcccatctttgccaagttccctaagatatatagcatccaca

SEQ ID NO: 172192 - DNA, 429 bp, Homo sapiens
caggcaaacaccatcctacggacacccctcttctcctggacagacagcaggtgagtgactggccactagagcaaggacgcagcccccagcagcaaagcctttcggcggccgtggccctgcgctctgaagccttcccacgtgcaagtcgcgttctttacacggtgctctgtgcacttactctggactgaacaggggagagtgacttcaaaacaaaacacaaaaccaccaaaccaaaacttcccacttcgcctaatactccattcagatcgagaactcaaggaacatttgttcaacacgctcagaaaatgcagggttagtgataaggatttcagttttggaccgaaatggatcttaaagactttcaaacttgatgcctttaacctcttctaggagataaactcccagtgaactttctgaagtttctgcttc

SEQ ID NO: 172193 - DNA, 407 bp, Homo sapiens
caaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaat

SEQ ID NO: 172194 - DNA, 516 bp, Homo sapiens
tccagcaggaagtatgtatccctttctgatgcaaatatgaaaaaagaacgtttaaccactatttattttaaatagcaaccatttgtttctgttggcattcttgctgggaatgtacagttttcttctgaactgatctactgctgcagtggagaaatagttagctgaagggcctcacaaaatggcagcttatgggcagccaggaaatcttcttatggccagctacaattgctcacacatctggaggatcacctaaaccacacccagtggtcatcacttctctgctggataccatgatgtatgccttcagatgataaagaagaaaaacagtgcaactaggtaactttatatatatgaactgaataaaaacagtttactcactgacttataccattttaaataagaagctggagcttcacaaatgtgaccatttcaagttgaataatacaagtatgtataactgaaggttaggggtaaggggtcagggagaaggaagcccttgtggactactagcaggag

SEQ ID NO: 172195 - DNA, 433 bp, Homo sapiens
tattttaccatatacatcaaaataaacaagtgtacattcttttatacaaatggagccaacaatgcttgctgttttgtagcccatttgctttaaatgatatgacacctttatgtgtaaataagagttagatgttaaattcaacagtttcacaatagttcataattcataaaatcaaccacctactgactgtaattaaatagtttctggctttttgttactataaataatatgtgggcgcggtggctcacacctgtaatcctagcacttagggaggccagggtgggtgggtggcttgagctcaggagttcaagaccagtctggcaacatggtgaaacccccctgtacaaaaaatacaaatgttagccaggcatggtggcttacacctgttgtcccagctactcaggaggctgaggcaggacaatcactagaactc

SEQ ID NO: 172196 - DNA, 246 bp, Homo sapiens
agccaggagagagtgcttctgtcatagtggaggtcttgacttgtggacaccccagaaatggactggtttggcctttgctacaaaaggagctgtcaatttagggactgaaaaaggactgccactatgcatattgaaagcctttgcttaaagatgcattcggggcttggtgcggtggctcacgcctgtaatcccagcactttgggaggccgaggtgggtggatcacctgaggtcagaagtttgagacc

SEQ ID NO: 172197 - DNA, 345 bp, Homo sapiens
catttgctttaggcattcggcatacctaatgatttccatctttgtctcaacattactgttttcactttactgtacttgtttccattctcactcattttataaagtaaaggtaaaatgcaataaaatattcaaccaattgtgcaaatcaatactgttctatgaacaaagatgtgagttcagtgaaacaaaattatcagctggcaagcagtgccaccatcaataatattaatagaaatgtgtgtttggcagctgatatacaaaaatccaaattaggcattaaaaggccatttaagagtgtcaatgaataatgcttatgcattcaagatgcacaaaagccaaggacca

SEQ ID NO: 172198 - DNA, 555 bp, Homo sapiens
catgcccagctaatttttgtatttttagtagagatggggtttcgctatgttgcccaggctggtctcaaactccttacctcaagtgatccaaccgcctcggcctcccaaagttctgggattacaggtctgagccaccatgcccgaccaagaagtcatctatattagatctactctttggaatcactgaggttttgtgtcctttcatgtggtaagttaatataatgaattttctgtatcctttgcctgaatttcccatactgtttcctctttaaatttgaatgttgtgttggtacatagtctggcctatggatttttcagtggtgattatatcttgttaaatttccttcttggtctcctttaatgcttttggcctttcttttaatcttgtctgattagactgtgtcaccttggtcttgtgtgttgtttgtctttacctggtgtatttttgccctatgagtatatcttatcttcttacacactttgaaataattttagattcatatagacttccaaaaattgtacaggagtttctgtcactccatgagtgagtggata

SEQ ID NO: 172199 - DNA, 254 bp, Homo sapiens
gaatggagggaaaactggctgcgttcagcttactaagaagtcctatgttggtctccaatggggccacctctaaggcatatggaaaggtaaattttgattttaatttttaaatcttgaaatatattctatttttaaaagtaattttaatacaattaagtgcattcataaaataaaaggaacaaaagaggcaaagaggggagagaaaggaagactcacagaggaaattatgctgttttagcaaggtttagccagtg

SEQ ID NO: 172200 - DNA, 339 bp, Homo sapiens
agtgacagcaaaagctgtaatgattcttcttaaaaaaaaaaaaaaaaagagtaaaactgacccatctctctttctgagttccatctacccctttcagccagggagaagattggaaatttaacactgacaattgccctacttttcaatattttctaccagaaggcttaacctaagcaacatgaagtcttttttccctatttgatcttcccactctcattgttgctctctcctctctcatctttacttcctgatttagagataagccatttttgtaagttcaaaccccaaaaaggatctgttcacacggagtgacagcaaaagctgtaatgattcttctta

SEQ ID NO: 172201 - DNA, 690 bp, Homo sapiens
gaaagaaagtgtggcttagctgagtgcagtggctcatgcctgtaatcccagcactttgggaggccaaggaaggaggatcgcttgagcccaggagttcaagaccagcctgggcaacatagtgagaccctgtctctgtttaaaaatgtggcttacagttgtaggtttgtaatccagagggagggcatggcggaggttctcacctgatgtctttttcattatgcagcaccatctgtcaaacattaaggatacagctggaagcttgaggagactgaggagcatttaaatagttattgatgtgggatattgagcagtattgagggacctgctgaaggctaggaccatgaatttatggtggttccagtctgtgctgttatttttctccagtagcactcagcagtccagatcagggcaagggaattattgacaggagagtgactgaagtgattgaaatgatacagtgagcaacctaagcatgatttaaaaaggaaaatgtgactgggcgcggtggctcacatctgtaatcccagcactttgggaggccgaggcaggcggatcacaaggtaaggagttcgagaccagcctggccaacatggtgaaaccccgtctctactaaacatacaaaaaattagccaggcatggtggtgcgtgcctgtagtcctggctactcggggggctgagaatcactgagga

SEQ ID NO: 172202 - DNA, 520 bp, Homo sapiens
ctcatgcagtgggagctaaatgatgagaacacatggacacatagtggggaacaacacacactgggccctaccacagagtgaaggctgggaggagggagagggtcaggaaaaataactaatgggtactaggcttaatatctgggtgatgaaataatctgtacaacaaactcccatgacaccagtctacctgtgtgacaaacttgcacatgtacccatgaactgaaaataaagttaaaaaaaaaaagaattttccctaaaagcattatcacacctaaagtttccaagttaaaatttcaagggctgatggccgggtgtggtggcttaacatacgtattttctccataaagcacatcacagccttcttgcttttagaaacactagatggcacttcactatgctcggggctattttaaacagtgaaatcaccaacaaaaagcataggatgcaaaaaagtggccctaaatagaccacttgtttattcagtctgtgagctggaataagaaagcatagaattagctgt

SEQ ID NO: 172203 - DNA, 495 bp, Homo sapiens
cctactgactagaaggttctttctcaacatctcctcactgcaagtccattccaaatcccatgtttctttttcctttgtccactggcttaattatttctgtcagtgttaacagcatttttcttggactcaaaggctgttatccttgggaatatctttgaggtttgtctccaacttcaaaactatttgagggttcactgaccaaaagcaccttggtaatgctttaaataaatacatattcctagaccctgttcgagaccaactgtatagtggtagattttaggacccagatttctacctcttacagaatgagtaaatctttgctaatggttacttttcctttcaaatatctgtcaaccttcccatttcttttcaaacctactgcagtcactgtaactcagaacttccttatccttgactagttactatgacaggcaccttctgggttacatccttcactctaatatcagcatcttctttacagaactcatttggact

SEQ ID NO: 172204 - DNA, 522 bp, Homo sapiens
cagatttaattttgatgtaactgttagtgcagaaataggtaagctatacatatgttgaggacaggaacggtaagtcaaggtttttatctcttacgttgtactttatggttatttctgtggatctttggtgggcaagtatttctatttggtgtttcccaaggtgtttttatttgtgccacacagtttctgaataaacactgaggatgaagagtgaatacagggtggaagaaagataattaaataggacataataatctagattttttttttttacaggaacagtttctccctaaacctataaattatgttagttcaatcccaacaaacctcaatgattctaagaacactcaatataaactattctattttctcttctaaaaaaaaaaatctaggttcttttttttttgtttttagaggatccggctgattggcaggcatcacggctacatcttaaatgtgtgttacaatggcaatcttcattttaatttccgatgagaggagaggaagaaagcccactctgaa

SEQ ID NO: 172205 - DNA, 154 bp, Homo sapiens
tggaggagagggaatggggagtaacttctaatgggtatagggtttccttctgggtgatgaaaacgttcttgaattatagtgatgatggttgtacaactctgtgaaaacgtaaaatcactacatcaggccaggcatggtggctcacacctgtgat

SEQ ID NO: 172206 - DNA, 394 bp, Homo sapiens
gctgggtgtggtggcaggtgcctgtaatcccagctactgcggaagctgaggcaggagaatcgcttgaactcaggaggtggaggttgcagtgagccgagattgcgccactgcactccagcatgggcaacagagtgagaatctgtctcaaaaaacaaaaacaaaaacaaaaaaccctagaggataaaagaactataacatctgggataaagttagctgttgaaataaatacaagtcctaccgttggggtagtgtcagagctggcctacgtctttgactttgagattcctagcagccagagcaaagaaagaaatagattattcccactggagccacagtggccataacaaacagaagccatctgtttagatgctgggaatggagaagacttgctccc

SEQ ID NO: 172207 - DNA, 372 bp, Homo sapiens
agcattcttagctgatgtcagctttagagggctctggcctgcaggcatttggtcaagtgctagaacctttgtcccatggcttgggacttggaatagaactagactcagttcttcaggccatccatgagatggccttaagcacagatagtctgtcactttcttcacccacacctgtacaaacatccagatacatgtggtatagaatattgagtaacttttcccgcagagtgcgttgtactattcccgagaagtccaaagcaaagccatttaccacctcgaaagaaacaagagtgttgtagttttcttgccaacaggagaagaaattagaaactggagtggagaacggatggtgtataccacgatgtgaaagga

SEQ ID NO: 172208 - DNA, 605 bp, Homo sapiens
tggaatgagatgatagagtggattttgccttaagtctttattaagttaaagcaagcagatatttgtggctcctgtgtgtgcagctagaccttacaatcattgttggtagtaatatttaagggaaaactaaaacagtgctagccctaccctttaaaagtatctattctaccacctgttagaccatgattttagcttaagttccctgaaggtttttttcatacatccacgagcctgaggtcacagcttaaacctctgttaacttcttaataattagccaactgtaagcaaaaatgggtcacagaacagatgccactattaaagtcccacttgaggttattaattattataaagttaaagtaagtctgttcagcatacttgtggttatatttctccaccatgttcagttgcacagttgctgaactgggaagagagaaataaggcgtttagagagacaccacaggaattttgccctatgctggttttgactattccttataccagtatatgatatgcccttatttaaacttacaacatgagatttttttgcaaataaatatgtaaataataaacaaatgaacagccaacccagacagccaaattcagat

SEQ ID NO: 172209 - DNA, 437 bp, Homo sapiens
tgagctgatcccctccctgctcccagctgagctcccacactggaggcgggaggacagagagggctgcagtttgactgtgagactttgagccctgagtagagttatgggtactgttttggagtttcccttgccctgggttgaaatcagatcacgccactgagccccatccaggacctccctgtcttacaccagtaggtggtcagttagcagcctgttggaatattctctggagatacagggtgagggcagggcagtgggtagggaaggatgaacttgaagcagctattcagatgcaaaagccaacagttctctgactttcccctaagggaaaataatcagtcacgagggagtgataaatatgtgtggggccttgtgcttgttaagcttttgcttgtattttccttgtcagctctgatcctcttggaggccatacgagc

SEQ ID NO: 172210 - DNA, 416 bp, Homo sapiens
accctgacccccgccaccccaaaaaagaactgtaaataaatattaaattctagttaataatatgtagagggaagacttgcaacttcctgctacttagtttgaaatgcatcatcaaaataaagtggccaggcgcagtggctcacacctgtaataccaacactttgggaggccaaaggtgggtggatcacctgaggtcaggtattcgagactagcccgagcaaaatggtgaaacctcatctctactaaaaatacaaaaaattagctgggcgtgacggcaggtgcctgtaattccagctacttgggaggctgaggcaagagaaatgaggcaagagaaacacttgaacccaggaggcggaggttgcagtaagccgagaccgtgccactgcactccagcctaggtgacactgtgagactcc

SEQ ID NO: 172211 - DNA, 233 bp, Homo sapiens
tccacaagaacatttagaactttgctgcatttggaaagaaaaagtaaaaatttcaggcatcatattcaccattgacatagaaatagaagtcttactaaatgggctgggtttcttaatatggttaagttatgcagaaaatagaacaaagatcgccccttaggagataaactttgcttagaggtactggggaagattagcctgtgagtttatttaagtatttacgctttgattat

SEQ ID NO: 172212 - DNA, 558 bp, Homo sapiens
aaaattaacttttttctcttgaattagagatcaaaaaacagaactacaaaacctcgagcagattgttggcatttattatttgattggaaaaccatgaacttaaaatcattatgtagctgccatatttttatcagtaatattactcttataatgtttgattttattgtctatagtaacacattaaggtgactttagcatatttcaacttttgttaatgttggagaattacacatagttttgcaataatgtgtaaatgtaataaaaatatcaaacagtggtaattttgactgataatgttagttatcaggacaagtgttagaaaagcaaatttaatcaaatggtgcccactgattttataggcagtttcttcattcaaagtaaaagtgatgttaaattgaagaacttgtcagtctcatgctggaggaaaatcagctttaggattagaaaaaccaaactgcaaattagatgaaataccacattaattagatgaaataccacattaatgttaaaaaaaaccggtgttatttggttacatggaaataaaataaaacggttttg

SEQ ID NO: 172213 - DNA, 292 bp, Homo sapiens
aaaaacccacagtgttcctctgagtggatagaaatttgaaattcttttcattttgcttgtcctgtattgctattataaaaagggtaagctttttaaaaatgaaaatacattgatttttaccatttttgctttgttttttatttatttatttatttatttattatttatttatttatttatttattctgagagggagtctcactctgtcactcaggctgtgttgcagtgagctgagattgtgcccctgtgtccagcctgggcgacacaacaagattgtatctcaaaaaacaaa

SEQ ID NO: 172214 - DNA, 489 bp, Homo sapiens
ctcatcagtttcccattagatttaactgcctccagaatataaatgtttatatttttggtatccacatactcacatatatatatatttggtatcttcatatatatatatatatatatatagagagagagagagagagagtttacataaaaaattaagtccataagaagttataaatttagaatatggttttacagtattacttagaaaagtagaaaaaagtctaggtagaaattatttgcatctttagaactgaacaaggtctcaaaagcatgacttaaactaattttgctgatgggtcatctgtaggtagatggggaatgaacaagaaaggatatcacacatatggagaacttaagaaacaaaggcatgtgtgcatttgtgaggagacaagcctaacctagataggagggagatccttgttgcaggatgataggaaataagattgaataaatggcattaagcctgattaaaggtctagtgaaaaagtta

SEQ ID NO: 172215 - DNA, 356 bp, Homo sapiens
ccacctcatctgccaacactgacagtggaagcctctgtcccatctgcccagtgctccccgccaaggacagagtcagggccttaggaaagctgtttttggcacctgagtgcatgtgtgtgtgtgttttcaaacagggttccactccagtggagagagagaaaaagactttggtcgacatggacatcagttaaaacctctatccagaaactaactaaccagtgtttacttgtgcgtcatagctagaggttctcgggacttcattattttcagccactttcctcccagaaaacactggccatctcatgaatgaagctgtttagccaaggttagaatatgcaagcagatgagggggtggc

SEQ ID NO: 172216 - DNA, 396 bp, Homo sapiens
ggaggctgaggtgggagaatctcttgaacccgggcaacagagcttgcagtgagccgagatggtgccactgcactccagcctgggcaacagagtgagactgtctcaaaaagcaaacaaacaaaaaacccatagagactattttgggtcttcatgactacctgacatctgacatgtcagtttgaggaatttagtatatttaatgatgcatttgattcactattagtgatttgtatgttttaaagagtaatttagatagctttttcccctctatcttccccagtaaatattgaagcaaataagaattatatataccagctgtcttgctttttatccactgtttatatcctgtttatcaagtgacccacccagttttatttggcactagctttttatata

SEQ ID NO: 172217 - DNA, 507 bp, Homo sapiens
ctgcgtgtctccctgaccccaccggacacctgccccggaccttcctaacgtctagggggtgacgcacctgagtggagattctccatgcagcaccagggatttctgccatcgtggactttttaacaggtgttctcaggatgaggacttttggggtgcaccccccaccggcagcagttgcgtttctgggcttgagattcaaggcatgactgagcaggtgggggatgatgctatgcattttttggcatgaggtctctttcaagtaaatgaagaggccatttcagaaacactgcagagagagaaatgtgagcacacattttctgctctggccaccatgattcttttgcatctcgtcaccatttccctgcacttatgccacccccttccccaagctccagggcccactaactgtgagaacaacgaaaagcattagctatggactcagcatgcttcctccccgagagctcccgacagccagcagaaatcaataaattaggataaagaaaatga

SEQ ID NO: 172218 - DNA, 191 bp, Homo sapiens
ttgcgatcactgtactccagcctggcgatggagtgagactccatctcaaaagactaaataaataaataaataaataataaaaaatttatcttctagtctgatcctctcacttcaaagatgaaatcattgacgactaaagtcagagggtttgatgtgggtatattcttctaattaatagtacagtgcttttc

SEQ ID NO: 172219 - DNA, 615 bp, Homo sapiens
gactaatacatccatttcaacgcagcatgtactacagagcagtgtacaaatgcaaaactgctttaaaatgcatttagttaagactgctctgttgcaatctaaaaatcagaatataaaatctgacaaaagatttttatgtttcttcaggtgcaaaaaataatggaaatataggcataaatattttcactttcagggcattttaaagatatacggaaataaggaacagaagcttatcagcattatagaaaatctggtatgtatcagtgttttgtttcttctatccatccccttctaaactcaaaggagctcaataaatatttagattaaattaaatcacttaaagacacacttctcccccatacctacagcaattctaccagtgaaatagcttataattcttactttaatgccacatcatttttgctaaatgagcaataatgatatctaaattaatacctcacttggatgcctaaaactacaattttcacatatacaagaaatagtacaacaatattcagcaatgtctaactgaaagctattttcttcccaaaataacgtaacatattcgaaagtgtgcaatcacagtgcacgtgatctaatttccttcagtgccaa

SEQ ID NO: 172220 - DNA, 458 bp, Homo sapiens
ggctgtgcgaagggaagacaccacgatgaggtccagggacacaaagaccttcagctcagttgggaggggtacagtgagagatgagagaagaaaagtaaacccagcagactgcctaaaacctgggtgtttgtctgcctctcagcaggtggatggggctaggcaggggcaggtgtgtgggtcagggaactcagctctatgtctgcttcttgctcttggctcgtcaggcactctatacctctctagcctcatccctgtcccctcctactaggaaaggggacaccttcccacccttgaggggtttggggtgaggatgagcagctgttaacacaggaaggtggaagggatagaatccaggaatgggtgtgttctctgtatccttgaactgtgtctttcaggcttgcagctcctggggtggagctctctagctcagttctacccaaagttaggaccatacctgg

SEQ ID NO: 172221 - DNA, 482 bp, Homo sapiens
aactcaacagtatcaccctggggacctgtggtaggcagaataatgccccccacttcaccccccaaaggtgatcgtgtcctaatccctagaacctgtgaatatgttagattacatgacagagagaattagggttgcatatggaattaaatttgctcatcagctgcccttaacataaggagggtatacttgattatccagatgggcccagtgtaatcacaatggtccttaaaagcaaaagagaaaggcaggagaatcagaggtcagagtgataggaatgctgacttcgaagatggaagcaggctgtgagcctagggatgcaagctagaaaaggcaaggcaatggattctcccctacagccctagaaggagtccacatcacacttgatttcagtccattgagacccatctgacttctgagttccagaactaaaaaatggtaaatttgtattgttttaagccatgcagtttatggtaatttgttac

SEQ ID NO: 172222 - DNA, 199 bp, Homo sapiens
tgttcatctttgtatcagctcagatgtcacctgtttagaaagacctccttcacccaatcagtccatttagcataatagtcgtatataaacagcacattggtttttattccttataactgtcattctttcacattcttatcatgtttatatgtttggaagagcagcagattgtctggattttccccactgtattcctcag

SEQ ID NO: 172223 - DNA, 514 bp, Homo sapiens
aaagcagcaatatgaaaaaaatagtattaattctggtctttgtcccattcagtgatgttcctcagccaaaatttattagaaactcttcctaaccttactggttgcaggggtatgtggtcaggacactcgtatctttttttgataaagctctcccactttgaccttcagcaaaaatgtcaaactgagatgaattctacacaaacccttctcatttctgctggcccctcaccttttttggaaaggacaatgcaaagtgaagccttttctcatttattgatccttatgattctcattgttatgttattttggggggtgtcacaatattgaggttgtgatggacttttcattatatttacttctgaagacctaagtgaggtttcagtgtgggcaaaaatgttaatgttttgaaaacacatgtccgtcctatgtcattgataatataacaatacatttgatgagtgctaaacttaataaatattatatttaaataaagtttataatcattttatcctta

SEQ ID NO: 172224 - DNA, 181 bp, Homo sapiens
ccggtggggtgggtgtggtggttggtggcggggaagggcaaagacagggtgttgaaaggaactgatgtaagatcaggatctactgatccacattcaagacttgccacatttctgtgactaagcgaaagtgttcccttctcttagcattatttctaactaaagcaaaatcatcctcacctct

SEQ ID NO: 172225 - DNA, 572 bp, Homo sapiens
gcaagactgattccatatttgaaaggtactctcctcaaactatttgagaaaacttttatcttttagacagaaattctgcattgaagcttttaaggaagaattcactttaaaatagaaattgtatttctattcttgaataagcagacctttttaaaaacagaaacatttctaaaaatccttctgaccatgacttatccaactttggaaaacaagacctaccagtgatgcttaataaattacaaatgagcagcaaaattccttattttttatttgtgtattgttgatgctttaaaacaattttttcagaggtttatgtccaacttatttaccttattctgtttcaagccatatgtcaaatatataattaatgatatacgggttactcaaaggtgctaggaagcctcctctcttttctatacctgggcagaaaggtataataatataataatgtccaataatttcacagatttatcatttacaaactttgctagtttatcaccaataactctacaagttcatcatttacagacgttgctagtttatcaacagcctcctaaattaacaaatgaact

SEQ ID NO: 172226 - DNA, 544 bp, Homo sapiens
ctccataaccacatggagcttatttcaaactccagaaataacaaaaagaacccggggggaccaccctcttagaataactccccatgggtgatgaaaggaaggcatatcaaattcactttaggagagaagggattctgagaaatggattttcacgatgtccaaatggagctggcctatagattttcctctggattatactggcctgctttgccttcagatgagcacagatggtcacattcatgaactggggttgctgaaaacacatttttaagggggctcgacatgtgttaaaacaaccagaagttcttgaacaaaattactggtcagccaaactggttttttgtttttgtttgtttgtttgtttgtttttgaagtaacaggctatatgttttagagcagttttaggtttttaggaaaattgaatggaaaatacagagctcccgtggcccctcccctccattcccaaaagttcttattatcagtgtcctgcattcacttgatgcatttgttacaactgacgagagccaatatgcctactttatta

SEQ ID NO: 172227 - DNA, 244 bp, Homo sapiens
tgcatggtttccccgaagtggagaacccctcaaaagaggctttgctcactttcgtctattgaataggcagaaaaagaagcaaacagtccattccaaatttcaagaatttaaactcgtatgaacccttcaaactctggaacttggccttcacccagcctcacatcagaagtgctctctactctgaggtcattctgacaaacttcattttatcaaattccattaaatataattgtttggcaatcta

SEQ ID NO: 172228 - DNA, 565 bp, Homo sapiens
gatggggggagtggcaggtgggcagggaacagatggtaggaccttgagtgcccagctaggggctgagtcttccttctgccaaggatgggctggccatggaaggtgtctgagcagagggcacagtcagatttccacatcagaacaaccaaggagccgggggcagggggccatggcatgcagaaggggtgagttttagaaagttcagaaccagtcaacttacggtgggatctttcccatctccacaccctctgtgccctccttacaatgggttcagtccctcttgctactccatcttacaaggagctgtgaaggtgttgagccctgccccgctagccggcgctcacctgctcccacgtggtgctgttcctgaggtctgctctgatagaagcccccagcaatgcctgtttcatcccagaaggacccccaacggctcgtttgagcaagtccctcagagacaccgcaaaaaccctccaaggatccttgcacaggacaccagaatctgcccccctagcatgaatccagtgtcccagtctccagaagagaccccccaaacaagtcctggaat

SEQ ID NO: 172229 - DNA, 347 bp, Homo sapiens
cggtgtgacatttttttcaaggatgagctttgccagctccacgtggaagtccctaaagctcctccttccacttcgaagcgtgactgatgcctccagggcctcacagccgcttctgaagcacttcctgaaagccagctccaccctggcgaggccctgacctcagcggacccaagcccaggacgatgcctgttgcgttcttctccccctgtagcaagtcaccttccccagcagcctccatgttgtctgggctctccctgtgggggatgccaggggagagtgagagagcagaggtggccaagatggcatgtgctgccttctctcctggaacatgctgcttccacacggca

SEQ ID NO: 172230 - DNA, 107 bp, Homo sapiens
cttaaatctgtgctttagtgttcttcatcatctttgaaaaattctcagctggtcacacctcttcagaattgtttctgttccctcctgctcctcttcctctcctcttc

SEQ ID NO: 172231 - DNA, 493 bp, Homo sapiens
aggatggaggtcacacataggaaagcaacaatatgaaagaagcccaggtctcagacgctgtgcaatgtccacttccaggtccatatgtgtgaaaaaaataaacttctgtcctctagaatagctgttattttggggtgtcttcactcagagtcaaacttaatccttaagaatatatcttctaattagtcctcctgttgcaatttgtcaacaagttaattctccctaatgatcaccgattaatcctctactaactaaaagaagtcttcaaaaccctccatcatcacaccacaaacccagtccaattactctacacatctagattgatttgccttatatctgctttttcaactataaaactgctttgtaaaaataactgaaaactaaactccagacagtgtatctgaaatgaatatttcaagaaggaaaaaatatcgagacagaaggacatatagtcagtgcccaagcccctccaaattacatgccttctgcctaa

SEQ ID NO: 172232 - DNA, 213 bp, Homo sapiens
tgggctacagagcgagactccgtctcaaaaacaaaacaaaaaacaaacaaaaaaaaccactgtacccttaggctgtcattccctatatccctcacccatccaaccctaggaaccgcttggattatagttttaaaggttatttttattttatttttttctttagaaactccaattatatttaggttggatctcctttgttttccatgttaacta

SEQ ID NO: 172233 - DNA, 414 bp, Homo sapiens
atatccctcagccctttccaagtgcaacttgatgtctagaccagtgtagtagctgctggctacatgtgatgctttagtttcattattattattattattttgagacaaggtcttgctctgtcacccaggctggagtgcagaggcatgatcgctgttcactgcagccttgacctcctgggctcaagcaatcctcccacctcagcctcccaagtagctgggactagaggtgtgcgccaccacacctagccagtttttttattttttgcagatacagggtctcactatgctgtccaggctggtctcaaactcctggactcaagcaatcctcctgcttcagactctcaaagtgctgggattacaggcataagccaccatgcccggctccttcagtttagattgaactaagtcaaagtg

SEQ ID NO: 172234 - DNA, 463 bp, Homo sapiens
gttgtggatgaacttagtggcagggctaagagcagccccgcctcgctccccgagctccgatgagtgagcagggcagtttctcccagcagcgaggctgcactcactgctgccctgctggggacctgacgcccagtgcatgcccccagctctgcattctgcagacccagaggcaagagctggccccagcattccatctgcccattccttgacacctaccggaggcccagtgtctgccctcccatcttctcctgggccagcggcaccagctcaccccacctgctcgctccagccactcaggggcctcctctttcctttcttcaaatgcatttagggatcttgaaagctcattttaccttcttgatcagatttgaatgctcaccagtgcaaacagactaattgaagagctcaatgaaaccgggtaagccagctttcacttcaggccaggccaactccccttactaca

SEQ ID NO: 172235 - DNA, 170 bp, Homo sapiens
ataactgaatgcatattaacagaatgtgtctcttcatgtctctgacaggaactggaacaaatgaaagctttgccacattgcttgcattcacatggtttctctccggtgtgtgtccttccatgattttgaaggctcttggcagatgtgaaggctttcccacaattcttaca

SEQ ID NO: 172236 - DNA, 685 bp, Homo sapiens
agaccctgtctcaaaaaaaaaaaagaaagaaaaaaaaaaaagcctggggtttgagaccaaagctccaccttttccctagtgtttcctgcaaaacttcaagggtggtaggtaagcagtataagatacaaatgttccctcctgtaacatggttgactcttgggatttaacaaaagttttaattctgaagatgaagaggcaaaacattttatttacatgcacagccctaataaccaagccccacctttctctcagagaactggaagaaccactttcaaactgccctgctctgccttgtgttccctcattcctgtcggaggttggcacttcgcatcctgtgccctgatgtcatattctatgtccttctgagattctcttctgaggccaggcccaagtctgtcacacagtatctaaatttggactctcagagatgtatcctaaagcaacaggctcattcagtccccagaataaggcagtaggatgtacaaaactcagttcaggttccctccactacactctgcactctccctaacacaagaatctatggcactcatctgtgtgtatgtccatcttttgctacaacagtagttctccaacttttcggtctctggaccccctatgatttgaatgtatgtgtcccccccaaaattcgtatattgaaacctaaggtccagtgtgatagtattaa

SEQ ID NO: 172237 - DNA, 387 bp, Homo sapiens
caattctggacttcggggcaattctggactatccctctctgtgcatcctcttcatttgattgtgggaagcctcaagtggagccaaagaaatgtcccagaagcattgtagggggttgtgtggcccacccacattcctggccctggcaagtcagtcttacaacaaggcctgccatcatcactgacagagtaatcccagcctgtctgccatccccaaattacgtggtcaccgcctggattgaatgttatgtcactggctggggagaaacccaagaatctttttttaaatgatcgtatgtttcccttacaccaaaagcaagcaaaaagccagtagaggtcactgagtctcttaatcataatttcagcgttcatattgcttcccaggtaagt

SEQ ID NO: 172238 - DNA, 741 bp, Homo sapiens
gcctttttcaaaatgtggcggtggcagggaaggttgtctgctccagaggcttccctagagtgaagagctctactatgtatgctttatgcggcagaaggagtgctttggaggagtttttaaatttgttttttttttaaatcttatcggttttaattgtagcaatgattcaagaaacgttagtaggtgcccataacttcggtggtggagatccaaaagtgaacaagacagtgttctggctgctaaattcttcttaactggttatgcctggagaccttcacttggttctgtgccagcactgcccatgaacttcatagactgtgatctttgctaaggcctaaatgaatgaagcaggtgcaggaccggaagcagaagacagaaagtggagaccagatgtttgaagctgggtaaaggcagggatggagcaggaaccgaggaacaaaccttggaactagttgcacttgcccaaaggaagttctcgtttgattgactctgtctgctgctccatagcgactttccagctctcaggcctgatccaaggagccacagagcatgcccatcaagagctatgtgggaccatgggggcgggcctgggttttatgtgaagtaatggcttaaatcctggcatgacagttcgcagtccagcatggcaaccagcagcccagcatgaaggaggcagacagttgaacagattatttttatggcttacttaaagaaatagttttgatgtcaaatccattttgg

SEQ ID NO: 172239 - DNA, 660 bp, Homo sapiens
gcctttttcaaaatgtggcggtggcagggaaggttgtctgctccagaggcttccctagagtgaagagctctactatgtatgctttatgcggcagaaggagtgctttggaggagtttttaaatttgttttttttttaaatcttatcggttttaattgtagcaatgattcaagaaacgttagtaggtgcccataacttcggtggtggagatccaaaagtgaacaagacagtgttctggctgctaaattcttcttaactggttatgcctggagaccttcacttggttctgtgccagcactgcccatgaacttcatagactgtgatctttgctaaggcctaaatgaatgaagtgtacacttctttggttcactggaactgaacaacagctgaatgtttaaccttgatcaggtgcaggaccggaagcagaagacagaaagtggagaccagatgtttgaagctgggtaaaggcagggatggagcaggaaccgaggaacaaaccttggaactagccacttgattgccgagccccatagaagacataatttacaagaaactcatagagactcaaaatgtaaggttctctgaaagaaattgaggtgtagttcttaggttaagggaaatgattaacttgatttatctatgaaggttttttctcagtgtgg

SEQ ID NO: 172240 - DNA, 402 bp, Homo sapiens
aggagaatctactccatgaaaattggcaagtaccataaacaaggcttcccgaacccctctctacctcagagccagtttaccagcataccagcagatgcattttatggtaaattaatgggcttcagaaccaaactgcttaagaaaataaactttatcacagccttatgcttggaataagatgacatcattgaaacagttatagtcctggttcagattttttttaatgagcctgtattgtatgtttgtgttagttttctatagatgaaatttacagtaaaactagaaaatctggaccatgagtaggaaactatataaagtacggtacttctatacagctcagtagcatgattttttttcactgccacggacatagaacagtctcttaagatggagtggtaagca

SEQ ID NO: 172241 - DNA, 407 bp, Homo sapiens
ggggaaaatagaaagtgagacaggaaaggagggaaagcaaatacagagtgctacgttatccagcaggctacagcatcataagaaccttagctggctgctcagtcatgttggaaatctctggagaatcatggcacctctcagaatacttctggggacaggtttgagggaggatggctgagagatttatttgttggctccctctcatatcctgtctcttactggtcagagttgcctgaaggatcttaattattctatacttttgggtttgttacttggcttctctatgcagctgctggaaaagcagctgatttggggtaacagggcttctgccacagcaggcacagtgaggaccaccaaagcctacctgttaacactggggaggtagagaccactagtggtaggctgag

SEQ ID NO: 172242 - DNA, 766 bp, Homo sapiens
  misc_feature (628)..(628): n is a, c, g, or t
caatgttctcatttcacacacagttctccagaggaaacacacagatttataatctgttattcaacagtcattttttcaataggatggtatcatctgtcttctggagtgttgccaaaataggaggcaaagagctagaatgaataacccttatcaaatccaggatgatgaaacgaagttagctctgaagaggaagactgtgttccaaagatacagcctaagctcaacatgcaaggcagccgttcatgaagctgaggctcacagcccctttttctgcagagtggccaagaggcggctccttccagcaaggcactgtgcttcaggtggagagcccctgggtcctaggagaggtgctgggaccacaggtgcctgctaatggtccaggtctttggagtggctgctgtagttgcttggaatagctgggaaggaacaggattctatgaaggagacagtatagccagaggaggcagggtgggcaaaaaatagaaggtgatatctgtgaagccaaaggaaggatgaatgtcaaggaggaagtcatcagtgattttgaaggatgcagaaaggtcagggtagatagatggagaacagaaaagtgccttttggatgtagccaccaagaaatggttagtaancttggagagaacagttggtacgagttagagcagcagcagatgcggagtgagagaaatggacctgataggggagcctgaatagcgtgtgaaggaacggacgtcgagtaggctggaactaccgtttcaggaccgggctaa

SEQ ID NO: 172243 - DNA, 119 bp, Homo sapiens
gccaaagttacagatgtagaaacaggttttttagtagtgtgatgtatttctgagattgttgaaagtgtaagatgttatttgaagtggcacagaattagctgtttggtcacgggagaaac

SEQ ID NO: 172244 - DNA, 572 bp, Homo sapiens
cttcagcgtctctttctcagagccacttgccagccagccatctcctgcattactgtttattctcagagtacactgaaaaaagtgtttcctgaatgagcatctcccacaaataaatttaacaaaaaaggaaactgagatggtcaccttcagagcaaacaagccaacggtgtagaagaggcaccccaatgcccatcccaccggcacagtagcaggtggggcaaaaagtgcatgggtcttatgcaagccaacagggagaggcgactagaaaggcttaggggaaaggtggcccctgggtgggattctgaaccactttcctggggtatctgtcctgtttgtgcccacacaagtgcatgtgtgctgggaaccggcagcaccaaggaggctggggccatcctaagactgcagctgtgcgacttcctgtagagaaggcaggacaccaagtccttttcagcaaggcagtgacggacagaagtcctgtgggcagcagctttcataaagtgtggggtcaggcaggctggaagcaggaccaagagggaggctaccaccacagttccagcatgaggcagcaaggg

SEQ ID NO: 172245 - DNA, 873 bp, Homo sapiens
  misc_feature (514)..(514): n is a, c, g, or t
agggtgtatcaccactgcctgcaaagaattcaagtagtaactggcctcaggataaagataaaatcaaggttgtggccatatccattgttaaggccccagaaaagtttaccatgttggggctgggtgtggtggctcacacctgtaatccccgccctttgggaggccgaggtgggaggccaggagttcaaggctgctgtgaactgattgcaccactgcactctagcctgagtaacagagcaagagcctgtctcttttcaaaaaaaaaaaaaaaaaaaaaaaaaaaaaaaccgggggttttttggggggggcggagacaaaaaggggcgtcattagaacgggcgccatggggccacataagtgtggttcccgagaccccaggtctcttgtggtggacccaagggtgggaagacatcgcgcggggtcccccatattagagggagcgccagtataataattctccaatataacgccacggcgtaaacccgtggcataaaataaccttcgggaagaagancagctaagacagcacaaacgagcgaagcgcacacagcagcgcacgcaaatcaaccaccatcgaacgacaggggcgacctcagcccaggcctgtacggtaaaccaaaggacagaccggggggagccggaggagaagaacacgctagatcgaaacagaaggggacccacacaaaacaacaagacaaacacggacccagaaaccaaagaagaccgacaaaggccgagcacgcggcaagactacaaaaacccagaaacaccagaacagtcagcacaagcccaggaggacggcggcagcgagaatgcgaaagtcgaagaagcaaggacgccgggcaaagcaaagaccaccaggaaggagacaac

SEQ ID NO: 172246 - DNA, 277 bp, Homo sapiens
caaacagggcccggcacagagtgaatgctatattagtattgggaagctaagttttttaatgtagagaagccaagatgcaaaatgcaggctttttctgagcatgggttatttctaccagccaccctttgctcctaggactggctctgagagagcaattacctttccctgtagaggaacagagtctggggccatctctgagtgtcacgcaaagctgcaggctgcagctcaccactgctgagtggatctgcctcagaaacagatgaaccctgcggaggaa

SEQ ID NO: 172247 - DNA, 182 bp, Homo sapiens
ctccagaagtggctgagaggctgagaagttgagcagagattctgacaaccctgctgggccaggggcgaaaattggaatccaaggcatgccacagaatagaagcctgactactcatgctctaagttaggtcattagaaaaccaaaccctcggaggacgtatacactagaaatagtatggacgt

SEQ ID NO: 172248 - DNA, 521 bp, Homo sapiens
caggtaaaagaatgccaatgcagtgcttctcagtagtttttaagcccatgcctcctttagataaacatatatctttaccactccatcctaaaactctgattacctttcctccccataatatgtaggtgattatatttcctacgtatctccagccaagatgattttgttaagcttcactctctatagtatatattgtagagaaaggattccccccaaatgtaaattagatgagaatgttgagttaagttaataactacatacatcctggggacattctaacatgcctgtgtgtgtatgtacttcttcatttcttctccatcctttgaaaatcaccaaggctaagtgccatagccaaaagaataaatgagaagggtgaggtttcctctccagtgcacttgatactaattgaaattagggtccacagactaggaaatttagtgaaatgggtgtattaaaagaacgagggtctggtcgaacagtctactctgagaggaagaggggtataaaatacaatatgagga

SEQ ID NO: 172249 - DNA, 175 bp, Homo sapiens
ctggccctctgcagacagctggagcccaagatgagttgcccttttgtgaaactagagaaaccagtgcagcactcgaactctgggtaaacggagtcatatctaagaatgtggagtcgggggcctgcgctacacctgggccacccacatgggacagaaactccaagctaacaaactg

SEQ ID NO: 172250 - DNA, 613 bp, Homo sapiens
tctagtaaaaatacaaaagttagctgggcgtggtggcaggtgcctgcaatcctagctactcgggaggctgaggcagagaactgcttgaacccaggaggcggaggttgcagtgggctgagatcgcaccactgcacttcaacctgggagacaaaccgagactctgtctcaaaaaaaaaatgtacaaaccaaaaaggaaaaataccatcaacccaacagaaaaatgtggatgtggacaactggaaacagaaaagacgagacccatcatggtggctcacatctgtaattccagtattttcagaggctgaggtgggagaattgcttgaagccaggagttcaagaccagcccaggcaacaaagtgagactccttctctgtaaaaaaattaaaaattagccaggtgtgatggcatgcccctgtagtcacagctgcttggtaaggtgaggtgggaggattgcttgagcctgggaggctgagattgcagtgagctgtgatcatgccactgcactgcagcctgggtgactaaagcaagaccctgtctcaaaaaatagaataaaaagacttaacatttctataaaaatgtcaatgtaggccaggcgcggtggctcacacctgta

SEQ ID NO: 172251 - DNA, 527 bp, Homo sapiens
actaattctaacaaatgtgcatagataaatttctaacagaaacagttataatttgagttgttaataatggcttgatatagtatcttaaaatacaagtacttctctgtgtgttgaaattttacttagtgctcactttagtttacagactttattaaaaaggtgtagattccatttatcatcttagttgttttaacatctgtttacataggcctttcttttataattaatagctaaagcaagtaattgtgtggctttgacattacagattttaccaaatgatacattgaaaacatggacgttgaatgtatttgtcacttttaagcttctttttgatatctttgttgatgtagttgcctacttagacatttgagagtataatatggaattggattattggaaatgggttgtattgccttcaaattcactttcgtttaagactgtaaaatttgtatttccaagtgcataaaatgtaaagtgtttagaaatagaaataaaaactgctagactatcccccatattttatgtct

SEQ ID NO: 172252 - DNA, 430 bp, Homo sapiens
gcggccgcctactactactaaattcgcggccgcgtcgacagtttacagactttattaaaaaggtgtagattccatttatcatcttagttgttttaacatctgtttacataggcctttcttttataattaatagctaaagcaagtaattgtgtggctttgacattacagattttaccaaatgatacattgaaaacatggacgttgaatgtatttgtcacttttaagcttctttttgatatctttgttgatgtagttgcctacttagacatttgagagtataatatggaattggattattggaaatgggttgtattgccttcaaattcactttcgtttaagactgtaaaatttgtatttccaagtgcataaaatgtaaagtgtttagaaatagaaataaaaactgctagactatcccccatattttatgtct

SEQ ID NO: 172253 - DNA, 650 bp, Homo sapiens
taaagataccctggggaggttttcttggagatgctctattaatcattataactccagcatttgtgcagagcaaatgctgtacctgacgccaactggagccctgctgggggctctgccagagctacggggatggcatcaagggagctgaggcttgcaggcgggtgcagcttccggtacattattaggattaaataaaaacaaggaaggccgggctcggtggctcacacctgtaatcccagcacttcgggatgccgaggtgggcagatcacgaggtcaggagtttgagaccagcctggccaacatggtgaaaccccatctctactaaaaatacaaaaattagctgggcacctgtagtcccagttattcgggaggctgaggcaggagaatggtataaacctgggaggcagagctggcagtgtcgtgatctgggctcacttcgagctccgcctcccggattcacgccattctcctgcctcagtctcccgaatagctgggactacaggcgcccgccaccgcgcctggctaattttttgtatttttagtagagacggggtttcactgtagtctcgataacctgacctcatgatccgcccacctcagcctcccaaagtgctgggattacaggcacgagccaccgcgcccagccgaaa

SEQ ID NO: 172254 - DNA, 176 bp, Homo sapiens
cagaaatagcagattttctcagagcactgagtctagtgattgtccacgtcaaggaggcacacacacaattttacccacacccctgatgtctcttctgtatggaaaatgcaatcagtgatgaataggtccgtacgacagttggggtaccgcagctcgcaatatcgtaactcattggt

SEQ ID NO: 172255 - DNA, 711 bp, Homo sapiens
gctgcagaagatactgacctaaacagatggaaaaagtcaagcaagagtagattagtaatcactacttcaatgagcccaaataaagatatggctgaccaagcacaaaagctgtctcaggaaacacagcaaaaaggcccatggaatattagggaaaacgttaaccctcagacatcatcaaattcattcacttaaaaaatatttcttaaaacctactgtatgtatggcagtattctaggcattagcaatggggtgaccatgccaggccaaagccctgccctcacagaacttacaatctaatgaggaaatctatgtggaagagaacactgaataaggcattaccataaaattccagaatgaagccttttaatacagagagatattttcatggaagatatgttaacacaatatttaaccctctctccccttcaaaggaagccctgtagcctaaggtgctcattgtttctcatcctctcaaaaaaaaaaaaaaaaaactctaaaacaatagagaagtgcatttaaaatacatctataaataaaagcacaactagtcttttacttccaagaaagcctgtcagcggcacagcagctcatgcctatatcccagcactttcagaggccaacaggagcaaatagcttgagttcaggcattccagatcagcctggacaacatgaggaaacccgatctctacaaaagataccaaaattagccgg

SEQ ID NO: 172256 - DNA, 507 bp, Homo sapiens
atatgcatttgtcaaaacagatcaaactgtacatttattatctgagcattttattatatgtacattatatctcaaagaaaatataagttgtattagggtcagtaggataattaaaaatgtggttttacaacttttattatcagagctagcagagaatacaggctctgaatgtgaacatacagcatttgctaaatactttggcaatatgtgtcaaggagaaacattgcttcagtggccaaatcctatgagtatttttatattactttgcagcaactgaaagaatttaaagatataaggggtctatcctattgggtgctgctgggttagaaacattttaagatcagataatccaaaacaaatatattatattattccatttgaaggagtgagcaataagttttataatttttgtatcggatagatacttttttaaaaaagaaacaacactacatttttcttcactttttctgtagaccatgggatattttgtgttgctttggtgattgt

SEQ ID NO: 172257 - DNA, 398 bp, Homo sapiens
ttccattatatcttgagcagtatattcaaactaaaatttaaaaacttattttgttttttcttatgtcctccaaagttttcagtggctgttcacaataaaggctaaatttctcattctactaactaggccttccatgacgcagcccttcatatttatttctgcataaatacaactaaaagctgaatgatctcttcactttaccaagaacagattttacacatcacaatatcacatccaccacttattcctatgtccaatatttattgagcacctattatgaaggctttaagccagaccgtgagcatcagaaaaagacagaataggaaaagacaaactcctttcctcagggagctcagtttcccagaatctacagataagctcttttactacagagtaaa

SEQ ID NO: 172258 - DNA, 895 bp, Homo sapiens
taggggaccaggggctgggactcagggacgggtcccagccagggcagctggagactcaaccaattcctcgcctggctcaggatgccacagaaatgggtccctacaccagcctttcggattccctagaacaggtggaccacaggaatgagccatgccctggggctctgaagccccctacaaacgcagctcccagcctgctcacacaaaagggctgggccaaggtgggcccagacaggaccaggtgtgctatggtcctcacagcagccaggagggtggaaatccccggggagccccggcccagggtccccactccccacgcgggggacctgtacgcaccccagcttcagggcttctgctgcctgaacacgaggtcaaggtatggagggcgcagctggcacccgtagtaacgacttcatggggcccctgccctgcagcctgccccctcctcccgcccccttaaaaggcctctgtcttaaaaaagaggacccccatactggtggctggagtttcgctgtgtcaggaggctgggcagaagcggtgggcaccctgggaggagtgagggcccaggacagcgcctccactcgcttctctgtctaggctcctgggggcgggggaaggtggccgagcagcagagttcggctggcagagccagtcgaaaggaggccgcccacccacccgcggagagaaggggttagggccggcagcccccgcagaccctggctgagcctgtttccccagacccacggggcaccggccagcgcccgctgacaacttttctaccgcctggaaaagtccagaacaactcgggggcggggagcgggcgcgggagcggaccccggcggcgggcgctgtacgcgtggcactgtttacgcgagcggcccgggaggcgcggccg

SEQ ID NO: 172259 - DNA, 774 bp, Homo sapiens
aaaagaacgagaacattcagggacagtaacaggacagagagatcaggcattcattcagttttaggacggcttcataaaggaaaggacctttgggctgggacttgaaagataagaaagactgctaggcgaaagaaggaagccccacgtggagtgagcagcctttgcaagggtctggcaaaaaaaaaaacctcctgaaaaacttgacattgatatggtagaagatacagataatattcaaatgaggaggatggaactagttttctattcttgctgtaacaaataatcacaaatttagctgcttaaaacaacacatttgttatcttacagttctgtaggtcagaagtcccacactggtctcagctgaaatcaaggtattggcagggttgcgttccttctggaggctctaggggaaaatccatttcctgctcattcaagttgttggcagaatccaattccttgagattgtaggactgaagtccctgtttccttactgtctgtcagctgacagccattcccagctttaagaggctgcccacagtccttgattctgagcctccttcctccatcttcaaagccaacaatggcaggttgagtccctctcacattttgaatctcccctgcctcttctgtcatcacatctctgagctacctttctttctccatcatctgcttttcagagctcatatgattagattgaatttcatcaaataatccagaaataatctccctgtcttagggtttgtaaccttaatttcatctgcaaagttcctttct

SEQ ID NO: 172260 - DNA, 288 bp, Homo sapiens
aacgtgccctcatccagtacagagagaaatacagataacaagtgctcaccaggccccgcaaaagtacattaaaaaaaaatacattccggaccaggcacggtggctcacgcctgtaatcccagcactttgggaggcagaggtgggtggatcacgaggtcaggagatcgagaccatcctggctaacacgttgaaaccccgtctctactaaaaatacaaattagccgggcatggtggcgggcgcctgtagtcccagttacttgggaggctgaggcaggagaatggtgtgaa

SEQ ID NO: 172261 - DNA, 3691 bp, Homo sapiens
  misc_feature (3)..(4): n is a, c, g, or t
  misc_feature (3523)..(3525): n is a, c, g, or t
ggnncgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgcnnnagccaggagtgcttgggcagtcccagctccacactgccctgagccccttcacttacctgtctctccacaagtagagccaaaggcaatgggaagctcaatgttgctcagtgggtgagatccagacccactggtgcaatgtcttaaatacacatgactgtttttctgc

SEQ ID NO: 172262 - DNA, 1708 bp, Homo sapiens
  misc_feature (3)..(4): n is a, c, g, or t
ggnncgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcaaatt

SEQ ID NO: 172263 - DNA, 630 bp, Homo sapiens
gagctttgcatagggtagacacagggctgctgaggtcctttctgcagaggtgcccagggctgagagttatggagcattcaagggtcttgacactggctctccatgctgatccaaccaggacccgcctctctgactgggtgcattgcctgagtccctctagctcctcttccttttctctctccccaaaccaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgcccaggagcaggaacatgccatgtagtgggcgccctgcccgtcttccctcctgctctggggtcggaactggagtgcagggaacatggaggaggaagggaagagctttattttgtaaaaaaataagatgagcggcaaatt

SEQ ID NO: 172264 - DNA, 3494 bp, Homo sapiens
  misc_feature (3326)..(3328): n is a, c, g, or t
atttcaaggaactattataaagtaaacatccaagtaaccaccactactgtcaggaagttgtacattacattgtggtttgccctctagttgccatcctcccctgtgtgcctcctctagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaagacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgcnnnagccaggagtgcttgggcagtcccagctccacactgccctgagccccttcacttacctgtctctccacaagtagagccaaaggcaatgggaagctcaatgttgctcagtgggtgagatccagacccactggtgcaatgtcttaaatacacatgactgtttttctgc

SEQ ID NO: 172265 - DNA, 691 bp, Homo sapiens
gagctttgcatagggtagacacagggctgctgaggtcctttctgcagaggtgcccagggctgagagttatggagcattcaagggtcttgacactggctctccatgctgatccaaccaggacccgcctctctgactgggtgcattgcctgagtccctctagctcctcttccttttctctctccccaaaccaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcaaatt

SEQ ID NO: 172266 - DNA, 1843 bp, Homo sapiens
  misc_feature (3)..(4): n is a, c, g, or t
ggnncgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaagacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggcaaatt

SEQ ID NO: 172267 - DNA, 3063 bp, Homo sapiens
  misc_feature (2895)..(2897): n is a, c, g, or t
ggggttctccctggccatccctcccccatgcagccttcccccccttctttaagaaggtaattctcgctgtgttcttgcaagaggtgggggaaggctgcatgggggagcctggagtctgggggagaggatctaatgtcatctccactctggggtttcccctccctgcttccccccccagacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgcnnnagccaggagtgcttgggcagtcccagctccacactgccctgagccccttcacttacctgtctctccacaagtagagccaaaggcaatgggaagctcaatgttgctcagtgggtgagatccagacccactggtgcaatgtcttaaatacacatgactgtttttctgc

SEQ ID NO: 172268 - DNA, 2674 bp, Homo sapiens
  misc_feature (2506)..(2508): n is a, c, g, or t
gagctttgcatagggtagacacagggctgctgaggtcctttctgcagaggtgcccagggctgagagttatggagcattcaagggtcttgacactggctctccatgctgatccaaccaggacccgcctctctgactgggtgcattgcctgagtccctctagctcctcttccttttctctctccccaaaccaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgcnnnagccaggagtgcttgggcagtcccagctccacactgccctgagccccttcacttacctgtctctccacaagtagagccaaaggcaatgggaagctcaatgttgctcagtgggtgagatccagacccactggtgcaatgtcttaaatacacatgactgtttttctgc

SEQ ID NO: 172269 - DNA, 819 bp, Homo sapiens
ctgcgaagcgggggttgccgagtggtaaaaaagatgtttgaataaacaggaagtactgtgcggctgaagcacactcgaagagaaaacacactggaacattgccctttgtaggcaacctcagggaggtttgcctccacagtagctggctgggctctcactaaatgacaaagaaaccacaagaattcctcaagtaattcttcactttcaaagttgaaagatcagttggagcttgcaggtaattttcaaagttgcatttagcacttaaagaaatctattaatgccacacatatctaaaccgctccaggtctgcaagcagcgacacagcacacgcagtgcgccctggctagaccaagccctagccaaacacagctcattcacgcagacaaatacacaccaacagggtttcgggaaacctgctcttgagatatttttgtggtgacatttacataggcaggatgctttaaaagaaaaaaaaaagaagaagaagaaaattcagattttgcagactttagaggattttgtcacatgtatttttaaagaacacatcgtcccgtattccagggatatgccctggatctggctttgactggctgtcctttacattttctttctccaccatcaaccaaactacctgtttatctccagatgcctagcttgcctaatggaacactccttaacccgccccaaaatgattgtcacagtcctgtcttccgtcaccggagtaattcagcaaatactgtgaagaaaagtaaactgctgaaggcacagcaagtcagcttgaaaaacaggaggaagagttgaacagccatattcaataac

SEQ ID NO: 172270 - DNA, 706 bp, Homo sapiens
gaaacaatgcaaccaccattctcaaacttcagtgagtagaagaatcatggcagcttgctaaaatgcccgagtctcatctcagatattctgattcaggatgactgaggttaccacctcattggttgctgcatatctgcataaccacactgaagcatccaggcgctttctgtgtgaaaggcagttgagagaagttggggcttggcatctgagcagaaccttgactctcttcaaaagggggctgacacactggagaaaccctggagaccaacagctggcttgcacaaaactcggacctcattgctcttcaaatatttatgaataattttcttcaacgtgtttgctaactgttaagaatattagtttttgctggtcttcttactcatggcccatctgaagtcccctggcctgaccctcctgtgaagtcatcccgctgaacgggcgccaccgggtcggggcattgccatagtgtcagcccacggggccataaacacaggctttgctggatccctgccccttcaactgggggaggctgggtggtaagatgagaaggcgccttccttccagcccattttctccaaagcagcaagtttcgagaacgtcacatttgatacatggcatagaagaggaatatcctcaaacacaactttcgggtgattatctcctatcctaagtgccatctgtatggtattatgcttatgtgactgca

SEQ ID NO: 172271 - DNA, 587 bp, Homo sapiens
aggtgctgggaaatgttgcaatttttatctcaaataaggctgaatttacagtagttttaagtatttcacttttaattaaaaggaagttaactgattacatttaaaccattttaataaaattagagtgatgttgatgtctaactgtatcttggttttaagcaaaataagtaagttgactgtcaaattaataatggaaattaatagaaactaaaccataatcagccaacagtacttaactttgattcactatttataaactccaatttgcatataaaatctttactgccagattgccaataaactgagctagtcccttggtagttaaaatcagagcaaggattgcgttgctatttattttttgtccagtgggtggcagcataactcaactggttatcttgtgtacggtcatttgaaattttttatgtgttttaaaggttttaatttctaaatctcttgtactacaaagtgtattctaagaaaactttcctccaaatactctgtttatttcttgctaaagtgaataagattttagataataagaaaattgcttgatatcctttcttcataggtttcaaataaaataaata

SEQ ID NO: 172272 - DNA, 448 bp, Homo sapiens
caggcattttctagcctcgaaagtcgaagcacaacattccgggcatggctgaggacctaaatagcagagttgatgtatgtttggagcccctccatgagtcttgcttaaactacagttgtagctggcgctccagcagccatattggacaatgaggaaccttgaaaatgtaggcttcaggctggaaaggatcaaggccatcaagctacagatgttcctacgaatggaaccccaaatgagctcaatcacaattctaccaagaaccccgtggaccaacccactggcccttgtgactggcctagagagttccccctcctggaggacactacaatgcagggccccttcttcatccctatccagcagaaagtagctagagcagtcatcaacccaattccccaaacagcaagtgtggggttgtcctgtcagagggggggatgagagggtgaaggcg

SEQ ID NO: 172273 - DNA, 505 bp, Homo sapiens
aaaaaaaaaccgtaccattacaagtcaaggtcagtgaggaaggattaaggacttctacccaagcttcctgctaaagactaactatgcttcaagtttaagccatctaccttttgaactagattccatttacattattctacagaggaggaaatgaaaagtactgatatgctggaatacccgaagagggtcactatgacaaagtgactagcttctcttccagttagatctcttctgaaagctttggaagaaaaacagtattcacagacaaatcatttttttattctctaatttcatatttaaaagcactacagacaaaattttagttacctatccagacaacctcctctatcaaccataataaatactcaaatgtgaatagtttctagtcttgaagtatatcttatgctcatctctccttaccatagttttcttatttcacagcagaccagtgaattatttgtagaagacagacacaaatctatgagctggtatttgagaactacta

SEQ ID NO: 172274 - DNA, 255 bp, Homo sapiens
aattgttaagcaacacataagcatgataaataccaaattcagtacagcagcttcctctggggaggaggaagaggtcacaaccaaattagcaatattttatttctgaactaggatgctaaagcaggtatatacttactgtataatcatttataccttttcataggtcctaaatattatgtaatttttaaacaatatctatatatagatataatttaagttggccaggtgcagtggctcacacctgtaatcctaaca

SEQ ID NO: 172275 - DNA, 348 bp, Homo sapiens
gctaattgatttgttataggttcatccctttatgtcagttctgtctaccacttaccatagctgtcatccctttttcctggaccactgaaagaacattacaattggtcttccatctctagactggtccctgccaatttctcaacacagtcctgccagttattttctatagtataagctgataatggcatccccttgtgacttcgtaacacttttaaggtaaaattcaaaatcataagctttttcttgcaagaccctttacaatctctctgctccctatagctctcatctcccaacactgttctgacatgcatctttccagccagccttactgaaaatcgtgtagatcct

SEQ ID NO: 172276 - DNA, 133 bp, Homo sapiens
ctcctccaacttccatcaatgtctgcccttgggtctggttttaaactctaaggtgtaaatgactcataatggctcaacattttgtccctcccaagaggtatttttaagtctaaggaataaagatttaatagta

SEQ ID NO: 172277 - DNA, 232 bp, Homo sapiens
aaaaagaaaaaaataaatgaaaaagagtgggaacttccatgtaaaagtgatcattttaaataaagaattaccaatgggacttgtgtgttcatgtgatttccttaaacgtatttgttgccttaggaaaagctacttaaacttcctgaacatcagttttctcatttgtaaaatgtatgtactttataatggtgttgtgagtgttggatattaacaaacgttatcttccttagag

SEQ ID NO: 172278 - DNA, 213 bp, Homo sapiens
cggccgcagggaccttcttgcatgctgaatcctcagtgcaaatgaaaacaaagggactggtcactaaaggaaatcctgttgtctccatgataatcaactccaagaagtgctgagaagtgcccaagcccttgggtccctgctgggctcctgccctctcttgccacagggatttcctccaagctggaatcaccatttccttcctaatcctggcca

SEQ ID NO: 172279 - DNA, 872 bp, Homo sapiens
ggagtgtggggtttcttcgcggctgctcaagatgaaccgactcttcgggaaagcgaaacccaaggctccgccgccagcctgatgatgcatgccacggtggacagtagagcagaatccattgacaagaagatttctcgattggatgctgagctagtgaagtataaggatcagatcaagaagatgagagagggtcctgcaacaggaatatggtcaagcagaaagcctgggggagttttaacacgcaacaagaggcatgtatgacgcagcagggggacaattcttgcccaacagtcattcacacatggaaccaggccaattataccatccagtctttggaaggacaccaagaccacggtggatggctatgaaactgggagtaaaggaaatgaaggaaggcatacaagcaagtgaagatcgacccagattgaggatttacaagaccagctagaggatatgatgggaagatgcaaatgaaatccaagaagcactgagtcgcagttatggcacccagaactgcatgaagatgattagaagcagagtggattgcactaaggtgaatgagcttctgttgattgaagacagttctaattgggcatgaggcagccatcctgaaccttgcaattcccagaaggtgtccccatgttacaaaaaccaggttggagtcctggtgggtgaacctggttgcacagatcctggttaagaatttcaccaatcaagcatttttgtgaacaacccttttttggctgcgacattttcttccaattgcgaaacattagcgctcctttctgggaaggaaatgctttttcacaagacctggggaaggctcgcaaaagcctttttgaaacacgaattatcgggggccaaatagacag

SEQ ID NO: 172280 - DNA, 665 bp, Homo sapiens
tgacatttgttaccattctgttgttgaggacgaaggaagggttgggaactcagagagagatcaaaggaagcttaatattttccatctctgggagcccagtgaccccgtacacctactaaactatcccagaccctggatattttgattctggagagtctagttcaggtccagactgctgcatctgctgtccctcgaggcatgccaagaggcacatgggagaatgatgggcacccaggaactcaggttaggctttgctggatgagctcgcccctctataaagagatgacattaaaatctaaatttaaaaaagtcaggaaatctatggtgaaaatttgcttgttttagtttgttagaactcaatattcacacacaacattgagatatacataataatcatcagagattttaatttttttaaatatcctgttttaccacaagcctcctgatgtgtatattagaagagagtcatgaagtgtaggcagcaagcagaaggaggcagaggggctggacaacaaggcttcacatcaacaccatcattaaggtaatgatcctttatcaatattgcacaagaccaaaagaaaatatttatttaccattaaaaataatgatgtgggtatagatttgcatgcatgaaaaagctcctccgagacatactgttacattta

SEQ ID NO: 172281 - DNA, 359 bp, Homo sapiens
aatcatggagaatgataggcaaaagcgaatctcattgttttaaaactatcatccaaatcacgagtgcttttctgaagcatagtcatttaggagatttctgagtgtgtgggatacaaagaagaagagaaacagggatcgacaagttactgagaattcaccattgcaggcacaggggtgcttttatgccttttatccttttataaaatttatttaaggccaggcgcagtggctcatgcctgtaatcccagcactttgggaggccgaggcaggaaagtcactggaacccaggagatggagattgtggtgagccgagatcgtgccattgtgctccagctgagtaagaagagcaaaactccgtt

SEQ ID NO: 172282 - DNA, 352 bp, Homo sapiens
gagttaattggagtagggttgacagaatataaacactgtgatgttgctaggagcaagagcatgaaggcaaacgattcttttcctattatctaaccttcctctgtgctgaaacaaaattattacttggaaaaggtgttaagtggaatcgtccatgatgtttttaaggataaatttattttttcttatgtaagtatatctgtcacaaaggaagatattgaacataagtactgaactttttgtttcatcataatgtttggttgatgtgacaaaattgttttgaagtatcggtctcttgaattaatgtacttaactctttttagtaagttgtttgtgttggtagtttttggcaaag

SEQ ID NO: 172283 - DNA, 320 bp, Homo sapiens
ctgggtctcctcatagactcctctcatcctccttcatttgtgcctgtctttactgcttctggggagagtgtcctgctcgcctggggccctgggcctccttgcaatgccacactctcatcccagccccacccccgagtctagctgggcccctctggtagggttgggatagagctggccaaatgaggccagtgaaggccagagctctggggcaagcagctttcctctcttacaagctgatggttgcagaatggggctcagcctactagaaaaagctggatctccctcaggtgaagcagcaaactcaggggggatgggaagct

SEQ ID NO: 172284 - DNA, 290 bp, Homo sapiens
ccaccttggcctcccaaagtgctgggattacaggcttgagctaccatgcctggctaagaatttccttccttttcaaggctaagaatttccttccttttaaaggcttaataatattgcattgtatgaatatgccacattttgtttatccgttcatctgtctgtggacatttgtgtgtttctaccttttggatattgtgaaaaggaatcactagatcacatggaaattttgtgtttaactttttgaggaacgaccacttcattttccacaaaagctacaccattttataatc

SEQ ID NO: 172285 - DNA, 761 bp, Homo sapiens
cctgtttctgcaggcaggctaagaaactttccccataggctctttacctgttggtgtaaagcccttttgggcaaagccccacctgggctcacctggtcagtaaacattgattccgtggttccatctggctgtggtgacttagcacttacaagctggctagctccttgtggattacggctctgtgagtgtttcctaggccccatactgccaagtcggggcagctctctcttctctcatccataaagccaggccaagctcctcattttccctgtgagcaccaagctcataaacctatttgtcctttgcctttctttcctctttccctagccctaccactgccattcaggaagtatttattaagcacctactatgtacagggtaccagaccatatacttgagcccttgatcacatactatcttatatgacttgagttatgtaatttgggcttcctcaacaagactgtaagctcctagagggcgagggagcgtgtcttctgctgcttctgtctgccttatagcacctacagaagaacccagcatggtcatgtgagtaaatccttggtgacttgccttctaggctcacaagttcaatgtgagctctttctccggggaaggatgagaacaaggagagtacagctcagttggctgtgtggtctcagtatggacctagtcttggggctcttgcatgccagggagggagaagggccagtgatcccagaccctttggtactcctttatcctctctatccacacagaacccc

SEQ ID NO: 172286 - DNA, 350 bp, Homo sapiens
gggagatttgttttggtgctgtgaaggtgtttgtagagttaaccccagcttcagtcaagggcttatcacaagtctattatccttatcctgattgttccttgttatcacttgaaacaagtaaatcacgatttttaaaactgaacttttaaataaaataagtagataaaaataagcaaaacactaatgaaatcagttaaaatagtaaaatagcttaaatgcattaaaaaataaatagccactgtggaaaatagtatggcatttcctcaaaaagttaaacataaaattaccctgtgatccagcaattccacttctggtaatttatccaaaagaattgaaagcagggtcttgaa

SEQ ID NO: 172287 - DNA, 528 bp, Homo sapiens
agtcttatgagagttcatgcatttgatgagggaagcaaggaaaagaacaaactgaaaaatgattatttgatgattagatagcgcttccattgacagaaatggaaaatacaatagaaaactttgagagaggtattcagggacagaagagttggaagagcaaacaattactgagcaactccatatacatttctatgcatattactggttttatcctatttaacctcatgatagatggtgaaaccgaggtagttgaagttatctgcccaggagcacagatagtagcaggtctagagaagacaatcagttcagtttgtgtcatgctaaattagaggaagaggtggaaaacttaggtgatgacatgtagcactgattggagctccataaacagagcagatccaagatagatttggggtgagttatgtgcatggttaaagtcattatgttttagaatgtcaatggagagaatatagcattaaaacaaagaggcaggagagatggtcaaagaaaatagaaggcaacaatttttca

SEQ ID NO: 172288 - DNA, 442 bp, Homo sapiens
aaactctcatctgatggaagaagaaactgaagtctgaagttaagaagaacaacttgacctgcccccagcctgcctgtcgtacgtgtgacactgttgcccttccatatatatgaagaaatgtatatggagtacttgccatggggcaggaatgaggtaaagtaggaccaggactagggtaagacaatgagacactagggtgaaaaatttaaggcagtcagtcacaggattgtatcagttcgggctctgtacttgcacagacctgaaaatgagtaccttcttgaattttccagctgaggctactcttgcttcaccatagtcctgcccctgtcattaggcattgggaatatacatagataaaataccaatcaattacttgaggtcaaggagttgttagtctgctggaggagagaagtagagataagtaaacagtcgtatgtgtgat

SEQ ID NO: 172289 - DNA, 510 bp, Homo sapiens
agatgtggcctggctgcttctaacaacctatgctcacacgtggagcaaaaaaaagtaagtgtaatttatttttactgcaagggaagcatagcgtaaaagcttaaaaactttgcagcctagtcatgtggcagaaaaataaaaagcttttacaagagaggaactcgagcaggctgtggagcaatcattgttagagatatttgtataacttaaaaaaaaaaaaagcaagtgttgatagccaagacaatgggaaagaggacttgaaggcattttagatatctaaaaggcagccccccatcacagaccctgaggcctaaaagaagagaatagtttctgggatcaggcccaggaactgctgccttgggtagccttagaacatggctccctgcatcctggccactgctccagctccaggtgtagcacagattggcccagttacaactccagtcactgcttcagagggtgcaagccataagccttggtagctttcatatggtgttaggcctgtgagtg

SEQ ID NO: 172290 - DNA, 368 bp, Homo sapiens
gaaactactgctgaaaggggcaaatccctcttccctccattctctctgtatttcatcctattggcagaatccaacaggcaaaggaaaacagtgggttgggctgggcatggtggctcatgcctgtaatctcagcactttgggaggccgaagcaggcagatgacctgaggtcaggagttcaagaccagcctggccaacatggtgaaaacccgtatctactaaaaatacaaaaacgtggtggacacctgtaatcccagctactagggaggctgaggcaggagaatcacttgaactggggaggtggaggctacagtgagccgagatcgcatccatgcattccagccttggcgacagagtgagactctgtctc

SEQ ID NO: 172291 - DNA, 212 bp, Homo sapiens
tacattcacaatgttgtgcaatcatcacaacccatttccagaccttattcatcatcccccaaaactctgttctgtaacattaagcaataactcctctccccagcccctggtaaactattctactttccgtctcttaattggtttattctaggtacttcatttaagtgctctcaaacaacatttgtccttttgtgtgtggtttatttctcccg

SEQ ID NO: 172292 - DNA, 216 bp, Homo sapiens
agttaccctgttgagtgaaatgttatgtggcctatggctgtacttacaccactctgagctttattttcagctaagaaaaaggggatattgtctaccaggtagcataacattcagaattaaatgaaatcacatatttaaagcacttagcactgtggccaagcaaataagggaagacaaaataaatgtaagttttcttcccccatgtgcaagactttg

SEQ ID NO: 172293 - DNA, 165 bp, Homo sapiens
cactaacgatggggttcctgaacagagtggtaggatagtactgctgccagctgtatttttctctcctctgggaagttccatgacctctggggaagccccgaagcttctagatccaggttcttcctttcaacgggtcctgagggaacccacagcctaatcccaggt

SEQ ID NO: 172294 - DNA, 392 bp, Homo sapiens
tttctccccaaattgatttatagtttcaagggaattctaatcaaaatacaacagttttatttgtagacatgtacaagttaatacaaaaatgtgtatggaaaagcaatgaacttacaagagtcaagacaatcttgaaaaataataaaggtgaaggattaatatctaatatcataaagctacattaaaaatataccattttatggtatattaaaaatatcttctggtttcttttgtgtgttatgccacaccaacttagctacatttatgactttcaatatcataattatgatattagatactatgatattaggtaccaataccatgatactggtgtcaggataccatatagacacatagactgtggttgtctacaggaaaaggataaggaaggt

SEQ ID NO: 172295 - DNA, 329 bp, Homo sapiens
cagaaatgttgtgctcatatttcgtgacagggtatggtctcgaatatgaaaacatgattctagatgttcctgggttaaattggttgtccgaaaaaatatctaatatcataaagctacattaaaaatataccattttatggtatattaaaaatatcttctggtttcttttgtgtgttatgccacaccaacttagctacatttatgactttcaatatcataattatgatattagatactatgatattaggtaccaataccatgatactggtgtcaggataccatatagacacatagactgtggttgtctacaggaaaaggataaggaaggt

SEQ ID NO: 172296 - DNA, 428 bp, Homo sapiens
actggcagaatgtcaaagactgtcttgtgatttcagcttcttactcgaataaaataatatgtttctcatgaagatacatgtttatacattttagatgtatttgttttcaggaagtggccattattttgcttttgcatagaaataatagtggattatgtaattctgtgtaaaaagtgcctttaataagtctgtttatataaaagtaatctccagcgctctttctctacctctgccctcaaggttgggcagggaggagaggaattgcaggaaatggaacaaaagtccttctgcttagtatgccaggcatggtggtctacttagtaggctcatgcctgtaatcccggcaatttgagaggccgaggcaggcagatcgcttgagcctaggagttcagacaagcctgggtaacgtggaaaaatcccgtctctac

SEQ ID NO: 172297 - DNA, 920 bp, Homo sapiens
aagctttctgactgctccaaaaaacgaagaaaaagattcagggagagtaagaggatgaagagagctggtgaagcagctgaccaaatggcccgaggtggtatgcagccgcggtaaagcagggcccctccgtgaggcacagccgcccgggggttccctaggggaagcaggggctgcggcagacgcctctcgggcaggtcagggtatgcaccctcccgcaggggctcccaaggccgggcgtgcgtgaggccaggtccacgggcacaccactgtgaacactgattaaacgtggcctccacggcttccaacccccaggacaggaccaaccctctgcccccggctcaggccagagctcggcgagaccgtcgctgtttaacaagcatttgctatacgccaccttgcattatgacagcatgtgacccacacagccatcctaggaagcaggtaacagccctactccattttgcacggaaagacttgcctgaggtcacagagagcggcaggcctgggatttccatccagggatccgactgcagagcacgactctggagggtcttccttcttgctcctcccatccttccactgtccttggatcccccattttccccctgcacaatctcctaattcctatgttcaacttctcattttcaactggatctttcccaatggcattcaacacacttggtgtcccccaccttagagtagaacattcaagcagcacagcctcctgaaggccctcactcatccctttcccagcctgtttgcgaaatgctttgtcaggactcaaagttaagtctcacttccgtccaattcccatccccacaccaacacagttctcaagtcaccaatgggtaaaaggcttcagtgatccactcctacagccaaaaggcactgctcggtctcttcagcctcagatggttcac

SEQ ID NO: 172298 - DNA, 133 bp, Homo sapiens
agagctgaccagagatgcagagttggaggaggcaatggtcgtcatatccctggaaggacccaagtgcatgctaggtgactgtttggcaggaatatatatgacttttcaggcccccggttccctgcgattttag

SEQ ID NO: 172299 - DNA, 457 bp, Homo sapiens
cattaaatgccttttccccatttaggatcatcgctctggaatattggcaggaaggttctgtggcatagtttccttgccttctaacttgccagcattagctgctaactctctctctgccctttgtttaaggtctgaaattgaatgaatggagaaggtcattttgtttgcccaacagccacatccaaccattaggcagaaaatacagtgttctctggctcctggaagaaaatcttattagactaattgctttatttatataacttgtcctcttcctatgaaatcagacagattttgaaagaggaaaaaaatacttgtggccattacttatattttagtgagtaaagtacatttgggcccagttatttcaagactcataatgacacagcgttaaactctataatctggaacatccaacaactcaaaactgaagctgcctcctgtgtgcccacaagatgtg

SEQ ID NO: 172300 - DNA, 617 bp, Homo sapiens
tgcactccagcctgggtgacagagccagattccatctcaaaaataaaataaataaaataaaataaaataaaccaagaagcaaaaatgatcaaggatagatcactggaaaattctgacaaaaattttatgaagaggtctaagaaaaaatgataaagaaaccagcagagtatgacattatagaagccacattatgaagtagtttcaagtagaagaaaaatagagaccagtgattcctcaggaaaatattccagttcgaagtctgattgaagggggtatgtagaaagggaaaatagattcatatggtgagaaatgttcatgataagtaaagaaaagtgagaaaatagaggaggatgtagaatcaagtgagtggttttactgtcaaagcagaagtgacttggattgctcatcatgtgaaatggaggtgactatacagatggagagggtaaaggaagatggagttaggggcacaatgggtggaatagggcacagagcaacaagcagaccagtaagaagagtcagttgacatcagagttcacattcttgaatttaaagcatctttcttaccaaatgttaaaatggtagaacatggcaggaatgcagtgtgtgtaaacacagag

SEQ ID NO: 172301 - DNA, 505 bp, Homo sapiens
ggccttgaacttcagggagggttttcttccccttgaaaagaggggaggaggaagatgtagtggcttaaaggaatcatgcatggtcattgaaatttgccatcagtgaaagaaaacataaatttagagatttctgaaataataagctgaaggccattgaatcactctccttaattagcttagttttctatcccaggcaagaaatctgttatcagttctgttatcaatttgtttataaaagaactactatgtgccaggcactgtttgaggtatttagaacataccagtgtacaaactcaagatcctttccttcatggaaaagacatcctagcacagcagaacctatggcactgagatgaataagaaaatcttaaaacaggagctaacaaccgttgcacaattatgagataagtgcactggcaagagattggtagtgaatattaacaaccaccatttattattcaacaaatatttactgaatacttactatatgtcaggctctgtgctt

SEQ ID NO: 172302 - DNA, 572 bp, Homo sapiens
  misc_feature (548)..(548): n is a, c, g, or t
gttacacttatcgcccaacactcctgcacgatagactctggttctaatgcttgttcagtctcttcaaactgcattttctgccttttaagtatgcttgtaattttctgttgataggtagacatgatacactgggtaaaaggaattgcagtaaacagggctttcatcctgttttcaggtgttggggataacatcgcccaacactcctgaaaggtgaccaagattactggcagcaacttaactgagataaacaggcttcaagttatgtgcaatacccagtgttccttgcttgctaaagtaataaaagcatatatgaatgcaaggtactgagaatattattatagggataatattgcatccactctcattgattgattgattgattgagacgacgtcttgctttgtcgcccagcctggagtggagaggcgcgagaccttgtttcaaaaaaaacaaaaattttttttttaccttttttttaagagacggactcttactatttggcccaggctgttctcgaactcctggtctaaagcaatcctcccggcttagnctcccaaagtgttggggataacat

SEQ ID NO: 172303 - DNA, 313 bp, Homo sapiens
ggtacatgtggcttgtggctgatgcactggacagtgtacatataaaacatttccatcgttgcagaaacttctattgaacagcagttgtattagtccgttctcaacactgctgtgaagaaatacctgagactgggtaatttataaaggaaagaggtttaattgattcccagttccacagggctggggaagtctcgggaaacttacaatcatggcagaaggggaagcaaacatgtccttcttcacatggaggccgcagcaaggagaagtgcagagagaagagggggaaaagccccttataaaaccatcagatctt

SEQ ID NO: 172304 - DNA, 387 bp, Homo sapiens
tagatttgttttgtccatgtttaagggcacctaagtgaaatcatataggatgacatactcctttctctctggcccccttcacacagcacgtgtgagacccatccgtgttattgctacctgtgttcttccttcaagttggctgtatgtggtctgctgtgtgttcattcaccagttatgtctcccttcttccaatcatgggggtttgggtggggagttccagttgggattatttggattagcactgccatgaacattcctgtgtgtatctttgggtgaacatacgtgagtgttttcgttgggcactaatgtttctcctaagtggttgcaccaatttccactccctctggcaacctgtgtgtgttccagttgccgtgctgcattattgcc

SEQ ID NO: 172305 - DNA, 358 bp, Homo sapiens
cctaaacaagcatctaggagtatatatgtagtttagagagagaaaaagactatcacaaagcttggctattttttatctttagcactcacacatttccattaaaagtttaccacaataaaaaagctgccacaaaacacaaaaattaaaaaagcttgtcatcacagtgtaaaagtcaacaactagagtacttagaacatgataagcatttagccaatgttttaaccactccactccaccccgcaacacacacacagagaggggggagatccaagatacatgctagtcatatgtgccagtcaaaagaagatacagagaattcatacagcaggtaaagttcatattttaaaatataacagta

SEQ ID NO: 172306 - DNA, 336 bp, Homo sapiens
agatgaccctgaaaggtggtgagcttcccattcccagaggtatgtgaatagaaaccttgagcttccagaaggaggtgggcagtgagaggtgttgcaggcatgttttgccagccacacattggacaccccttgctcagtcaagaagccacatccaaaccctcggaccctttcacacttggagcttttgtttgaaaggtcagacttcaaccctcaaaatgaagatgactttaaaaagctggagatggaccaaaaagtaaacaaaatgcaattataatttcatagatggaaagtaaaacaaatttttttaaaaagaagaaggaaataaaataatacata

SEQ ID NO: 172307 - DNA, 399 bp, Homo sapiens
tgagacagagtctcgctctgtcaccgaggctggagtgcagtggtgggatctcagctcactgcaacctctgccacccgggttcaagcaattctcgtgcctcagcctccagagtagctgagactacaggtgcgcaccaccatatctggctaatttttgtattttttgtagagatgaggtttcaccacgtcacccaggctggccttccaggtgcacggggctcctggattcaagcgatccactcgcctcagcctcccagagcactggagttacaggtgtgagccactgcacccagccactcagggagcttctgagctgtatcctcgtgccagtaggcgaagctcctggagagggcatgggtgcctgtgtgtcccacttccctgccttatgtggtaagtccac

SEQ ID NO: 172308 - DNA, 549 bp, Homo sapiens
gcttgattaccaaaacggagcactgcactgaggtcgtggttcttcttccaaattgccattcttttacagaatgggcctctaggttttcagttatccatcttacacacattttcttgtgcccaaaaagaagtcaactagaaagcataagctacccaatacctatttgagcacaactatagactcatcactagtaagctataaagcagcaccggaagtagctcttgccatctctaaccttacaaattcaattcaacaggcaagacaggagaacaattaaaaagagaaggctctgtggtagaagagaggtctatgataatcctcaaaccccagacaaattaaagagcttcaatattagcttatcattaggaaagggacagagcgccctaatattttaaatttcaattacatacagtgctatagggcacatataaactcacacctatagataaagatacaaaatcataaaatttcaaaactggaaggcacttacaaaccacctatatccattctaagtctagcgttctaatatacagtaaacatcttcatctc

SEQ ID NO: 172309 - DNA, 205 bp, Homo sapiens
ttacaagcgctaggagccagagggagacagtggaagaagctagcatattagaatccagtttaagagaatgaggaagactgtagaattgcgggtaggggatggctgctattactgtcgtggcagtgtgggcctggggttgtcaagtctctaggactttttctcccagtttttaagtgctgtcttacattttgagccctgtgctggc

SEQ ID NO: 172310 - DNA, 494 bp, Homo sapiens
tgggtgctctgaggatcccttagtgtcaactgtgtgcagagaattatgctagatggcactggtgatgcaacggatagaacacgtccttgccctcatgaagctcataaccaaaagtacagccagactgaaaaacgcggaaaaagggaagtggtagggaaccggtgggggagtaacacacatacaaattctgacctagtgagtatagagagaccacttggggatgctggtgatagaccttaaagagccttgtgttgaaagggtcttggaaacatgacagaaagaggaaggatattctggacaggaagaatgcctttcacaaaaagctcagaagcaggaaggcaaatgtaaaatatgaatgatgtagtatagacagaaggtaaactaaagaagttaggtgggaagtcaaatcatcatggatttttaaaactcgaagctaccaagtgcggatggagagtcaccagctatcagacctgacagtatacagttgacactca

SEQ ID NO: 172311 - DNA, 155 bp, Homo sapiens
gagtgaggggatcaagaggaccagggtcataactgaggatctcaggacttaggggagaggaagggattgcgggtacccaccagcaggaaactgacctgaactggctcccctgcctaacttcccatcctattttccacctctcagggttgagtatg

SEQ ID NO: 172312 - DNA, 191 bp, Homo sapiens
ctggagtcaatatgaagtaatacctttttaagacagtttggctgactgcatttaataatgtccaatcatgctaagtgcaataattttgtattgggttgagtggcttgcatttgccacctgtggcactgtgatgcctgctgtatgctattttcacttgggtttcactctctctttaattgtcctgcctttta

SEQ ID NO: 172313 - DNA, 295 bp, Homo sapiens
atactgtttctccaagctacagcttttatggtaattcctagtggttttagcagaaataaccagccacaccacaaataaactccctgaaatctattttgttaaatgctgtggaactacagggaagccactttgtggactaagagcagcttcctagtagaaggcaggtcttcagtaggactaagcaggacggtggtaagaaaagttctagctggctacacttgaggcaccaaaaacgccatccatgaacattctctggctttgaacccaaaagcactttttacttcatttgagtatg

SEQ ID NO: 172314 - DNA, 353 bp, Homo sapiens
tggtctgtggtccgcatggtagaactctagccagggctgtggcttttcattttggggacgttgggagcagtatagccacagccccaggtgagctctgtgaggtggaagagattggacattctaacccctttgcctatggataactgaatgagtcaagatccaggcaaaatgatttgacgtagcaaggttttgtcaaagcagtagaagcaaggctcctggttctcatgtcagtctgttgtctgatatatttgtatctggtttttgttcttgttgttgttacagttctggttgtgagaattagggaaaagcctgtaaccacgaatcagaagttctcttcttttgctaacttttct

SEQ ID NO: 172315 - DNA, 483 bp, Homo sapiens
cctcttttggaaatgacttgagggattctgcatcatcacttacttcaatgctcttttcttcttgctggctaatgtgggtgcgctctgggaaatcaaagctgctcatgctgaggaattaactctaaaagctgggagtatccagagcagaatagtatctttgcctagaaaaatggtgtcattttagtggtattactgagatggaacacacagcaagcaaaatggtggcctaaagcaactgtgggccagtggttgcagaccttgggaacaaagctgccaaaggaaatcacagcagattcctagagggattgtgtctacctgggcagccccagatattccgggtttccttacttgagagagagcttgttctaggacagcagccctatctggaagtttctgagatattctaaggaagttttcaagaagaattagactagctgtaagtcccttccttactcatcttccctctcaaatacaacaacaaca

SEQ ID NO: 172316 - DNA, 613 bp, Homo sapiens
  misc_feature (564)..(564): n is a, c, g, or t
  misc_feature (613)..(613): n is a, c, g, or t
ctattctgatcttgttttaggaagtcaagaatgactggataaagatgaggaaagactatatacttagcaggagtggcaacgacagcaatattacagaggtgccaagatactgtgaggaatatgtggacagctggtcaactgaaggaaattcacacagaattactcgattggttcaggcagagatttttatttatttacttttttttttgagacggagtcttgctctatcacccaggctggagtgcaatggtgcgatctcagctcattgcaacctccacgtcccaggttctagcgattctcccacctcggcctcccgagtagctgggattacaggcacccaccatcaggcctggctatttttttttttgtatttttgtagagacagcgtttcaccacgttggtcaggctggtcttgaattcctgacctcaggtgatccgcctgcctcggcctcccaaagtgctgggattacaggcgtgagccactgcacctggccagggttaaatttaagaactgtttactacttgttatattaccacaaacagggtaagtctcttgactgtgtntgcatgccaaaaacacctgctactttgatcgtgtattggtccctttttn

SEQ ID NO: 172317 - DNA, 111 bp, Homo sapiens
tgtgtggagctggcagcatctgctcctcaccacctcagaccagtcctaccttccctagctacttccccatagctgcttccactgcacgttcttctgaaccctgacggacag

SEQ ID NO: 172318 - DNA, 254 bp, Homo sapiens
ttttggtggtggcaagacaactggctttggcatgatttatgattccctggattatgcaaagaaaaatgaacccaaacatagacttgcaagacatggcctgtatgagaagaaaaagacctcaagaaagcaacgaaaggaatgcaagaacccaataaagaaagtcagggggaccgcaaaggccaatgttggtgctggcaaaaagtcgaagaagtaaagggctgcaatatgttatctgcggccattgtggatttttc

SEQ ID NO: 172319 - DNA, 631 bp, Homo sapiens
tccagaggaaatacatgcccaaaaccaaaagaacatttctgggtgagtattccatttcctgtcgactccaagagtagcaacacagtcctttagctaggaattctgagctggagcttcctttcgtcactgagagacatgtcctaggccctgcttcctctttgtaaaatccagatggcatcgtatccttaggctacctcatggacttgaactgaagagcaaataacatgtgtaaagtatactcactatacaaattaaaggcaagaatggaagacgagactataagaagctgatccagttctgttatggccaaacctgaggtgccattcatttcaacgagtccagggtccagcccctactctatggctaggagcaccctctggagattggggcaagttcctaatgaccatatactgctgagaaagccagataccatctagctttctccagttcctcccaactcttcgcagttctcattctgtatgggagaagaggggaaattagaaacagaagaggagggccaggagctgtggctcatgcctgtaatcccagcactttgggaggccgaggagggcagatcatgaggtcaggagttcaagacaagcctggccaacacagtgaaaccccgtctcta

SEQ ID NO: 172320 - DNA, 212 bp, Homo sapiens
gatggtccctgcctgcagaagctctcagcctagtgcagggaacaaacatgtgaatacatgcccttctatttggtaaaatgaatggttgagagagcaagaggggaagagatgactctgcccatgaagatggagaaggtatcaggaaaaggacataattgggctgggcatagtggctcacgtgtacaatcccaacactttgggaggcctagtag

SEQ ID NO: 172321 - DNA, 670 bp, Homo sapiens
atttctgagtcagcttcactcttgcatcatctgctttgacagttttcttggctcctgtaatgagaaaaagggaaaaaaatgctgcagcagctggggctggcttcctgatcccaccctgggaatcagagtctcagctattgataaacatttctagccatacctagaaggagaggaccttgcttctgtgtgttgaacagttccaagaactccatggtgaacttcctatgaagaaccctccataaccctcaacccttcaaacctgacggtatacctcattttgttctcccgtctctggcattcctcacccacccacgctgactggtctttccaaagttcatttctgtaatataggatgtctttggtttcaacaaacatttgtaagtgcccctgagcctggtctttgctatacactggggattgagaggtgagacacaagcccatggggaaatgtatgttaattagaaaagtgaaaaaattgtgtatatgggataattccaactgttttaaaaaaaaaatcctaggaaaaatgcaaatgcctatttcagagaaagaaatggaaatcccaaggtggcaaaaaggaaggcagaattcatcctgaatgtaactggggtttttttgttttgttttgttttgtttgtttgttttgtttttgagacaggcatgggattac

SEQ ID NO: 172322 - DNA, 430 bp, Homo sapiens
tggaccagcagacgcaaggtcttgagggtggtgaattggaagtgaacttgaggctgggaaggcagggaccaaatcaccaaggccttgaatgtcaggccgagaagggggatttgagcctgtaggcaatggagagctcctggaggatttaaacaggcacagcagggtgcggttggtaattctatgaaacccgtctctggcttgtgggtggtgctggaggccgagagaccaatctggagggcgagtgatccagcctcttagagtcaaagggacccagattttactcccaccccattgcttcctacctctgtggcctgggacaagtaacttatttaaaatgtgaggatactaattcttgctccactgatttggtgtattaaataagataatgaattacatgtgcaaataaataaaaagtggtttgtagtgtgta

SEQ ID NO: 172323 - DNA, 241 bp, Homo sapiens
aggggaggaaggaggggagaaacaatcacccaagtttccatttctaatttgggttggaaaatcatacttccattccttgaatactaacttcatgttctggcctacagttaagacttttggtcttatactaggaggaaaaagcctaaaaccacagctgttggtcccatacccttcttggctcactccattttggtgcctgccaaatctctacacatctggtagccactcattcctgctacac

SEQ ID NO: 172324 - DNA, 551 bp, Homo sapiens
ataggtattcaataaatgttacagtattagcatttttttcagttgtagtagtagtagttgtagttagacccaagaacaatggattgctggatttgtattttttatttattcagaaacctttttgaattactttgggacaacatggattaacctatgggacattatgttgagtgaaatcagccaggtacggaaagacaaatactgcatgatctcatttatatgtagaatctatattgaactcctatagaaatctaaagttgaaatctaaagtagaaatctaaagttgaactcctggaagcagagggtaggctggtggttaccagaggctgggagtaggagggagcagagagttggtcaaagatacaagttccagttagagagaaggaatatgtttttgaggtgtgttgcacagcatggtgaatatggttagtaataatgtatattttagaattgctaagagagtaaatttccaatgttctcaccacaaaaatgatatatgaagttattattccatagtgtatacatatcttaaaatatcacattgtacacct

SEQ ID NO: 172325 - DNA, 295 bp, Homo sapiens
tgcatttgttgaatggggtaaaaattgcatagcatctcgagtgctgtgcctacaaattaccttgataaatgattgtgactcagcaaagcttaggcttttgccctagttttggaggctggggctaactagagaaaaaatggagggtctgttgggtgtttctgctgtttttacaaggcttcataattccccattgtctgcgtgtgtgtgaatcagcaagtggttcgcatcctgattgggtggtgtgatgggagcacccacctcgcagagcctcagagccctcattgtctcccttttc

SEQ ID NO: 172326 - DNA, 500 bp, Homo sapiens
ggtcaggcactgaagcctggtcaggcactgaagcctggtcaggcactgaagcctggtcaggcactgaagccgggtcaggcactgaagcctggtcaggcactgaagcctggtcaggcactgaagcctggtcaggcactgaagcctggtcaggcactgaagcctggcctaaagctttctaacaaactttcactcctgctctaaaacttgccttggtctctcctgcgttatgcccctcagccgaattctttcttctgaggaggcgagaattgaggctgttgcagacctgtgcagattcaacgccagtaacagcatggtcatggctcactgcagcttaaccccctgggctcgagggatcctcctttctcagcttcccaagtaggtaagactgcaggcacacatcaccatgccctgctaattaaacaattttttttgtgtagagacagagtctcactttgttgcccaggctggtctcgaactcctaggctcaagcgatactcctg

SEQ ID NO: 172327 - DNA, 403 bp, Homo sapiens
ggaaggattgcttgagcccaggaggttgaggctgcagtgagctgtgatcgtgccactgcactccatccagcctgggatagaatactgtcagaaagaaagagagaaagaaaggaaagagagagagagagaaagaaagaaagagagaaattatacctgggtttggaccctgtgctcaccacaaaggagctgtgaccttgggcaatttatttcctagagtccaagtttcccaactggtacagaggagaaaaataataataacagtaatacctgacaggttgggagagattgtgctggtgtcacagagtctgtgacggcacttgtaagggagtgctgcataaatgagagtggctgctgttgttgcattattatttgttttacatggttataaaacttccctcaagcc

SEQ ID NO: 172328 - DNA, 380 bp, Homo sapiens
cgaaatagcaatttatacatttttggccaaaacaaaccaaagttactacagcaatgaaataacattatatctgtatatagaaactgcttgctaaattcatgatatagaagcattcagaccaatagataaacgaaaacaaaaaagacacataggaaatatagcctttaaaaataatgcagatgctcctctacttacaatggggctaagtcttgataaacccatcataaatggaaaatatctcaagtcgaaaatgcatttaatccacctcacctaccaagcatcatagcctcacctggccgacccgaaacacctgcatcaggctacagttgggcaaaatcatctaacgcaaggcctattttataataaagtcttgaatgtct

SEQ ID NO: 172329 - DNA, 588 bp, Homo sapiens
ggagaggctgggaagcccttcaaccagaggctgaggacatggaatccccaggagtgcctgctgctcatggtagaagtggccagatctcgatgcggcacctgtaagagccccctgctgcttcctgcccccagacccactgtccccagagacctctcaggcttgctgaggagcatgcatctctgtcacttgctttgggtcccctcggtcacctcaaagatagatgcttacagcccgtgggtgacctgctgtttccaccccctcccgatgcccctgccccactggtgtgaccactgctcctggcttgcaatgtctgtgcagctatgacagcctgagttcctctcagggtgggtgtccctcctgcagaaagcccgccctgtctcccaggccccagctctggtcctgggcagaggagggaaggactggggtggtggctgatggattctcatgttgcctctttcccgtattcccctgggctcttctctcagaacatgccccctgaatcctgacggctcactgtgtctcatgtaggaagcccccagtgacatctcgtgccctgcacacaagtccctgaacctgggcccctcccca

SEQ ID NO: 172330 - DNA, 598 bp, Homo sapiens
cgtatggaagatgaaagcatggatggtaaggcacagaagtgaagtagtttagtcaaggctagtgagtggcagaactaggattcacacctactctttgtgacattgactcttaggctgtttccaccacttttccagtagaaaattgatttttgattgtaaactaatttgagttggctcgacttagtgactgattttctttaactgatgtcaaaagaggctgacgcttaagccagaaggcagtttataaacttttggctggagcagtgtagcagcaggaccagaattctatgatagctggtcactgtatcccttctgctgtgagacagtttgtgtgggaggcccaatgggcagagtcagagctcagaatcctggctaaccttgaatgtgacatgtcattgaactgtgacagttctggtataaaaatatgcctcccaggtagagcagaatactttcaccagctgatcacagaacgctcttccttggacagaggaaaatctcttttacttcacctctatgaagacactcacccagtaacaaatttttttttttttttttgacactgcactccagcctggacaacagggcgagagttcatcta

SEQ ID NO: 172331 - DNA, 347 bp, Homo sapiens
caccaccaggcagcttcctggccgttggtaggttcctgcagctggctgagggaacagggaccggcaggggactttgttaggggagggttgggatgggcagtgggcccctgaaagttaatatattggaacctagctcgagtgtcgttctttccaattccgaaagtagaaagagtaaaaataggggtgattggggtggggttagtagaatgcctctctcagggcgctcccccctcccccaccgttttagagagctaggcctcagccagtcttgccactcccatctcagtgcttcctgaagaggctgttttgagtgttgatgaaaagcaatgcaattatgccaaacagta

SEQ ID NO: 172332 - DNA, 464 bp, Homo sapiens
tacatctggagttaacacaagtaataaacacatctacaccaaaataaagtggcgactattttccctataaatgtaatatcattcaaatgtacatggggaggagtaaaaacttatagagcatggcaaatctaaagttactgcctaagtttaggtatggtcagaagtacccttgaggccgggcacaggggctcacgcctgtaatcccagcactttgggaggccgaggtgtgcagatcacttgacacctcatcagctcctgacaactcctgacaactggtcaggagttcgagaccagctggccaacatagtgaaaccccatctctactaaatatacaaaaattagccgggcatggtggtacacgcctgtagtcccagctattcgggaggctgaggcacgagaatcgcttgaacacgaaagatggaggctgcagtgagcagagatcatgccactgcactccagcagtg

SEQ ID NO: 172333 - DNA, 235 bp, Homo sapiens
aggcccttcttatatactaatactaacagtttaagaacttaaatctctttttcccctagtgggattcttattcctttctttttcttcaatgtttgagttcaggggtacatgtgcagaatgtgcaagtttgttacataggtaaacatgtgccatggtggtttgctgcacagatcaacccaccacctaggtattaaacctggcatccattagttattcttcctgatgctctccctcc

SEQ ID NO: 172334 - DNA, 443 bp, Homo sapiens
tccttccatacctttcattccccagccatgtgacccaacgcgttcacaagttccagggattaggtcatggacacttttgggggccaccatgctgccaaccacagggaagaaagttccatcaggatgacagttgtgggctgggaaaaactccagaatgaggagcaaggaagtggtttgccctctccttctctccatgttgacactggttctcttctgctgcatgctagagaccttaggagagggagaatgagtggcttcttcccattcatctccccgcacttctgtcaggaaatgaaatcccacgcagcactttctgtttcagttctcgtggagtctacgtttctaattggcaccaagactgccagctccatctccgactgtccctctgtctctctcactgcatctgcctctttgtccgcatccttctgcctcctgtccctgtc

SEQ ID NO: 172335 - DNA, 568 bp, Homo sapiens
agctgtaaggtggggcccagggggaaatgttgggcattttgtttgacctctgtggctcctgccaacaatttaggatagctgctaaaaaaataacaaaaagctttgggccttaatgaagacacggtatgcttatcaaaagatgtcccatcactgtgcactaaatgaggacatagattttaaaagaaaatgagtttactagacagtgaaaagaaagaactatgcgcgacagaaaatattaatatctaaaagtaaatatttaaaagtgtcatctggaaataaaaatctttctagaaggcaaaacaagaaatatgcgaaagttacaatatttaacacaatattgagaagaatttaataattagagctatcaagggaataagttgcctcataaactaggtaagctccctacgattggaagtatttatggagaggcttaccaactgtcaggaatgttgtaaaatcaattcctgcactggaaaagaaatacattaaatatttctaaggcctttcccaccaacagtttatgtgattccctgccctacccttaccattaatgtaatttatgatacca

SEQ ID NO: 172336 - DNA, 784 bp, Homo sapiens
gggacaatggtgtggggaaatgacatcaaaggtccaaaagaaagtttcctagcaaggctgccaccaccctggggcagccaacttaggggtgcaggacagttatgagaggtacagagttaagacaagccaccggtctgggctgtgaatgagtgtgaatcagcatgagtgccgcttcctcggcccccacttcaggagaatgcacccacatccctgccatctgatgaacatggaatggtttttcttacctgggaaagaatagctggagcctccgaccacagggttttcccaaggtggggaaaccaagccgggttcttagacaagttaagtacagatgtccacaagcactgcagctggagacagtgctgagtggacgtcaggtgctgacgaccacaagacacacacgcccagcaagcgtctgatgggggtctcggatgcagataaagatggagaagtcctactctaaagaagccaggaggcccacgtggaaaatctgcctttcacactgccccatggaaggaggaatgtatttgttccagaagaaagagaggaatcatgacctggataaagcagcgagttaagaatgccagcttgacctcagaatgaaagcttctatttagtttgtttttaaaggtaggatctcactacgttgcccaggctggagggcaatggctattcacaggtgcaatcccactactgagcagcgtgggagttttgacctgctccgcttctgaccagggcaggtttacctctccttaggcgactggtggtcccctgctcccagaag

SEQ ID NO: 172337 - DNA, 355 bp, Homo sapiens
ggccttaagaagaggaaggccgtgacctcacttaggttctaacaggatcccccagctcttttgatgaaattaaatcgcaggggtaagggcagaaacaggacactcattcagaggccgatggggtgatagggcagtgatgatggaagctcagacccgggtgctgagatgcggtcccacctgatgtatatttgggaaataaactgatcaatgggttaggtatgtgggttatggaaaagatacgtttcaagggcagccgctagatttggggcccgaatcaacaggtgagtggctgaatacccactcttaggaacaacacatttttgcaacatgatccagctaagtctcatgtctgaat

SEQ ID NO: 172338 - DNA, 397 bp, Homo sapiens
tcccccataatccagaaaagtaaaagtatgtatttatctagaagaagcactcttgtaaattgttactgttatgttaatggcttctcaatgccaacaaaataaatctgaacttcgtagtgtgacattcaaggccatctaagatctggtccttgcttacctcctctactttaatattcttagcacatcatttctatgcacacataccctctgcacaaaaagcaaatggaaaatctggggctgtactagtttttttttttaatttccaaaacgtattatggagttttgttgtcatcagtcaccctctacctggaatgccttcttcctcattcactttacctgcttcaaatggttgatataaaaatgacttgctagtgcctttaaactggaggtggtacat

SEQ ID NO: 172339 - DNA, 655 bp, Homo sapiens
agaagaccaagcaggcagacgtgttcgggggcccgcgggttccgagactggagactggacctttggctgtccccacgtgcattctaggtcaacggtgcggtggcagaaccctggggctctcccccgcggaactcggccctggccgaggccccaaccacgctagtaggaggaggccgagcatccctcctcgaaatcgcgaaatcccggcccgacaatgtagccacggagtcgaaagccgcgtgcgaacttggcactcacaaagcctagataaccgtctattttctcctgtaaaataggagggatggacccccacagatcattgtaaaaggttcttacaaagaaaaatcctcctggactgggcacggtggctcacgcctgtaatcccagcactttgagcggatcacacttcgagaccaacctgaccaacatggagaaaccccgtctctactaaattagccgggcgtagtggcgcatgcctgtaatcccagctactctggaggctgaggcaggagaatcgctttaacccgggaggcagaggttgtggtgagccgagatcgcgccattgcactccagcctgggcaacaagagcggaattctgtctcaaaaaaaaaaaagagagaaaagaaaaatcctggaagtcaagtaaaaatgtgtg

SEQ ID NO: 172340 - DNA, 1859 bp, Homo sapiens
  misc_feature (1379)..(1379): n is a, c, g, or t
  misc_feature (1407)..(1407): n is a, c, g, or t
  misc_feature (1411)..(1411): n is a, c, g, or t
  misc_feature (1414)..(1414): n is a, c, g, or t
  misc_feature (1417)..(1418): n is a, c, g, or t
  misc_feature (1423)..(1423): n is a, c, g, or t
  misc_feature (1427)..(1427): n is a, c, g, or t
  misc_feature (1440)..(1441): n is a, c, g, or t
aaaaaaaaaaaaagatgtgagggtgatctggctgcgacatctgtcaccccattgatcgccagggttgattcagctgatctggcggctaggcgggtgtcccctcccttccttaccgctccatgtgcgtccctcccgaaactgtgcactcggtcgaagaggacgaccatccccgatagaggaggaccggtcttcggtcaagggtatacgagtagctgcgctcccctgctagaacctccaaacaagctctcaaggtccatttgtaggagaacgtagcgtagtcatcccatcaccctttgctctcttttcggactcggcccgcctgcacccaggtgaaataaatggccttgttgcgtgtacacacacacacacacacacgcgcgcgccgagcatggtggcacactcctgtagtcccagctactgggaagactcaagtggaagggttctttgagcccaggaggcagaggctgcagtgagccgagatcctgccactgcaatccagtctggccaacacagcaagaccctgtctcaaaaaggaaaagaaaaaagactagtagaaaaactctgtaaaagagccatgaagggagacggtcccgtcagatgcgaaaatcctcaggccgggtgcggtggctcacacctgaaatcccaatactttgggaggccaagacaggtggatcacctgaggtcaggagttcgagaccagcctggccaacatggtgaaccccatctctactaaaaatacaaaaattagccaggcatggtggtgggcacctgtaatcccagctacttggcagactgaggcaggagaattacttgaacccaggaggtggaggttgcggtgagccgagattgtgccattatactccagcttggacgacaaaagcaagaccccgtctcaaaaaaaaagaaaaaaaaaaatcctgtgtcgggcctcagtttaaaatgtgtggtacagtaagatcatagacaggcagtcagagacagacccaagtacagatgggcattcactgtctgaccaaggcagccccttacatgaacagggtaaagatagacttgtctaaaaatggcattaggcacctgaggagccatctggaaaaagatgaagtcagatgcaaacctcactttgtatactagataaggatccaatgtagtaaatatttaaatgctagtgctagacccaaaataatattagtgtcaagcatgaccttttaactatgactcaaattccagaagccatacaaaagacatgttttttcttgtcttttttttttctgagacgaagtttcactcttgttgcccaggctggagtgcaatggtatgatctcagctcactgcaacctccacctcccgggttcaagcgattctcttgcctcagctacttngcagactgaggcaggagaattacttgancccnggnggnngaggntgcngtgagccgagatnntgccactgcaatccagtctggccaacacagcaagaccctttctcaaaaaggaaaagaaaaaagactagtagaaaaactctgtaaaagagccatgaagggagacggtcccgtcagatgcgaaaatcctcaggccgggtgcggtggctcacacctgaaatcccaatactttgggaggccagggcaggtggatcacctgaggtcagggtggtctcgaactcccaacatcaggtgattcacccacctcagcctcccaaagcgctgggattacaggcatgagccactgtgcctggtctagaaatctgtatttttacataaaatctttctatttaaaataatagcccttctgctctggtccttgggcccttcctccaaaaaataaaaagagtataataaaaaataaaatgtgggcaatctattc

SEQ ID NO: 172341 - DNA, 414 bp, Homo sapiens
ctgagacgaagtttcactcttgttgcccaggctggagtgcaatggtatgatctcagctcactgcaacctccacctcccgggttcaagcgattctcttgcctcagcctccccagtagctgggattacaggcatgcgccatcacgcccaactacttttgtatttttagtagagacggggtttctccatgttggtcagggtggtctcgaactcccaacatcaggtgattcacccacctcagcctcccaaagcgctgggattacaggcatgagccactgtgcctggtctagaaatctgtatttttacataaaatctttctatttaaaataatagcccttctgctctggtccttgggcccttcctccaaaaaataaaaagagtataataaaaaataaaatgtgggcaatctattcaaaa

SEQ ID NO: 172342 - DNA, 637 bp, Homo sapiens
  misc_feature (11)..(11): n is a, c, g, or t
actctagagtntcccatgccaataacctccatctaaagtcaagaccaaagaaagaatcttaagaactatgagacaaaagtgtcaggtaacccatatgttaatctaacttattagattaaaggacatttttcagcagaaatctcacagatcagaagggattagggtcctatctttagctgccttaaacaaaataattgtcaggcaagaaatttgaatccagcaatcctaaggttcataaatgaaggagagataaattatttttcagacaaatgctgacagaatttaccacttccaagccagcactacaagaaatgctataggagttctaaatcttgaaacaaaacctcgaagtacaccaaaataaaaccttcttaaagcataaatctcacagggaaagcaataactgacaatggggggaaaaaacaaggtattcaagcaacaactagcatgatgcatataacagtgcttcacatcttaatactaatgaacgtaaatggcctaaatgttccacttaaaagatacagaatggcaggatcgataaaaatccaccaaccaagtatctgctgtattcaagagactcacctaatacataaggactcacatcaacttaaggtaaagggaggtaattggcattcca

SEQ ID NO: 172343 - DNA, 731 bp, Homo sapiens
agactggcttaaggatagcagagaaggggatgccaggggtgacttctaggtttctagctttcgtaaccagccactgagatagggaactttggagaataatgtagtttggagagagaactgcatttagttctggacatttttagttcgaggtacccttgagatcttgtcagttctgtatatccagccatctcctgggtatctgtacttggttcatttatcataatctcaaaccaagagtttctaaaatcggccgtgttcatctttctctaaaaccccctcctgtgttcttcacatcttttggtggtaccaccactatttatcccagagatctgggcccaaagctgattcatctttgagtcttccccagtggctagtctcttttgctttctacctcggtccttctctacttctagatcctcatagcctctcacttgtactgaagtatcagctttcatggttttgaggagtggttgtagcccacttcttgctagtccagaatgctcagtgctgccagatgaatcttcataaagcaccagttaatcatggcattcctgttctccagaagcatcctttagatctcagtctccctgatcctagccgtgtagtactccccaggaaattcccatcaccgttgctgaaacctggcctatatttttttaaaataaactctccatgcttttcccacatgtgcagctgatgtgactcttacttgcttctcaaatgccaatctc

SEQ ID NO: 172344 - DNA, 391 bp, Homo sapiens
aagacagcagactgaagcctattatgttaactcttctgcacagaagggagttcatgtttgaggcgtgttatttcagatacataaggttattttcagtgtttagttgattacttagtaaacataggttgtctttcgaacgagttgtgatgaaggagaaccgtgtcccatccgtttgcagtggtttatccactgtctgcatggtgtatccttaacatggacagcagcgcacatcctgcacttggtcatctcattctttctgtttctatttagcactcactgcatttctctttttcatggcccttggccctttcaggcgttccccctctcaacattgtagatatctgcatattggaaattcacacccggaaataaaatagaaatatgtagttta

SEQ ID NO: 172345 - DNA, 486 bp, Homo sapiens
ctgtaatcccagcacttcaggaggccaaggcaggcagatcatctgaggtcgggagatcgagacccacctgaccaacatggagaaaacccgtgtctactacaaaattagccaggcgtggtggcgcatgcctgtaatcccagctactcagaaaggctgaggcaggagaatcacctgaacccgggaggcagaggttgcagtgagctgagatcgcaccatttcactccagcctgggcaacaagagaaacttccttgccaaaaaaaaaaaaggtagcatttccttagagaaaaaattagttaacagcttgtgcaatgacagcacagatatttaaatcattccaatgtcatcgtcacatgacagcttaggataacgacacttattaggtatgcagctttagacaaaacaatctttctgagtacaagttttcccttctgttaagccacaaaaaagaaaggggtgttgggcgataaatcacgcgatcctctatc

SEQ ID NO: 172346 - DNA, 154 bp, Homo sapiens
gaccatcctcaacattcttggtggctgcaaccttagtaggctttgaccattaattaaactgacatgattcacgaattggataaaggcttttgacagtaggaataaacatcagatgggtagattgattccctatccttaaggaaaagaaccacag

SEQ ID NO: 172347 - DNA, 624 bp, Homo sapiens
agtggcactttgtaataaaatcttatgtttattttccactgttgaatacacataccttagtgttcccagagagggaagcctacaatgctatccaatgaatagtttgcagatggattaaatacatgtaccaatgaaataaaacgtgcagatttggggctttttgcctcctacctttgctctgggcccagagctccccgatgatgacacgggaggtttgtgcaaagatctgaagtcaagaaggattagtttaaagagtcagatgaaaaaggacacaaatgaaaatgcttctgcatgagcctgaaaaccaacacttagcaatgagtgattctgactttggggcctgtaacaaataatagcaaatgagggaagtttccagtggcttcacagcaggagggcaatggccagggaaccactgtgaaacagatcagtcaacgggacttcctggttcttgaggaagctttgaaggcagggagtgtggcatacatgtaagggtctttgttgctaatatttttttttgaggcatatactttgcaggggcaaatcttcaagttgccacttcctgagaactccctcattttagtgaatatatatttcaagcccagtagttgaatagcactattattg

SEQ ID NO: 172348 - DNA, 3884 bp, Homo sapiens
  misc_feature (1224)..(1224): n is a, c, g, or t
  misc_feature (1230)..(1230): n is a, c, g, or t
  misc_feature (1246)..(1246): n is a, c, g, or t
  misc_feature (1295)..(1296): n is a, c, g, or t
  misc_feature (1299)..(1299): n is a, c, g, or t
  misc_feature (1321)..(1322): n is a, c, g, or t
  misc_feature (1326)..(1326): n is a, c, g, or t
  misc_feature (1335)..(1335): n is a, c, g, or t
  misc_feature (1337)..(1337): n is a, c, g, or t
  misc_feature (1345)..(1345): n is a, c, g, or t
  misc_feature (1353)..(1353): n is a, c, g, or t
  misc_feature (2889)..(2889): n is a, c, g, or t
  misc_feature (3835)..(3835): n is a, c, g, or t
gcgacgtcagaggcgcgggtgttcgcctacgtcactggggcgctacggtgcctggagctgggcggtcttctcgtcagagtggggactggtgagagcgacctccccgccaggtcctgtgtgttgccggctgaagaagggtagctgaaaaattcagacccagcacagtgtttatgttggtcaaaaatagaaaactatggcgcggccgaggcgggaggacccttcaggccaagagcagcctagcaacatggcgcaaccccatctctgtagtcctacctcagccccccagctacttgaatccaaagattcaaggctccagtgagctatgatcccaccacagcattccagcctgcgagattgagatgatgattattccccaccttctaagagacaaagaccaacgagccaccacagccaccagtcccagaacccgccaatgctggggaacggaaaatgagggagttcaactctggccctcacaatccagtggaggagacgaaactcatctgcctctgtccctctgggcacgcctcatgccaggtgcatctgtggacaggggccacgctcctgggcttccaaagttggagaaagctgccaggctcaggtctgaaggccagaattctacagtaagtcctactgagtcaaggtgggagcagggtcggtggcttccgaggctctgcgggagaatccgtttcctggcggtagaggtggcctgcactcctcagcttgtgctgcccgtctcgaatgactggagtttcctgcttctgtcactacacctcccaccctctcccatcacctgctctgctcttacaaggatccgagtggagtcttgctctgtcatccaggctagcagtggcgtgatcttggctcgctgcaatgtctgcctcctgggttcagatgattctcctgcctcagcctcctgagtagctgggactgcaggcgcccgccaccatgccctgctgttttgtatttttgagaaatggaataatcgtatcgctgatctatgtaaacaaattgaagaattgtctgaaagaaaatatgacatgaacttatgaattcaacaggtgaagatttacaacttgataaatcagctttgtgagctcgagctgtaaaagccaaaggtccggtgatgatcccatacccttttttccagtctcatgttgaagatttttatgtagaaggccttcccaaaggaattttttttttttttttgagatggagttttcnctcttntcgcccaggctggggngcaatggcgcaaccttgctggtcactgcaacctctgcctcctgggttcnnganattctcctgccttagcctcccnngtcnctgggattncnggtgcccnccaccacncgaggctaatttttgtatttttagtggagatggggtttcaccatgttggccgggccagtctcgaactcctgacgtcaagtgatcttcccgcctcgactcctgacatcaagtgatctttccgcctcggcctcccagagtgctgagattacagacgtgaacccatgcctggccaggaattttgtttttcaggaaggctttctactaatggaattcctggccttgagaggatgttactttcgaaggaaaggatttttttgttattaaaagagccacctaagctgaagattcccttgagaacaagtactgtcctgcggtttcatggcccttcttccatttgtggttcttgcgaagtggaatttaaatgacatcttatcaagatggataaaccctagtttcccagtgctggaatatagaaaatggatggacaagtaaatcccactcagcacccatagtccaggcatggggacctcaacacacctgagccccagacatcacctttcattctggacctaccatgaaagacttctgaatccaggaagagaaactgactgggcaacatgttattcagaaacaggaccttgccctgtcactcaggatggagttcagtggtcctatcatggctcattatagcctcaaactcccaggctcaagcaatcctaccatgtcagccttcccagtagctgggactacaggctggagtacagtggcacaacctctgctcactgcagcctccacctgccaggctcaagcaattctcctgcctcagcctcccgagtagctgggattacaggaagtgaccgcacaatgactcaagctaccacatactgttgattgtgaaatgccagttgaagcatatgtcctgcgagcttaggggtgctacaagttgaccactgcagcagtaaagatgactctgaagaatggcgtgggatggatcctttcgaatgcatttgagcagcggtctccaaccacagggccacagagctggagctggatctaccatgaaagacttctgaatccaggaagagagactgactgggcaacatgttattcaggaacaaaaagatttggactgtaacttaaaaatgatcaaataatagtgcatgcatcaagtgcaatgggaagctcttctggagagtgagagaagcttccagttaaggagatggggtctcaccctgtcacccaggcttgagtacagtagtgctatcacagctcactgcagccttgaactcctgggctaaggatcctcctacctgagcctcctgagtagctaggactggtctccctctgttgtccaaggctggagtgtagtagtgctatcacagctgactgcagcctcaaccttccaggctgaagcgatcctcccatctcaacctcccacgtggctgagactacaggtgcttgccactatgcccaactaatatttggaatttttgtatacgtggattccagaggggtgacagcgaaacgtgggaccatccagttgcaggaaaacaagcttaacacgcccactgattctacattatgctcctacctccnggcagcctctccaggcccagaactttctccagtcagcctctacagaccaagctcatgactcacaatggcctatttaggcccataccctacgtcacggcagtctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgtctcacagcagattcttcaggcccagcatctgcctcactgtggaccccccaagccaagctcccaacctttcagcagcttctacacacccagctcctgccacccagtggcttctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttggcctctccaggcccagctcctgcctcctgtcagcgtctagaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccagnccccacccccagatgcatttattagaaataataaagttctttcttagct

SEQ ID NO: 172349 - DNA, 469 bp, Homo sapiens
ctctttacaaaaatatttttcaaaattaaataaatgtagctaggcatggtgatgtgtacttgtagtttcagctactcaggaggctgaagtgggcagatctcttgaggtcaggagtttgaggccagcttgggcaacatagcaagatccctcactctacaaaaaaattaaaaaaataaccaggcatggtgacactcaactgtactaccagctactggggagctgaggcaggaagatgccttgaactcctgggctaaggatcctcctacctgagcctcctgagtagctaggactgtaggtatacatgacgatacttggctaatttttaaattgttttgtagacacggggtctcactttgttggccaggctggtgtcaaactaatggcctcaagtgacccttccacccctgcctcccatcctcgaggcatgtgccaccacaaggagcacttgttcaattttctaaaaaaaaaa

SEQ ID NO: 172350 - DNA, 1426 bp, Homo sapiens
  misc_feature (431)..(431): n is a, c, g, or t
  misc_feature (1377)..(1377): n is a, c, g, or t
catgccttgggagctaagtggttgctgcacttgaccactgtgaagactggtgtgggaagggtcgtttcggatgcacttgagcaggggtccccaacccctgagccatggagccgcaaggagccacacagcaggaggtgagtggtgtcgagtgagggagtgagggaagcttcgtctgtatttacagccactcccctttgctcacattcccgcctgagctccaccttctcagatcagcagcagcattagattctcataggagaacgcaccctgttgtgaactgtgcatgtgagggatctaggttgcgctgtccttatgagaatctaatacctattgatctgtcactttctcccatcacgctcaggtgggaccatccagttgcaggaaaacaagcttaacacgcccactgattctacattatgctcctacctccnggcagcctctccaggcccagaactttctccagtcagcctctacagaccaagctcatgactcacaatggcctatttaggcccataccctacgtcacggcagtctccgcagatgaggctactgcctcacaacagcctccacaggcacagctccatcgttacaatggcctctttagacccagctcctgcctcccagccttctctccaggccctgaactttctcaagtcgacctcaccaggcccagctcatgcttctttgcagcctctccaggcccagctcctgcatcttggtggcccctccaggcccagcctctgcctcccgtcggcctctacagtcccaacatctgtctcacagcagattcttcaggcccagcatctgcctcactgtggaccccccaagccaagctcccaacctttcagcagcttctacacacccagctcctgccacccagtggcttctttaggccaagctcatgcttcacaagggcctttccaggcccaacttttgtctcatggcaaccttccctggccagattcctgcctgtctcccagcagcctagacaggcccaggtcttgcctcacactggcctctctacatccagcttatgcctcacggtggcctctccaggcccaactcctgtcccaggacgtcatctccgggcccaaaacttactcaagtcagactctctagtcccaactgctgcctcctggtggcctatgaaggcccaaaatctcctcaagttggcctctccaggcccagctcctgcctcctgtcagcgtctagaggcccaacctctgcctcatgggggcttctccaggcccacctcttcctcttggctgggtctacaggcacaactgctgcctcacaacagccttttttggcccagttcctgtccagctcatggcggccaatgtaggcccaaaacttcctcaagtcaaactctccagnccccacccccagatgcatttattagaaataataaagttctttcttagct

SEQ ID NO: 172351 - DNA, 886 bp, Homo sapiens
cgccatgttgcccggcctacgcatcgggggcgtggcccagtgacgtcacagctaagcgcctctgtatcgtcgcgaatccgtcgcggaacctgtcttctgtctttacccagagctaccatgagcaagcggaaccaggtatcgtacgtgcggccagccgagccggcgtttctggcccgcttcaaggaacgggtcggctacagggagggacccaccgtagagactaagagaattcagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgc

SEQ ID NO: 172352 - DNA, 916 bp, Homo sapiens
cgccatgttgcccggcctacgcatcgggggcgtggcccagtgacgtcacagctaagcgcctctgtatcgtcgcgaatccgtcgcggaacctgtcttctgtctttacccagagctaccatgagcaagcggaaccaggtatcgtacgtgcggccagccgagccggcgtttctggcccgcttcaaggaacgggtcggctacagggagggacccaccgtagagactaaggtgagccttcgccagtcgtgtttcttcggaagcgcagccagcccgccactttcaacttttgcctctacttggagggtgggtgctgtcgggtccctcttttcacccgcgctcgaacccaattccggtggaactcggacccccaggctggttcttttcaagcgaccacagccccctacgcccaggaagctctgtagttttcagagcgctgctgtgttcctgaaaatgaactgacgtgtaaaccacctggtccttggtagatggtaaagaaagatcactttattgtctcttctttctcacttgtttacctcaaaagctgtgagttcgcagggtgagttagagttacagcgtcgtcccgtattccagataaggacacaggccactcgatcaaatgacccccgccccaaccatgtcctaggactcgagtctggaacgtcttcggaggaatgtcctgaatctgtttctatgctttgttaattaaaaataaataaaaataatatagagaaggtcgggcacagtggctcacgcctgtaatcccagtactttgggaggcctaggtgggcggatcacctgaggtcaggagttcgagaccagcagagccaatagccaatatggtgaaaccccccgtctctgctaaaaatacaaaaattagccgggcatggtggcacatgcctgtagtcccagctactccgga

SEQ ID NO: 172353 - DNA, 5177 bp, Homo sapiens
  misc_feature (3375)..(3375): n is a, c, g, or t
  misc_feature (3514)..(3514): n is a, c, g, or t
cgccatgttgcccggcctacgcatcgggggcgtggcccagtgacgtcacagctaagcgcctctgtatcgtcgcgaatccgtcgcggaacctgtcttctgtctttacccagagctaccatgagcaagcggaaccaggtatcgtacgtgcggccagccgagccggcgtttctggcccgcttcaaggaacgggtcggctacagggagggacccaccgtagagactaagagaattcagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattatgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcanagcaaaacatcaattatggatgacaaaagtcttaagacagccataaagacacagttgacaaatgtggctatttctgtggcttacaacaatttaacataatcattacaacatatattaagacatatcagaattttagaantctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacagtggctcatgcttgtggtcccagcactttgggaagccaaggtgggagaattgcttgaagccaggaatctgagcccagcctgggcgacaaagcaatacccctatctctacaaaaaataaaaaatagccaggtgtggcgacacacacctgtggtcccagctgctcgggaggctgagcgggaggatggcttgggcccaggggttcaacgctgcagtgagctgtgattgcgccactgcactccagcctgggcaacagagtaagaactgtctcaaaaaaaataaaaaatagaaataaattttaaaaaaagaattacccatattctctttgtttttgtttattcacattaacctttattctatctggaatttatttgagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccgggctggagtgcagtggcgcgatctcagctcactgcaagctccgcctcctgggttcacaccattctcttgcctcggcctcccaagtatctgggactgcagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatg

SEQ ID NO: 172354 - DNA, 5002 bp, Homo sapiens
  misc_feature (3200)..(3200): n is a, c, g, or t
  misc_feature (3339)..(3339): n is a, c, g, or t
aattcgcggccgcgtcgacacgacagaagggacccaccgtagagactaagagaattcagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattatgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcanagcaaaacatcaattatggatgacaaaagtcttaagacagccataaagacacagttgacaaatgtggctatttctgtggcttacaacaatttaacataatcattacaacatatattaagacatatcagaattttagaantctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacagtggctcatgcttgtggtcccagcactttgggaagccaaggtgggagaattgcttgaagccaggaatctgagcccagcctgggcgacaaagcaatacccctatctctacaaaaaataaaaaatagccaggtgtggcgacacacacctgtggtcccagctgctcgggaggctgagcgggaggatggcttgggcccaggggttcaacgctgcagtgagctgtgattgcgccactgcactccagcctgggcaacagagtaagaactgtctcaaaaaaaataaaaaatagaaataaattttaaaaaaagaattacccatattctctttgtttttgtttattcacattaacctttattctatctggaatttatttgagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccgggctggagtgcagtggcgcgatctcagctcactgcaagctccgcctcctgggttcacaccattctcttgcctcggcctcccaagtatctgggactgcagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatg

SEQ ID NO: 172355 - DNA, 5087 bp, Homo sapiens
  misc_feature (3285)..(3285): n is a, c, g, or t
  misc_feature (3424)..(3424): n is a, c, g, or t
cgccatgttgcccggcctacgcatcgggggcgtggcccagtgacgtcacagctaagcgcctctgtatcgtcgcgaatccgtcgcggaacctgtcttctgtctttacccagagctaccatgagcaagcggaaccagagaattcagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattatgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcanagcaaaacatcaattatggatgacaaaagtcttaagacagccataaagacacagttgacaaatgtggctatttctgtggcttacaacaatttaacataatcattacaacatatattaagacatatcagaattttagaantctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacagtggctcatgcttgtggtcccagcactttgggaagccaaggtgggagaattgcttgaagccaggaatctgagcccagcctgggcgacaaagcaatacccctatctctacaaaaaataaaaaatagccaggtgtggcgacacacacctgtggtcccagctgctcgggaggctgagcgggaggatggcttgggcccaggggttcaacgctgcagtgagctgtgattgcgccactgcactccagcctgggcaacagagtaagaactgtctcaaaaaaaataaaaaatagaaataaattttaaaaaaagaattacccatattctctttgtttttgtttattcacattaacctttattctatctggaatttatttgagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccgggctggagtgcagtggcgcgatctcagctcactgcaagctccgcctcctgggttcacaccattctcttgcctcggcctcccaagtatctgggactgcagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatg

SEQ ID NO: 172356 - DNA, 593 bp, Homo sapiens
ctgagtgtcactgttcacgattattataaatatctagaacagttgctaacacatagtaagggctcaataagtattgaatggatgaacgctttccctaatatttgtatctggcttcccctggaacctctatcagtgttccttaccttcccttccctgtccacttgggccgtttattttgagtagaacccatttgcattacctctgttgtgacttacttgcaacaagattaatcttcccttatacctctttttagtatagcatatatcccttagttttgtaattatttgaatacattttttactctcttgggaagcaagtctaacttatttttactttcctattactgaagatgaacagtggctaacataataaacacccattaattatttttccttgaaccgaatgtcatgagaaaatataataaaaagaggtgggttagttttaagctaccttaataaaattcagtgttcagattcaaggtgacattgagcccagcaacacaccttcattggtcagatcacatcaacagtattatggttatatctgggatatcacactttacaggatggcattgtaatacagtgtcacagagt

SEQ ID NO: 172357 - DNA, 534 bp, Homo sapiens
gggaaccccacttatttttaggcttcagctcagacgctacttccttcagaagtccctttctggcacactaccttcctcatgtggcttatttgttcctcttgcaccagatcactccgcagcttttgagtttgtatatggcaacaatgaacaaggtataatcctcgctgtagataaactcatcatatttgtttttctccatggagtgaaaatgttttaagctcatataatgactatggtcagggaaaaagccacacaaataattaggatatgttgtgacagtgcacaaatagaaacacacataatgtgcttgagaacatgataaatgccggttttacctttccttccctcacctgaccaagcttagcgagacgtgtggcatcttcctcatctttgctcttcagtgccaggtatggaataggtccattatggacaggtgccttattgaactgagcagagccacgaatgtcaggctgggagtgtggtcgctggagtcaggccttggtttacatcctggttctgcttcttaaccactct

SEQ ID NO: 172358 - DNA, 712 bp, Homo sapiens
attatgccttatattaccatgcttggtactacttgcctctgcatttggctgtggtcaacaagtaatgcagaagtgactagaagttactatagatatgggtttagaggtggcttttctgtgcaggtagaagttaaattgaaatcccaaacgccgtgacgttctcagtgggagagttttccttttagagggaatgtatggctgaaatacagtgaaaaatgttggagaaggaggctaaaactgtatcctatatcatcttatataggattggtaaaatagtttgtgttttattctaattatgataggaagccatgtgaaatgacagagttcaagtaatttgactcatgcatttaaaaatgttataatggagcaatcattgaatgaagaacaatgacttaaaaataaaaaaaatctaaaaattatatatttatttttatagacagggtctcattctgtcacctagttgctgcagtgcagtggtgtgatcgtagctcattgcagcctccaactcctgggttcaagcagtcctcctgtcttggccttccaggtagctgggaatgcaggtgtttgtcaccacgcccagctaattttaaaattttctgtagagttgggggtcttgctttattgtccaggctggtctccagctcatggcttcaagcaatccgcctgcctcatcccctcaaagtattgggattacagttgtgagtcaccatgc

SEQ ID NO: 172359 - DNA, 565 bp, Homo sapiens
agctctgtcccagtttcttcatgtggataaaaatgtgggtagtaatagtatctcagactctcataagattgttatgaggttaaaatgagataatccatgtaaaatacttagaaccctgcatggcagtgtaagtgctcaataaaaatcagctgctgcttttattatcaccaccccttccagtgtctttttgtgtgtgtgtaaaaaggcagtggaagttccttgggataaagatatgttatgataaagattgtttgataattaaaacaattaaataaataaaactttctagcactattgtaaatctcagacactggcaggtactaggagttcaaatatgaacaagaagctcacaatctaatgggggtaaattgatgtgcacacaatcataatatagtaaggaaggacttaataacacaatttgtgccaaggggatagttaaagaaaggtatcacagagttactgacattagaattgagtctgtgggcccagtagagacaacgactttggcagatggagaagaagaggagcagaggttcaagcaaagtgaaaagctccgcttaaaaca

SEQ ID NO: 172360 - DNA, 412 bp, Homo sapiens
gaccctcagagaggcgaggtttcgagggcacgagttcgaggccaacctggtccacatgggttgaaaaaaaaaaaaaaaaaacctcgcgccgaattcggcacgagcaaggggctacggtctacaaggcagtattacaaacaattactctgggacccaacaagtccagaccacacataaagatcaggaatcttaagctttcaagttagaaatgaaatatgaagtagcacataaataattcctagttcaaatttcacttttgtttacatttgaaaaacaaaaaagctactaactccatttatgaaagcttcgcatgatgcagaaaaacaaagctttctgaacaaaacagtttctaataataacttcaagttgtcttggcccagtgtaaaatatgaaataaaccagtattgatcat

SEQ ID NO: 172361 - DNA, 2677 bp, Homo sapiens
ccccctttttaaccacaaaccgaattttctttcatttaggtgatctatatatatctatatcgtatagcttatagcttatatctattttaaataacttaaagccgctaaaatttgggggggaacagctttcgccctggagcggtgcgcgatgctgtctcatgccgacctcctggacgccaggctaggtatgaaagatgccgccgagcttctgggccaccgggaggcggtgaagtgtaggctgggcgtggggggctccgaccccgggggccatccgggggacctggcgcccaactctgacccagtggagggagccactctgctgcccggggaggacatcaccacagtgggctctactccggcctcgctggcggtgagcgccaaagacccggacaagcagcccgggccccagggcggcccgaaccccagccaagccggccagcagcagggccaacagaagcagaagcgccaccggacgcgcttcacccccgcacagctcaacgagttggagaggagcttcgccaagactcactaccccgacatctttatgcgtgaggagctggcactgcgtatcgggctgaccgagtcccgagtgcaggtctggttccagaaccgacgcgccaagtggaagaagcgcaagaagacgaccaacgtgttccgtgcgcccggcacactgctgcccacgccaggcctgcctcagttcccgtcggctgccgccgccgctgccgccgccatgggcgacagcctgtgctctttccacgccaacgacacccgctgggcggcggccgccatgcctggcgtgtcacagctgcctctgccgccggcgctgggcaggcagcaggccatggcgcagtcgctgtcccagtgcagcctggcggccggtccgccgcccaactccatgggcctgtccaacagcctggcgggttccaacggcgcggggctgcagtcgcacctctaccagcccgccttccccggcatggtgcccgcctccctccccggccccagcaacgtctccggttcgccccagctctgcagctccccggacagcagcgacgtgtggcggggcaccagcatcgcctccctccgccgcaaggcgctagagcacacagtctctatgagcttcacttaatgcagccgcgccccggcccgctccgcccccagcaccgccccgggggccgccccgaggcccttccggcgcgcacccggaccccggcgccctgccccgtcccgccccggccttcgccccgtctcgtttcgtcctcgcctctctcctccactcgctcgggctcaccccaagccccagcccgcgaggcctcccctccgcctgatttcgatcgcccgcggtcccccgtctcccggccgcccctcttcccttcccacccagctgcgccctcggctcggtctccagcgcctcagcccacccttcccgccaccctggcctccctgctggcgctggccgtgctcgcgccctcctcctggccttctgacgggcggcgttcccacccacaccttcgacgcgacgcctacgacccccctcgcccgccgcctcccctccggtcccctctttccccacacttcgcgaccctcctcccgcgcccggcaaaaagtatccttcccgccattttacgtaccagggagtcgactcaggatctgaaatcagacaccaatggactggtttgtgggcagaaacacacacactcgcactctcgctcacgctcagacgctacacacgcgcgcgcacagacacggtgcacctaggtcacacacggacgtgttcaagggacagcacaatgttagggatttttgtcttaaaggaggacaagcattgctaccaaccgcctcatctgagggcccaactgatatgatttgatttatccttgtactctccaagctcctgtctttctttcctctcccaccacgctacccttgcccagtccacccagtcacatccgtgcagccctctcttggcttgcaagataacgcttttatttttattttatcttattttcattttcttaagcacaactgtgtgagagtgtagaagggaaggcttctcaggaggaacgtgacagtggattgggtggctggagtagactaaagcagtcatgtgacgaggaagaggtgatctgacccattttgataagtctttataaggaagaataaaataaacgtgtaagcaaaattttcttttgtaaaagcaaaagccacatctcttttctggatccttcaggactggggtttgtttgcttccttttctgtttctgtcttctcgctgctctgtgcccttggttgttttgtggtggtcctgtcgtccctcgtgcccctcggccacctgctggcagccgatgggggcactcggacatctacaaccctgcaactttgtacagagaaacacaatcagctctttctgcatgtgctggtcaaatccaaacccagagaacagaagcgctttctaagaatgaacaaatatgtgaaataggatgttttgtgtagataaagcattcttgttacatactggtcaatttgtgatatgttttaacttaatgtctgtgtttatttatggaattcggttttcttaataaatgtttgagctaatataaagcatattatttgacttttccggacaagtttatatcaagttaaatgtaaatggataaaataaaatcattttcagtatgtg

SEQ ID NO: 172362 - DNA, 259 bp, Homo sapiens
accttctagcttccacctgaacactcatcttggctcaagaactagtcctccctaagcctcagtttcctcatctgtatattggggtcagtacagcccccggctcatggatgaataagcctggccctccatatacgatacctgatcccaccattcacaggctgcatgggagctttttatttttcaattgtgcaatttgtgttttaaaaatatatgacatgaggccgggcatggtggctcacgcctgtaatgccagcacttt

SEQ ID NO: 172363 - DNA, 481 bp, Homo sapiens
ccctcccacaacagtaactcctcctaccaaaggcaacttacctgctttctaccgatcagcacataatacctacctttaaatttaaaaaattaaagataaatatatcctttgaccccagttctccattcctttattcatttccttctcctaacagaaaaaattttcaccaaaaatgttgcctgtagtcacggcttcgaatcttttacctctaattccctccttcccactccactgagcctactctccacaatgtcaccagtgacctccatgttgtcaccaaatccaagggcatctgtctctcttctagagtcgttggccagccagcaacattcaatgtcccctttttccagaaaccatgactgctctgggctcccatgacatctcatgggttttctcaagtagtcacctttttggatcatcctctgtgtgttcttaaatgtcacagtgcccagagctcactcctgccccacctcttttctat

SEQ ID NO: 172364 - DNA, 277 bp, Homo sapiens
cagagacagggtttcgccatgttgcccaggctttcagtggtttttagtatattcacagagttgtgcaactatcaccacaatcaattttggaatgttttcatcaccctaagaagatacccccaactccttacccatgacctccctatcttcccatctgctccaagcccctggcaaccactagtgtactttctgtctctgtagatttgcttgttccagacatttagaataaatagaatcagcaatatatgaccttctgtatggcttctttcactcagca

SEQ ID NO: 172365 - DNA, 672 bp, Homo sapiens
ttattataacctttatactcaacatcggtgcatcttaaagtgactattaagcatcaaaaacctgagtgtggatatcccatgggtcaaataactagtttaataaataaattttcatttttctatttgcaaatcattctgaataaagaagaaatcccaagtgactgagacatgccacgatgagacaactgacaaaacaggagcttccatggcaagtacagtttctcctgaagtatattgtgatggcatgcaagaaagctcacaacattcaaaacaactagaaattcccatctaaaaaggctctggtaatggctactctcagtggttcaaaaacaaaaaaatgtccagctttcatgagagaatagagaggacataatccatctcctgaagagtattcaaagaagtttcaaatcctgacaatgtcaaaaaatgaatctactggaactttttgagctagtgttctaacttgccaaataaaataaggtaaggactgcccagaaatgagtcactgctttgaaatataatctctctcttttatttgtgtcactaagtctattgatgatatggttaaccaaggagaatttttctatacatgtgttatgttgaaaatgtttacagtatattcacctgtatgttctcagcgtccacctgacagacccttttcataatagaaaa

SEQ ID NO: 172366 - DNA, 345 bp, Homo sapiens
gccgcccattttgaagcggggggtctggatgaatgggtctgggctgggcctaaagagcccagctgttccctgcaccagactggagctaagaggagcaggtgctgcatttagctggccccatctgccagggaggtgctgagtggggagtgacaatcactgctttccccacgaggggtccaagcacttgaagttaccttcatcttggggagaaatgtttctcagagaagattctagcctccctgatgattttttatagaattctggaagtttcagagaatagaacatttgggtctgaaatgtgcactcttttgtggcagccatgagctcttcaaggctgctgtggat

SEQ ID NO: 172367 - DNA, 594 bp, Homo sapiens
tcactctatgattgtcccaatttgtttttctatgccatgacaaaaacaaaatactttcaaaatgttctgagcatttaaatgaacatttaagtgtatgtaaataaacttatttaagtaacttttatgttggtaataaaccaacacatgcattaaatacctcttcagcgtaaacaggaaatactgatgacgatgccagcatggaactgtcaattcacattacagcacaattaataatcaatctgactagtttagtgatatttaaaggacacaattagtcactatatctgccagaataattgaatatgttaacattctcctcgcgtaaataccaatttcattatctcatatctttctctttactcgtctccagatagcaatagccctccctgtgtgggtcatgtagaaatgacccagaacttgttggtctaatattttcggtctaattctttccaacctttggtaaacttagaaagcctgcagggatctcatattgatgattttcaatcttttaattgtgatagtctttttgttattctgtcttttcaccttcctttgcctgtccatctataattttcaattcaagtttatatcagt

SEQ ID NO: 172368 - DNA, 203 bp, Homo sapiens
gcaaaagattttttatgtaagaacttaattcatatatacatctctggctttgaacttcgagaaaattattatacttcttgggtggctgaaaaattcttggccttaggcattttagcaataattgttcagaactgcacagcctgctatgtcttattcccttgctacagctgtttactttgtgataactgaacgaacaatgcgga

SEQ ID NO: 172369 - DNA, 123 bp, Homo sapiens
gccctacgtgcctaatgaggtactctgtataccacttttttttaaatgagcagagtgtggctatttactctacatgaaaaagatatggtatattatacatgttttcttcctagtttcagaaag

SEQ ID NO: 172370 - DNA, 440 bp, Homo sapiens
agatgcaaatcccaactctgttattttactaaatgtgtgaccttgggcaagttaattaacctgttttggtgtcctcctctgtgaaatggagttaatcgtggtatttaacagaattcaaaatgtagtgtgttctaaagcgctgtgcctggagcatcatcaccactaggtggttagggaagtaaaacacatttggcacacatcattcaagaatggccagaaaatccatgtcttcccacaatagggaccaattttttgcctttcaccagacaaccactgaatgttaagaatctactgtgtgctaataactgtgtccttgctgtatgacagaagctatttggagcgctctcaagtgcttattacagctagtcaaggaaaccgcatatataaaataatactggatacaagactatacaattaaatactggtgtatcactaacaac

SEQ ID NO: 172371 - DNA, 227 bp, Homo sapiens
gcatgggttttcatttagaatacttttatgtgatgaatctgagctttagaacaatggaatcactttcccagagtattaggaagagaattgatgatgattaaatcccagttcttcctgattccaaatctcacagtctatctctgcactatcttgcctccttactctgagttaaaatcggatgaattcttttcacccaccagtgttaagtctgccttctggcataaaaa

SEQ ID NO: 172372 - DNA, 250 bp, Homo sapiens
ccacatgcacacagatgagcacgggtacacacacacatgcacacacacagatgagcacgggtacacacacgcacacccacatgcaggtacacacacgcacacccacatgcacacaatgcaggtacacacccacacccacatgcacacacatgcaggtacacacacacacacccacatgcacacacacagatgagcacgggtacacacacgcacacccacatgcacacacatgcaggtacacgcacaccca

SEQ ID NO: 172373 - DNA, 158 bp, Homo sapiens
actaaaatgaagccagccccccttctgctactccagagaatcatgaatggggcagtggggaaacacagaaacagattccatgaaatcagccatgcaagattagtttgaagataatgacactgggcttaaaggaaatccattacaaatgaaacttataa

SEQ ID NO: 172374 - DNA, 210 bp, Homo sapiens
cttccacaggtagttctagctacttgggaggctgagatgagagtatgacttgagcccaagagttcaagactagcctgggcactatggtgggtccccatctcttaagaaagaaagaataggaaaaactaaattagtataagaactaattacttaatttgtataagttatgaatatgccaaatgcaatttagatgctttttcaaaagagcac

SEQ ID NO: 172375 - DNA, 200 bp, Homo sapiens
aaaaaaaatgcttacaatgaaaactaagtgaataagtaggatacaaaattgtatatgcactgtttttaattatgttaaaagtacatagaagactatataaaaatatactaaactgttatacagtgagactaggggtggttttaatttttattcttgatatgctgtattttcttattctacaatgagcatgttttataaac

SEQ ID NO: 172376 - DNA, 330 bp, Homo sapiens
acagatgctctcacagcagagcaacctcggggcatttagtgtgaggcaaatgctcagtccctcacttacaggtggaataaagagtgtcatcattttgtggtaagttgaagaatggtccccaaaagatgtccacgtctaaatttccagaatttctgaatatgttaccttacatggaaaaaatactttgaagatgtgattaaagattttgagatgaggataatattttggattagcttggtgggcccaaagaaatcacaggggtcttcaccaagagggaggcagaagagttagagaaggagaagtgaggatgaaaaagagagatttgaagat

SEQ ID NO: 172377 - DNA, 463 bp, Homo sapiens
ggctcttctggctctgggtctctgtctccctctctctgtcgtctctgtgtcttcctttgtctctgggtctctgtctccctctgacctgggtcttgtctcttggaccccatctctccctccctgtctctgtccatctcccttatctgtctctgtctatactggcgccactatttcatcttctgtctctctccctgctctctctccctgtctctgctattcttgcgctttctcttttgtcctcttacaacttggcttctccccatctctgaatctgtctctctctttcctgtgtgtctctccctgtctgcttatctctcctttctctatctctgccccttgtttatctctctccctcctctttctcatttgtgtctgtctgcctcttcatctctgcctgtctctctttctccctctctctccctcccccatctcccctctcttctccgtccccatcccctacgcc

SEQ ID NO: 172378 - DNA, 428 bp, Homo sapiens
atgaaaaacccgagggagcaggtgatgtggttcccgggggctgagcaatggctccaagcatccaaggccccttgcctttctggagctgggtgagaagatcccagaaggagagcagtggcaactctttgccttctcctcctgacctggttctgatgctttttcttttttttttttttctgagacggagtctcgctctgtcacccaggctggagtgcagtggcacaatctcggttcactgcaacctccgcctcctgggttcaagtgattctcgtgcctcagcctcccgagtacctgggactacaggtgtgtaccaccacacccaactaacttttgtatttttagtagagatgaggtttcaccatgttggccaggctggtctcaaactcctggcctcaagtgatctacctgcctcggcctcccaaagtgct

SEQ ID NO: 172379 - DNA, 707 bp, Homo sapiens
cttgtttgctgctaagtgtttcctgccacctggcttcttattcaaccttttagatttcatgttaggcaaacaagcaacagtgttcattgaggaagtactcactagattataagtactagctagtgtggctgaactatctgttgtcacaggaggtgctgcagttgttgttaatgaaacacagttagctgtagtggtttgactatttgcagcagtttgagaattggcaggctggctaatagacaattgtacacagctttgcccagccatctgtgatatgctttgattgaggctggccaaagcaccaaatgtattcagggcaacattggtatttggatcttcgctggtggtgggttgaataatttgcataggggtttgatttgtagttcctgatgaagacatcacaggctgcaaagcaaagagctgtccatttaaagaaatggtttgaggctgttggtttgacatggtaacagaaaaagtttgtgttgagttagacgctgataaagatgaaggtcttggtaatatgtggacaagatgctttcctccaaaagtctgtggtgttggaacattttgcactgaattattagaccctattacagtattggctccattgatggggagtcgaacagaaccaggaggtggagcagggaggagtggcaaaggattctgattagcagcctgtatgattactatctgttgacctactgttt

SEQ ID NO: 172380 - DNA, 594 bp, Homo sapiens
ggtgaaaccccaactctactaaaaatacaaaaattagccaggtgtgctggtgggtgcctgtaatcccagctactcatgtggctgaggtgggagaatctcttgaacctgggaggcaaagattgtactgagccgagactgcaccattgcattccagtatggggaacaagagcgaaactccatctccaaaaaaaaagaaaaaagaaagaaaagaaaaagaagaaagaaaatcgctttgggagaaaaggttttatgcaaatggccaatcatgattaattgatggggaggctctcaggcaaaggatcggatttcacagataagtgtgtgtgtgtgtgtgtgtgtgtgtgtatatacatatatacatataacttggctctcctgagaagaaaatgttcattcagtgtaaggcaagatagtgtaaggcaagtatatccaaatcaggggtgtccaatcttttggtttccctgggccacattggaagaagaattgtcttgggccacacataaaatttaataacactaatgatagctgatgagttaaaaaaaaaaatcgtaaaccaaatctcatgttttaagaaagtttacgaatttgtgttgg

SEQ ID NO: 172381 - DNA, 132 bp, Homo sapiens
aggtaggaaagaaggaaggaaggggagagaaatgaaagaaagaaaaataaaggaagaaaattcagaaggtacaaaaaggtttatgtaaacttccatccctcctctgccccactcatacagttcctcttcggg

SEQ ID NO: 172382 - DNA, 100 bp, Homo sapiens
tgctgccataacaaaatgccattgactgggcaatttataaataacattaatttatttctcacagtactagagactgggactttcaagtgaccagcaagtt

SEQ ID NO: 172383 - DNA, 255 bp, Homo sapiens
cctgaggactaatgagattatacatcttttcatgtgcttactattcattcacatgtgttcttttgtgaagtgtccattcaagttttttgtccattttcttctgggttattattgatttatggttcttcatatagtctggatacaaatccatggttatagatacgtactataaatacttcagtatttatttcccaagaacaatcatattctcttatataaccaatactattattgcattcaggaaatttaatattt

SEQ ID NO: 172384 - DNA, 448 bp, Homo sapiens
tcccgcccccttttccccaagctggggacctcagagaatccattctcctcctgccctgcagagagtcacggagcacgtcctggctttctccgtactgggttccagaaatacctggaaccctgcatgacagaggccgagctcagcacactttctggttctggaagggggtgtcagacagatgaggaaatgtgcaggagtcttggctgcctctctgtcccctgtgagaaattccaggctcgtcagtgagcacccccaggcccttcaggtggcgttggaggttttagaagaaaaaggcgaggttcctctcggtgtccttgaagatgtcgttgctttgctcatgttatcaaacaagggctgggatggtcaccatttgcagttagctgtaggggacgtgatgtccttttttttgtatttactggttccttcttgagacctcggtaggctccaa

SEQ ID NO: 172385 - DNA, 251 bp, Homo sapiens
ggcctagatcgctgtgaggtctatggaagtttccacaagcttgctgggtagttctcgaggcaaactcggaaagggagtcccttgtctccctggaacggatctttcttggcatctctgtcacactcattaggtgggcctggtgtcaaccccatttgcaggccaccccaaacttgatcaaaggtccgcttctggcaccccataccctgtcctacaggaaatacagggacaggctcccaataacaacacccagc

SEQ ID NO: 172386 - DNA, 355 bp, Homo sapiens
tcgaagcccaacactgcgctgctaatggaaagacagagaacagcatccatatacatttccctagaatatcactcaggaaaatatatataatataaagaaagcaaggatttggctgataattctctagcagaacaggccaaatacctctcataaaattaaaaatacttgcaaaaaagatccaattataaagccacaaaaaaaccctaattttcttcttgagtacagcatgatttttaaattgggaatttcccaaatacagtgccaaaaaatggagtccctcaaataccttaaaattcggttgttgttactgctccttttcctaaagccagataaaccaaataagttaggatttaca

SEQ ID NO: 172387 - DNA, 467 bp, Homo sapiens
cccccacagccctgctgggggaagaggaggagaccagcccgtagccagcccagcctcagccccagcagcctgtggctggcagggcctctgcctacacagcaagctctcagagtggggggatgggagcagcgcccaggcacccacccagctcccccaacccagagtgtcaccggggacctttaccctgaatggggatggttttaacagcccctagagagggtcagggcatctgtgacaggacagggtctgagccccggactttcacctctcagcccagtgcccttttccccgcagcagcctaagctcccagtgattctctgggggagggatttctgatggggctggttctaaagaaaagctctccagggcagggcctgtgaaacccaaggactgactgctgcgggggctggatagcctttggggacagaggaggggagagggtggcagaacctaaacagctgcggccg

SEQ ID NO: 172388 - DNA, 582 bp, Homo sapiens
agtccatctttgcttaaactaagccatagcagccttcagttgtttgcaacactgactgacagcataggttactatgtatcatttgtgggctcagtcttagtaccatatagtgttccttcatctgccaagggcattctgctattggtgaacaggcaaaaagagggagagttaccgttaacattctaagaatcttacctaacctgacacctatggacagtgctggagcctctcagaaacctagtcacaggtgcccacgcaagcttcatcttgccagaaatcacaggaaagcaaaattgagatgtacctttaaatatatcctgtttcatacaaaggcatgttttgctttgcaaaaaggatctctaagatttgctttaagatggtgctctcatttttgcatgtctattaaaattttaaatgggtctaccacaaactgcagcgtatgtgtacaaggatgcacgaagacagatgttggtaaactaccatcttaatgtcaataaaaatataaacaatataaacatctagtaaaggagaagcaaataaataactataaaatagccacaatgtgaaaatactgtccaacag

SEQ ID NO: 172389 - DNA, 332 bp, Homo sapiens
gtgcaggagggccctgggccagtggggaagcaaatgagagctgatgagaggccttgaagcctggaggctgggccgaggctcaaaggcctgggggaggagatgggccatgccatccactggtaggttttagggttggttcttgaaataaagagagacacttatttaaagcagcttctctagtcctaggcctgtcaagctaggcagagaggagtgaggagaagctctcccagtccattcaagctttatcctagcacagatttggttcattgtcttccctctgaaattgaggtggaatgttgtcttgggattctgagtcagtcttcctcatccag

SEQ ID NO: 172390 - DNA, 258 bp, Homo sapiens
aatcgtgagatttctgtaatacagaatgcgttccattgttattattaataatagtctctactataaatcacatcaatcactgtgtgagcattttgcacatgtaatctcaaattctcatagagaaatactgttggctacacagactcagtaatttcaatcatgatactattgttttaaacccatcaatatgctaatccattctgccaggtgcaagagaaaccaaagagtaataaagtaatttcagagccttctgacctc

SEQ ID NO: 172391 - DNA, 377 bp, Homo sapiens
ccaactgtgtgactttgtggaagtgacttaacctctgtgcttcagcttcctcatctatacaacagaggtaataatagtgcctgtcttgtaagttgtttaaccatgagagtcaaatgaatttatgtatatgcagcgttttagaactctgccggacacataagtgcataaaaatgttagctattattatggatcttatctgatatcatcctaattggctttgtaagaggcagagaaaagtctgactaaatctatcgtggaccaataattcatggaaaggtgctacagtcacttttttttttttttaaccagccagtgtagatttttatcaagcaagaggattgtcaattatctgccagaaataaagaaagaaagcctta

SEQ ID NO: 172392 - DNA, 350 bp, Homo sapiens
acggtcccctggctgacctctctcccacgaggcactgaggccctgctctgctggtgtctccatgtccatgtcctggggatcgagagcagccctgcgcgccttctgctcaggggagggtgggccgggggttccagcaggcaagggggtcgccaggaccacagcccccaggtctgggccttctctctgcccccggcctccttcccagccttgtgcccggtgccctgcgcctcccctgcccgctcccctagcccttcccctgcagcaaggggtgcatctcctccccgtgcggggagccctgcgcagccacataattatgcatgtaagatataaacagagctgtttaattatcc

SEQ ID NO: 172393 - DNA, 109 bp, Homo sapiens
cccctatggctgcttgggctgtgagagtccgtctgctttgaaggggctacagatggcattctcgactctagcagccttcggagcaacatgctcctttggaaaagagaaa

SEQ ID NO: 172394 - DNA, 480 bp, Homo sapiens
tctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccg

SEQ ID NO: 172395 - DNA, 407 bp, Homo sapiens
cacactcacacaccagcaggctcatctttgtacaaactcacacttaatctccaaaggcagaatatattacgttggaaatacccaatttggacttacaccaatttcatgataaatagcatctttccatttcccatcaacagtggccatcagaaaagtaatgcatttcatagaaacaatattttaagttgaccttgtgtttagtgtccatttttgtgtcttaaccccagatcaagattcccatgagtaaatctattcacctagaacgaagagccacggactctcattcacatgtccatccatccccttcccttgcatacctgcccacgcatacccacaccgaatgctctatacctctgctacaagccttgtgccagctgaggacaggcatgtcataaacacctcctggt

SEQ ID NO: 172396 - DNA, 445 bp, Homo sapiens
cctccctgtccccaaagcagcgatgcatctgaaatggcctaaaaaggcgtggaaacccaggggttcctgttctggcagaagttcctcagttgcccacagggcctgaggtctggggtgaggaacacctggtccagatcaaagagcttttagggtgtggggctggatttttgcatacaggttacatcaggagtccaggagtaaaattaattcttagaaggccagattacataaaaggcaaggcagagagggttctgcaaacactaaccgcctcttgggtgtctgatggtactcctctcatggcctcagcctggagggagctgatgtgggaggaatctgtgggccctgacctggaatgctgcacagtggcctctgccagtgacaggggcgggcaaggctgagtctagaagcaaatgccagcccacaaatgtgcagtgattggcgccta

SEQ ID NO: 172397 - DNA, 709 bp, Homo sapiens
ttgagcccatgagttcaagaccagcctggacaacatagcaaaaccccatctctacaaaaaatagatattagtgggcatggtgacacatgcctgtagtcccagctactcaggaggctgaggcaggaggatcactcgagcccaggaggtcgaggcaacagtgagctataactatgccactgcacatcagcctggacaacagagcaagaccctatctcttaaaaaaatccctggaaaggtggcaggcaggaagtttagagtgagcagactcacagcagcatgggctgtgcttgctctgaggagcgcttgctgttggtttcagcgtgaggccctctacctcccagggagggtgacttggggtactcaaactcccacccaattcctggccctggcaggagtatcgtgacaatgagcatctcagtcaacctgtgccacagtttccttatcctaaaatgcaggtgatcccgctgccttgcacagggctgtgacgaagagactatcattcattcattcattcattcattcagttcctccacaaatgtttattgagcacctactacatgccagagaacgaaacggcccaggggaaagcggaagggagaacaaaacccgcgcaccgggcatggccccgaaggacgagcagagtaggaaggtactagaggaagccagagggggaagggggccacgccagtccgcgggccgaaccccgccg

SEQ ID NO: 172398 - DNA, 673 bp, Homo sapiens
ttgagcccatgagttcaagaccagcctggacaacatagcaaaaccccatctctacaaaaaatagatattagtgggcatggtgacacatgcctgtagtcccagctactcaggaggctgaggcaggaggatcactcgagcccaggaggtcgaggcaacagtgagctataactatgccactgcacatcagcctggacaacagagcaagaccctatctcttaaaaaaatccctggaaaggtggcaggcaggaagtttagagtgagcagactcacagcagcatgggctgtgcttgctctgaggagcgcttgctgttggtttcagcgtgaggccctctacctcccagggagggtgacttggggtactcaaactcccacccaattcctggccctggcaggagtatcgtgacaatgagcatctcagtcaacctgtgccacagtttccttatcctaaaatgcaggtgatcccgctgccttgcacagggctgtgacgaagagactatcattcattcattcattcattcattcagttcctccacaaatgtttattgagcacctactacatgccagacaccctactgggtcacagggagacagcaggaagtggaagaaacaaaaatccctgtccagctggagcatttgttctcaggaaggagacagatgacaagatgcataagga

SEQ ID NO: 172399 - DNA, 438 bp, Homo sapiens
agcccagggcaatctaagaagacatgatcactaaatgtgatgtgggatcccagatgggatcctggaccaggtaaaaactaaagtaatgtttcaacttcagtaaataataatgtatcaatattggtccattaattgtggcaaatgtgccacactaatgcaaagcgttagtaacagggaaaactgggagcagggtatatgagaactttttgaactgttttcacaattctcctgtaaatctaaaactcttctgaaaatagagtttattctttaaaagtgtctggaggatgtgcacaagggtgtggcagcagaggggctacaggtaaaaaatcatgacatctggaatatttccttcaatttttgctccacacggtgactatcttaccctgctcccattaaactctgaacaatgttatcagcctgaaaaatggattggcagga

SEQ ID NO: 172400 - DNA, 618 bp, Homo sapiens
  misc_feature (1)..(1): n is a, c, g, or t
naatcgagctcgtgtaccccgcgggttatgtcttacgagtattgaacataagtagtcttttgcaactctcatcagcccagtttaatattacctatttattataatgtaatgctgctcgcacaactgagaaaatactgttgctttaccccctccagctctgtagcagccacgcagaaatcatagaactgtaaacatatgctaattacacaacctatgtaggcaatcaatattaagaaaaatttttactgcccggtatttctgtggttgaaaatgtagagtctaattttgatccgcagtaacatctaggttaatgttgattcagaaggaaaacgtgttgttgttgccatgagaagaggcattgaaatgctgaatcaccaccacaaatgttaccactattaatataaggagatacataggaagatggaattagaccatctcggaccaccaggtttacaattccacctgcagatacatgcaagaagtattgtcacaatacttatgtcacgttattccgttgaggtcatcaccaactaagcttataattaatgtgtggtcaatttggtcaatgtcaccagcgtagcatactaacaaaaacaagggttgcaaagtcaaatgcct

SEQ ID NO: 172401 - DNA, 4143 bp, Homo sapiens
cgggccaggtttccaggctcggccgccgcctccatcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172402 - DNA, 4191 bp, Homo sapiens
cgggccaggtttccaggctcggccgccgcctccatcccagcacctgcggagggagcgctgaccatggctccctggcctgaattgggagatgcccagcccaaccccgataagtacctcgaaggggccgcaggtcagcagcccactgcccctgataaaagcaaagagaccaacaaaacagataacactgaggcacctgtaaccaagattgaacttctgccgtcctactccacggctacactgatagatgagcccactgaggtggatgacccctggaacctacccactcttcaggactcggggatcaagtggtcagagagagacaccaaagggaagattctctgtttcttccaagggattgggagattgattttacttctcggatttctctactttttcgtgtgctccctggatattcttagtagcgccttccagctggttggaggaaaaatggcaggacagttcttcagcaacagctctattatgtccaaccctttgttggggctggtgatcggggtgctggtgaccgtcttggtgcagagctccagcacctcaacgtccatcgttgtcagcatggtgtcctcttcattgctcactgttcgggctgccatccccattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccaccacttcctcgtgcttcatctctctcccgtgctggatgcctcctgacctcaacatcagactccaagttcctcagcttttagactcttggacttacaccagtggtttgccagggcgtcttgggccttcgcacacagattcaaggctgcactgtcaactttccaacttttgtggttg

SEQ ID NO: 172403 - DNA, 3603 bp, Homo sapiens
caccccccccctccccccaccaacctctctgccagacttaggtacagctgagtttaagtcgcacgcggattatcatgggggtaacattggaactggtaatcaccaatagtagttgttgctgctcatgcaggatggaagatcgtcgtgcgttcatgaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172404 - DNA, 2175 bp, Homo sapiens
catagggtggcgcttagggtggctcatcgcggtggcgctttgagtggcgctttggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172405 - DNA, 2105 bp, Homo sapiens
acagcacagaggaggtggacagcacaggaggtggatgcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172406 - DNA, 1882 bp, Homo sapiens
  misc_feature (29)..(29): n is a, c, g, or t
acttcgtctgcgtctctgagttccccgcnggtgtgtgggtggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172407 - DNA, 1803 bp, Homo sapiens
taggctaggtacgaggctgggggttgaatcggccgaggaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172408 - DNA, 561 bp, Homo sapiens
  misc_feature (6)..(6): n is a, c, g, or t
  misc_feature (10)..(10): n is a, c, g, or t
tcacantgancatctgcccactctctgtctcttaggaagacaagagcagcaggtgagcacatgtatccagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172409 - DNA, 1282 bp, Homo sapiens
ggtgagggcgagcagagctggtgagtcggcaacgcaggaattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccaggtcaggacttggggcacggggacaggggccctgggagtgggaccacccatggtcttgcaaactggtctctaacaagagccaggcttttctctgtactatccaaaatatggaactaatatgtggaggggaagccacgggtaaagttttcaggaccttgatatgagaacaatcaaaactatcagttctgagagaagcagtaagaccctcataactggtggttgtttcagcaaaagtggggtggccccttgatatagatgtggaaaaggtacttaggaagcacagacaccacctcccatctcctcactgcctcctatggggaactttacaattagga

SEQ ID NO: 172410 - DNA, 446 bp, Homo sapiens
aagtgctgggattacaggcgtgagccacggtgcccgttgcaccctgcttttgactgaaggagagagtcaagacaaaaacaagtttacgagattaaaggtggtacatgcagctaactcaacactgtacgaggtagtttgctttagcgactgggtgagtgtttgaaggggaaccacagaggaaatatggtgcttaatatgccacacttagggggcataagtgtgaaatctttcccttccttttactgccgcctccggccgaaacccccacccagttgatgctttgcaaccaatggttcttcctcttatagcatctcggtgtgcctcctttccatgactgctgctttaagctgttttctcatccacagaccatggctccctggcctgaattgggagatgcccagcccaaccccgataagtacctcgaaggggccgcaggtcagcagccc

SEQ ID NO: 172411 - DNA, 3570 bp, Homo sapiens
ggtgagggcgagcagagctggtgagtcggcaacgcaggaattatcatgggggccaacattggaacgtcaatcaccaacactattgttgcgctcatgcaggtgggagatcggagtgagttcagaagagcttttgcaggagccactgtccatgacttcttcaactggctgtccgtgttggtgctcttgcccgtggaggtggccacccattacctcgagatcataacccagcttatagtggagagcttccacttcaagaatggagaagatgccccagatcttctgaaagtcatcactaagcccttcacaaagctcattgtccagctggataaaaaagttatcagccaaattgcaatgaacgatgaaaaagcgaaaaacaagagtcttgtcaagatttggtgcaaaacttttaccaacaagacccagattaacgtcactgttccctcgactgctaactgcacctccccttccctctgttggacggatggcatccaaaactggaccatgaagaatgtgacctacaaggagaacatcgccaaatgccagcatatctttgtgaatttccacctcccggatcttgctgtgggcaccatcttgctcatactctccctgctggtcctctgtggttgcctgatcatgattgtcaagatcctgggctctgtgctcaaggggcaggtcgccactgtcatcaagaagaccatcaacactgatttcccctttccctttgcatggttgactggctacctggccatcctcgtcggggcaggcatgaccttcatcgtacagagcagctctgtgttcacgtcggccttgacccccctgattggaatcggcgtgataaccattgagagggcttatccactcacgctgggctccaacatcggcaccaccaccaccgccatcctggccgccttagccagccctggcaatgcattgaggagttcactccagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172412 - DNA, 2819 bp, Homo sapiens
cctggccctcccagacacatagtaggtcctcatggaatccaggtaccctctgggctgagccataaggacaaagaaggcctggaaggcccgagactgtgctgcctgtgatgcctgctagcttacctccccctcctcctccctactgccacccgcattgggcaacaggcccctcacctgtccaacctcttgtgttgcagatcgccctgtgccactttttcttcaacatctccggcatcttgctgtggtacccgatcccgttcactcgcctgcccatccgcatggccaaggggctgggcaacatctctgccaagtatcgctggttcgccgtcttctacctgatcatcttcttcttcctgatcccgctgacggtgtttggcctctcgctggccggctggcgggtgctggttggtgtcggggttcccgtcgtcttcatcatcatcctggtactgtgcctccgactcctgcagtctcgctgcccacgcgtcctgccgaagaaactccagaactggaacttcctgccgctgtggatgcgctcgctgaagccctgggatgccgtcgtctccaagttcaccggctgcttccagatgcgctgctgctgctgctgccgcgtgtgctgccgcgcgtgctgcttgctgtgtggctgccccaagtgctgccgctgcagcaagtgctgcgaggacttggaggaggcgcaggaggggcaggatgtccctgtcaaggctcctgagacctttgataacataaccattagcagagaggctcagggtgaggtccctgcctcggactcaaagaccgaatgcacggccttgtaggggacgccccagattgtcagggatggggggatggtccttgagttttgcatgctctcctccctcccacttctgcaccctttcaccacctcgaggagatttgctccccattagcgaatgaaattgatgcagtcctacctaactcgattccctttggcttggtgggtaggcctgcagggcacttttattccaacccctggtcactcagtaatcttttactccaggaaggcacaggatggtacctaaagagaattagagaatgaacctggcgggacggatgtctaatcctgcacctagctgggttggtcagtagaacctattttcagactcaaaaaccatcttcagaaagaaaaggcccagggaaggaatgtatgagaggctctcccagatgaggaagtgtactctctatgactatcaagctcaggcctctccctttttttaaaccaaagtctggcaaccaagagcagcagctccatggcctccttgccccagatcagcctgggtcaggggacatagtgtcattgtttggaaactgcagaccacaaggtgtgggtctatcccacttcctagtgctccccacattccccatcagggcttcctcacgtggacaggtgtgctagtccaggcagttcacttgcagtttccttgtcctcatgcttcggggatgggagccacgcctgaactagagttcaggctggatacatgtgctcacctgctgctcttgtcttcctaagagacagagagtggggcagatggaggagaagaaagtgaggaatgagtagcatagcattctgccaaaagggccccagattcttaatttagcaaactaagaagcccaattaaaaagcattgtggctaaagtctaacgctcctctcttggtcagataacaaaagccctccctgttggatcttttgaaataaaacgtgcaagttatccaggctcgtagcctgcatgctgccaccttgaatcccagggagtatctgcacctggaatagctctccacccctctctgcctccttactttctgtgcaagatgacttcctgggttaacttccttctttccatccacccacccactggaatctctttccaaacatttttccattttcccacagatgggctttgattagctgtcctctctccatgcctgcaaagctccagatttttggggaaagctgtacccaactggactgcccagtgaactgggatcattgagtacagtcgagcacacgtgtgtgcatgggtcaaaggggtgtgttccttctcatcctagatgccttctctgtgccttccacagcctcctgcctgattacaccactgcccccgccccaccctcagccatcccaattcttcctggccagtgcgctccagccttatctaggaaaggaggagtgggtgtagccgtgcagcaagattggggcctcccccatcccagcttctccaccatcccagcaagtcaggatatcagacagtcctcccctgaccctcccccttgtagatatcaattcccaaacagagccaaatactctatatctatagtcacagccctgtacagcatttttcataagttatatagtaaatggtctgcatgatttgtgcttctagtgctctcatttggaaatgaggcaggcttcttctatgaaatgtaaagaaagaaaccactttgtatattttgtaataccacctctgtggccatgcctgccccgcccactctgtatatatgtaagttaaacccgggcaggggctgtggccgtctttgtactctggtgatttttaaaaattgaatctttgtacttgcattgattgtataataattttgagaccaggtctcgctgtgttgctcaggctggtctcaaactcctgagatcaagcaatccgcccacctcagcctcccaaagtgctgagatcacaggcgtgagccaccaccaggcctgattgtaattttttttttttttttttactggttatgggaagggagaaataaaatcatcaaacccaaaaaaaaaaaa

SEQ ID NO: 172413 - DNA, 440 bp, Homo sapiens
ttaaattaaacatttaaacttatgatttcagattctatgatttgtatcgattggttcacatattagtgtcagaaagtaaagccaaagattgcatggcaaaggcaaattggagaaattctctaaaagtatttcataaattttcggaagaagattgtgcagatgttcgcaatactgccaaaggtttactagacactatccccatagtttttcaaagagtaggtcagtagaacaaaatacaacaatgctgacaaaatattgaaaaggctgcaatgacaaactataaaggatttgagaaaaatcttaagcaatattcaagcatatcagaagaaagttatgctaactaccaaaatgatactctccttaatttgaatgttttaagttggagatttgatgagtaactggcagtcataataaagaggcaatgccccagttaggctacc

SEQ ID NO: 172414 - DNA, 175 bp, Homo sapiens
tgagaagatgctaaggacacagcgcagagtggaagccgaggcccaggttgggggtcaggagctgggctgggccccggagggcgctggcatgcacagcctctggacgtcagcccgacaccgcctccggggcttgctcattccccggccttgctgcttgccccctgctacacctggg

SEQ ID NO: 172415 - DNA, 397 bp, Homo sapiens
atttaaatgtaggttctgcattcttcccagtgaattctatttttcttaattggcttatccaattcattatctgtagaaacttcctaaaactggctgtcagtgttatagttccactacctgacttcataacaactactaagctacagtacaaagactgccatttatgttctaacatttttagattttccaaattctgaactggtgttttgcaggaatgctccactttgtccaataaggaatcttgttttgtgaggagtagatgagttaatatatgtagagtatgtaagacagtgcctgatgtgtagtgggcactcaatacatgttagctattatcatttattgaatatctgctatatttgacagactatatgaagtattttacatgcaaatttctcat

SEQ ID NO: 172416 - DNA, 1085 bp, Homo sapiens
cttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagagagagatgtttcgtcctcagcttttgcttccattttttttttaagaactctgggctaataacttctaatctttatagaatatttcaaagaaatatatttgttcttaaagatacataggtttgagatattgagtgctacaagcatttattttggttttaccttaacatattatgattcctcagttttgttggcatttagtaattatgtttatgtttttatcttatcaaaaaatgtcttcttacctttgatatttataatcactcctcggtcatgtaaatagtttgctttatattttactgttttaaagtctgtgaccttacctgccctcttctgtagcaaagtgcagcatttaactcaggaagctatattccccccaagtgtcattaatatttgcataagattaaaaacactccagtcggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcacctgtggtcccagctacttgggaggctgaggcaggagaatggcgtgaacccgggaggcagagcttgcagtgagccaagatcgtgccactacactccagcctgggtgacagagcaagactccgtctcaagaaaaaaaaa

SEQ ID NO: 172417 - DNA, 509 bp, Homo sapiens
ctgggaggccaaggtggcggtgagccaagatcacgccattgcactccagcctgggcaacaagagtgaaactccatctcaaaaaaataaaaataaaaataaaaataaagagattattccagcatcggcaacatggcaaactttgcctatacaaaaaattacctcgtcactgtgatgtgtgcctgtagtcccagctactcaggaggctgaggtagaaggatctgttgagcctaagagttcgaggctgcagtgagctatgattgcaccgctacactccagcctgggcaacagaatgagaccctgtttgaaaaaaaaaaaaaaagagtcaggtgcggtagctcacgtctctaatcccagcactctgggaggccgaggcgggtggatcacaaggtcaggagatcgagaccatcctggctaacatggtgaatccccgcctctactaaaaatataaaaaattagccgagcgtggtggcgggtgcctgtagtcccagctactcgggaggctgaggca

SEQ ID NO: 172418 - DNA, 402 bp, Homo sapiens
atttatgggaatggcaccgcaaagttcgaaggtcatgagtccattgtcatgcagtgaacattgaaggggtaaatcttggatttgcctcctactccgttacccacccttataacataaccgttgcattgttgggcagattacagtatgaaagtcaggtgatctcatctcttccagcttctggggtcaccctttcccctaatacttaaaatggcttgagccatgtactataagttcagtaccttttcttctctccaatattctgataataatggggcttacctttcctggtcatctttctttgaatttctgctgctacctcagtgtttcacctctggccactgctgtctcctcttcgctctgcactgcccgcttctctaatctcccagacatcccccgagccat

SEQ ID NO: 172419 - DNA, 718 bp, Homo sapiens
tgatttcggaatcatctaacaattgaatccctgctgttgttatttcatctattaatgtcctagatgtctcagataacattgccaggtgtcttgagagcattcgtctcttggatggtgtattagtccgttctcatactactataaagaagtacctgagactgcgtaatttttaaaggaaagaggtttaattggctcacagttccacattgctagggaggcctcaggaaacttacaaccacggtggaaggggaagcaggcatggaccttcttcacatggtggcagatggcggcaggagacagaagagtgaatgaacaaagggggaagaaccctttataaaacaatcagatctcgtgagaactcactcactattatgagaacagcttgggggaaactgcccccatgattcagttacctccacgtggtctctcccttgacatgtggggattacaattcaacatgagactttgcgtggggatgcagaaaaaccatatcggatggaaagtattgtcattgaactaatttgcccctcttggcacctttattttcttagactcctaatagatcggcacatcagaccatagaacatataagtgcagaactatctgattcctaaggtaaaaactgcttagattctcaccctgagacccttcaagaagtctgggtggtagccttccaaatatgcatttaacttcaaagaatacgatttagctattacaa

SEQ ID NO: 172420 - DNA, 396 bp, Homo sapiens
ttaccatacctaagtaaacagcagggtcacttagatagtggaggtctaagggagctcaaatctaaggaagaacaggggccaaatgaacaggaggaacatgctgccttgctgtgagcccacagcagcctgttaaattctgcacagaggttagctccttcccctacctcttgggggtctggggatttgagggagtagaacctttggctttagcagaggctggtggttgaggctgcagaaaaagtattagataccctcttggcacttccaggctgagagaccatggagcatttagtattatgggccaccagactttgtttcagctattttgtagatgacgtttcatcttaatgcttgcatcaacccagtgcggtagatatatcttcatttttaaaaaga

SEQ ID NO: 172421 - DNA, 545 bp, Homo sapiens
agggaatgatgtagatggaagaaggactggtatgctcctgaaacagtaagggctcaatactgatggatgatccagatgagtaaagggagagtagttagatggtagggcagagaggtgaggggaacaagatcatttagagcctgttggacaattcaaagactctggtggttttcaaccttagttaaattaagagccactggaaggtttgaatgatatgaggtaatttactttttaaaaatataactctgcactggggaaagaaaactctattcaataaatggtgctggggtaattgaatagccatatgcagaagaaaggaactgtacctctgtctcttactgtatacaaaaatgaattcaagatggattaaagacttaaatagaagacctgaaattaaaaaaaaaatcctagaagaaaacctaggaaaggttcttctggacttggtgtaggcaaataatttatgactaagttctaagaaaaaaaaaacacaccaaaacaaaaatagataaatgggacttaattaaactaaaaagcttctgcacagc

SEQ ID NO: 172422 - DNA, 221 bp, Homo sapiens
tgtctgcattttggggaaagacctgccctcaaagcaaaggctttcaggctacaggctggcttcaatgctagggtgagcggtgaatagtgtgcatagtgaatacttgctttctggtacaacctcataaccggggcacggtctcagtgaataacagaggacaccctgcacctaagttactttttttttttttttttttttgagatagagtctcgctctgtagt

SEQ ID NO: 172423 - DNA, 632 bp, Homo sapiens
atttccaggtagatagtgttggaattgaactggaggacacccaactggtgtctgttgcagaactgattgtttgcttgctggtggggagaaatccctacacatttggtcatataagtgttctgtgtcgattgctgtggtgtgagagcagaagaaaaacagtttgcttttaacataatgtcccagacctttctattaggcagggccatgtgccttgtttcagcctataaaatataagtggtagcgaaacgatcacttctgggttgagccatgtaagactcccccattaccacatccacattctctttttcctagacaacacatactgagacagtggcttcataaaatggaggcagtctggatcctgagtcacatgatgaaagagccaccaatgatccatgttagtcttggcatgagggagaaagaaacttgctgtgctatgcaaatgagatttagaagttcgtttctgcagcataacttagactagtctgataaatatacagaggtacttcatttttctgcctacacactaccaagtgacaacaggggtaaaataagtgggagaaaatacatacaagtgggcagaaggaagagttagagaatgctggaaatctctgaaaaatgaggaagaaaag

SEQ ID NO: 172424 - DNA, 366 bp, Homo sapiens
cctctgttgcccaggctggagtatagtggcgtgatctcggctcactgcaacctccgccttctaatttctatatttttggtagagatgtcccggctaatttttatatttttggtagagatggggtttcaccatgttggccaggctggcctccacctcctggcctcaagcgatccacccaccttggcctctcaaagtgctgggattacaggcatgagccactgggccggtcagtgcccttttctctgaagtccttaaacctgggcatgacttccaggggctgagttcttctctttattcaccctaccctaaaatatcatccagtctcagggctcccatccattcactgctgaccatcccaaacttccc

SEQ ID NO: 172425 - DNA, 895 bp, Homo sapiens
cttgaaagaaacagcagccaaactgctatgattcaaaccacccaagtggagaagaagttaagaggcaattttcatctaaagatacagcatgtgaaatgagacaggctctttggaacaggcaggattccaacagaagatgagagaaaagccttcccatcagagacaccagcaagaggcaagaatgtgtagagcttattccaggcacagatggacaaaagtcaaggatgcaagtaaggaaggaggaggatgtaaaaagccagtaggaaggataggaccaaaccgcaaaggataagaccaaactgcaaaggatcttcatgttctttgtaactcactctagaactgtgagccactcaacactttgaggcaaaggatgtgaccctgggttaagctttatctaacagtagtatatagctttgaaaccaaaaagccttgacacttgcttcctgtcaacaagggataaaaaatcaatactgacttttccacttggagctgggaagaccaagcttccctggcccttccagcattgcattcactctcaacagccaattaaaaggctaaggtctataccttctctgccctctttatcataatggatctaatagtgaaagtagctgggtgaagagcatgatcccatccacctgcgctttcacatccagcaggcactttaaaagtaaaacaatcctataatcatttatatcctttgggaaacaaccaaagtatttgttgtgaatctaaatatagtcatgggaaaataagagtccgatggcagaggaaccactgcggagagcacagcccagagaggatgttgccttgagtctgaggcccttgctgactggtgtaccagcgagccttccactattccagtcaacccacaccgtggcccagcagcatggga

SEQ ID NO: 172426 - DNA, 548 bp, Homo sapiens
gagtcggtaccgggtcagtacggatgtgaccctgggttaagctttatctaacagtagtatatagctttgaaaccaaaaagccttgacacttgcttcctgtcaacaagggataaaaaatcaatactgacttttccacttggagctgggaagaccaagcttccctggcccttccagcattgcattcactctcaacagccaattaaaaggctaaggtctataccttctctgccctctttatcataatggatctaatagtgaaagtagctgggtgaagagcatgatcccatccacctgcgctttcacatccagcaggcactttaaaagtaaaacaatcctataatcatttatatcctttgggaaacaaccaaagtatttgttgtgaatctaaatatagtcatgggaaaataagagtccgatggcagaggaaccactgcggagagcacagcccagagaggatgttgccttgagtctgaggcccttgctgactggtgtaccagcgagccttccactattccagtcaacccacaccgtggcccagcagcatggga

SEQ ID NO: 172427 - DNA, 396 bp, Homo sapiens
agggtgtggggcaagagttttcaaggaagaggagcagcctgtgcgaaggcctggagacagaccggagcttgggggactcaagacagttttcggcacggtggaaatgcggagtgggcggcagggccctatgggagacaaggctttctttagttgtgggcagagctgggagtgagtgcacggtgacagaagcacagacaaaacaccagcaagtggacagaagtcaccggagtgccaggtttgcctcactttgaaaaaccctacacacaggcacagattatctctgagaggggacaggagtaggtgcttccataatgaagagaccacaaggatttcaaagcaagaaagtctctcttttcttgggacccttccaaaaggacccctcttggaatattgtta

SEQ ID NO: 172428 - DNA, 297 bp, Homo sapiens
attagggcaaaaacaaataattgttctttgaaaatcacttggtcaataatttgtaggtgtgtagtaactgtcatactagttggttatgtatgtgatcttagctctccacctaagttatgaaatctttgtggttatgtttgtttctatctctttggttttgtttttttttttcctggaacgctctctttatcttgtttcaacccaactcctgctgataacacatttctcaaaaccctaccaactggagatctttcctgcagcttccgtcacggccctcggactcagtccctcagcaga

SEQ ID NO: 172429 - DNA, 185 bp, Homo sapiens
ggtataacagcgatcattctgagactctctgtctttcaactgcgtgtttagactattcacatttaatgcaaattaaaggacacattgggatttaggcctatcatttttatttattttctatttgttccctttattttggtattcttctgtttcccttttcatgccttccgctgtgtattccgaat

SEQ ID NO: 172430 - DNA, 153 bp, Homo sapiens
aaaaggaacaataaccaagattttattgagtgcaaagcacagttctaactgttttatatttattagctcaactaaccatcataccaaccttctgagaaaggtactaatattgtcgttatttagagatgaagacgtggcggcacagggggattg

SEQ ID NO: 172431 - DNA, 176 bp, Homo sapiens
cctggaaggtcattccctccatcctgagaagttgggggcgggggggtacttagaggtggaggctgggattagaatcctcacccttctgcttagtggctagaagaccttgagcaggcccctcaacctctgtgagcctcggtctccaaatctgtacgttggggtgaacgatgattgta

SEQ ID NO: 172432 - DNA, 332 bp, Homo sapiens
ttatttcttcactatttcattactcaaaatatcagaaactggacaaagactaaaatcaaatcccattttaaatttttcattgatataagtaatagagcaggagttttactgagtaaatagttataggaaatcagatcaatatcaatgaagtatatcagtgttttccgtaagtccacaacatgttttcctgaagactaccagtaggattccacttgtcaaattgccttctttttgtttctattcctcttgacttaatatacaactatcccctggaaatacctttctacaacctctgagacacagcaccttttgtattacatgcttttactgta

SEQ ID NO: 172433 - DNA, 997 bp, Homo sapiens
aagtaagtgccaaaaaagtgtttaagcctgagtgtggtccgaaggtttagagcagacacaggatgggagctttgatggtggaggcggaaagaaagatcccaggcaggagagacaattgaagcaaaggccttgagttgagaattggccgtgccctcatcctttcctgtttcctttttgtttgggcaatgaaaagagcatggactttggggttggatgtgcctgcattcaggtcttgacactgctgtattaccgctcccaatttcttcatgaaacaagattaacagtatcacttgtatcagttagggtttgttggttatgagcaacctaaacccactctggctaacttaaacataaaaggaatctattgggatctattgacctgccaagcctcagaaaggacaggaatcagggaagcttcagagacctaagaggcagcagctgatagtatcttcagagtgctgctgtcagaataaacctacaagggctgttttctctccttgtcccaaccagatcaaggttcagattcctgagaaagaacctccgtggttaggaagaacacaagcacattgattgacagcactaggggaggtgttgttcccaatgggaaatctagatgctactaccaagagaaggaggaatggtttatagtagggcagaacccactgctgtccatggcaaaccagtgaaatatttagaagatagaaatatatgcaaaggccaggcacagtggctcacgcctgtaatcccgacactttgggaggccgaggcaggtggatcacctgagatcaagagtttgagacaagcctggccaacatggtgaaaccccatctctactaaaaatacaaaagttagccaggcatggggtcaggcatctgtaaacccagctacttgggaggctgaggcaggagaatcgtttgaactcaggaggtggaggttgtagtgagctgagattgcgccactgcattccagcctgggcaacagagcaagactccatctc

SEQ ID NO: 172434 - DNA, 1525 bp, Homo sapiens
cctgtagtcacagctctttcggagggcaaggcacatggatcacctgaggtcaggagttcaaggtcaggctggccaacatggtgagaccccatctctactaaaaatacaaacattagccgggcatggtggtgcatgcctgtagtcctggctacttgggaggctgaggcaggagaatcgcttgaacacgggaggtgggggtttacagtgagtcaagatggcaccactgcactccagcctgggtgacagtgagactctcaaaaaaaaaagaaagaacttggcacaagcccacaagcctaggcaatataacaagactcccatctgtacaaaaacaaaaaaaaaaaaaaaaaacaagagaaaacacagttgttcgggcgcacctggcgccacagagaagagcttccgaagaccatcgcgtggggggccggggcccaagagttaagtgaacggtgccagcgcggtcccagagggaaaccgcgcgccagcacagcgcgagaatcccccataaaaacgccggcgcaccgaccgtctcggacaccaacccgaagggaggccggaggacaaagggggatcaaaagaggggcccagggagcaaaaaaatagcccggcggggagaacacccacgaccccccatcagcagcgacacccacacggaacaaacccctacacacacaccaccgcaccccgccacacaccaacaccacaccccacccaacgcacccacgacacgcacacaccgcccacacagcgcaggcagcaccaccccgacccccccgccaccgcgagagcaacccgcaccacacgcacgacacccaacacaacaaacgcataaacccccgccaccccgcagacacgaccgcgcaagcccgcagccagcgccgagcccgcgcccgaccgccccaccagccacgcgcccggggagaggggcgcgagcgcgcgcagccaggggagagaggccgcggggggcacacggcgcggaacgaggcggcagacgcgcaggggaagaagggcgggcagggggcgaggcaggggcccgcggggagcaggcagcccgggcacgagaaagacaggacgacgccgcagaccagaggggcgagccggcaagagtcacgacaggagggacagaggaagcagaaaagacgcgaaggaacagagagggggccgacgcgagaccaacagggcggagcacgcgcgacgacggacggcaccgcgggaggggggggacggagcacagggcgaggaggcaggcagcgaacagcagggagcacgaagacagcacgccgcgccgcgcagagaggaccagaaggccagaggccatctgcctaaagcatgaagggatatggagaagcgcaacaagctactcggtacgtacctaacatggggtgcggaggagagagcgtggacagacgaggaggggataggaagttggcactgagagatatgaggagagtacgaaggcgagcgccaagcgagaggaagtgtagcgacaaaagagtgaacggaccacgacgcaggggtggacgtcgca

SEQ ID NO: 172435 - DNA, 470 bp, Homo sapiens
cagagtcttcaactgctacttctgagctgaggctgctgccttggtatccacacaggccttgctatttggggggtttaaggaactcagtgggattcctgggtttgccaagaccatctcctggtgttccttagaccagacagatgacctcgtgactggctgtttcttcctcctcagtttggaggagctgggaggggctccccatggggtgctctgcagacaagggcagtgtgggtttaaactcccagtgtcagggttcgcagaagggtagagtatccctgtgaagacagttccactttggtgtgtggtttatgtcttgtgtcaaataaaagggcaactactttcttctttggggactattagctcatcacagtggttcttagagaccctaaaaaagcactgggtctcgttgttatttatgttttgctttctaagtttgtatgttttcttaaaatttttggtgaccttagcta

SEQ ID NO: 172436 - DNA, 691 bp, Homo sapiens
ttctcccagaagagaagggagagcacatgcccaggctccatggacttccggttctcccctcccttcgcacccccacaatgaggtcacgacgggatgccaccaccagctggtcccttccagagctctgtctgaactccaccagccttgcttctggcctcatcctgcagacccaggggacacctccacttgcaagttcagtccatgggcactgcacactctctcggccccaagttgaaccccttttcctcacccaacatcctccatttcaacaaatggcagcgttgtgggtaaaataacacctccttcagagacattgacatcctcatccctgacttcggctgcagctcagtggtgcaatctcagctcattgcaacttccacctcccaggatgaagcaatcctcccacctcagcctctccagtagctgagacttcaagctccctccagcagccgagctgatttttgtatttttttatagagatggggtttcaccatgttgcccaggctggtgtcaaatccctgggctcaagtaatctgcccacctcgacctcccaaagtgctgggattgcctgcgtgagccccatccccggcctgctcatttccttctagtgctgaagaatattccgatgtctggatagaccacagtttgtctgtccactcacctctaggcagacatcttggttgcttccagt

SEQ ID NO: 172437 - DNA, 541 bp, Homo sapiens
tttcaatcatcggttttcctacttgcagttcacaatatatactggtcactctttataagatttaattatgcttgagtttttgtgtgaaaatacctcttgactgctgcttctcaaaagttgagctagataatacttcctttctgctgaaactaatggtggcttttcaaagcaatttgcgtaaattacaggcacaatctaacatgcttgaaactgacctgattgtctgcataccatcagattgctttagaaaggagcagaggaaggaaaggaggtgtcaggggtaactccaggaattggaatggcataggctccctctgccagagaaacaactctgctcttgatctaaataaatttgaattggtacctcatcatctggatccatttggatacatttagcatcctttgcgggtgtctggctatacaaaagctaataaagaactcgctacataaacgcagtccagttgtggtattctggcattgttcacacagcataaacacgtgctttgtaaaggtagatgaggcgaatgagtttgagggtcct

SEQ ID NO: 172438 - DNA, 404 bp, Homo sapiens
aaactgcctgccctcctctccccagatagacccaccacaaggcaccctctggagaatagaaccagcaactcaatgtcaatggaggcccctctctggataatctaggtctagagtaaacttcctcagacctctccaggttgttaaggccaaaagatccaaccctgggtatctgaggactcgaatcacacagcaatctgcctgaggtctttccaagagctagaaatttggcaagaagggggccccttggaggagaaggatgaaaaggcctttgcctggtgcctgcatctgcgagtgggtcagagggtggggcatcaggaccatgttctctgcagcaagaaaatatctcatttcaagactttcagggctggagttggtgctgggctagccaaaccggaagcgtgggc

SEQ ID NO: 172439 - DNA, 358 bp, Homo sapiens
cttgcaaggtagcattttggccaccattttattgttaacaaaattctaataaaacaataaaatggtagcccaaattcttaccatagaatatttaacaggccatttatcatctcataaaaatgtagaattgaattgaaattaattatgtgtgtgtctcaagaatatctgtctcaaaaaggaaaaaaaaacaaaatagaaaatagagggctaacacgatgaatccaagaaaagggcccactggatttggcaatgacaggttactggtgacctttagaaccaaagctgtcttgatagactgctgatggtagaagccagattgcagaggaggaaagaagtcactgcttaaaggagctctttg

SEQ ID NO: 172440 - DNA, 1829 bp, Homo sapiens
ggcacgaggctcatctttgagtcacttcaaggaggccttccttcattctctgcttgaagcaaagacctctggttttactctttgatagcacgctattctttccttcatggcactctccccttagcttggaaaaatgtttatgtggttcaccactctctactttgatggcattttgtttgctgttgcttgctagtatgtagcatactacctggcatgtggcgtatacttggtaaatattttgttagttaaatgaaaagatttgcttggtatttatggagttctttttatgttgaggcaccatgctaggtgctcaggagaaatgtcataccaggtgtcattatggtgcttagcctgggaactggcaatgggggagacatattacatgcataaatctgttcttacaatgcagagtgatctacgccatgggaaaggcatgcacacgatgttatgagaacaaagaaaaggggcttagccatcagactggtcaatcacggatgactttctgacggaatagacgttttagctgctgagtatggaaagatgaactgttgctctctagatggagggaaagccagaggtggaaatctaggagagcacggtcaaaggtggggggcaaataaaaattaaggcactgttgtagggatgcatgggctggagtaaaggatgcttgtgaggtaaggacactgtggactgcgctaaggactttcaactctttctagaaagctctttgaggccactgagtgacatcagttagagaggttacctcatcaggaactcatcagtttggccttttgaaaagaatactatgacaataaacaagatggacagacggaaggttggttagattatgaaaaaggattactgtgcaggctgtcaacacatatgctcccaactaagagagtactggctaaagagataggtaatgggggaatggacagaggaatcctgaagccttaacacctattatatagactttagtgaccacataggtgtggggtttgactaatggaatcaaagctgatgcctcagtttcctgttttcctaggatagtggaactagagcaggtttggatgataaatgagttcatgtatagatttggatatagaggtctgggactcaagagagacatctcagctgaagatataagtattatagtcattagcaagtaagtggtggctcaggctacaggtttagatgaggttactcagtagagtgacagtgaagcaagtggagtggttgggatggaagcctcagggagctacaacatcaagttacgaggaaaataaaaagactgatgtcagggatggagagatatttaaaggaggaggagtaatcaacagtaacgaaaatagacggctagggactgggcacagtggctcacacctgtaatctcagcactttgggaagttgaggtgggtggatcacttgaggccgggagttcgggaccagcctagcctacatggtgaaaccccttctctactaaaaatataaaagttggctggatgtggtggtgtgcacctgtagtcacagctactcgggaggcggagtcaggagactctcttgaacccaggaggcagaggttgcagtgagccaagactgtgccactgcactccagcctgggtgacagagcaagactctgtctcaaaaaggaaaaaaaaacaaaatagaaaatagagggctaacacgatgaatccaagaaaagggcccactggatttggcaatgacaggttactggtgacctttagaaccaaagctgtcttgatagactgctgatggtagaagccagattgcagaggaggaaagaagtcactgcttaaaggagctctttg

SEQ ID NO: 172441 - DNA, 269 bp, Homo sapiens
agtaggaactgtcttataacaacctacattattgtattgtgtttgcatcattgtaggaaataatttttagcttgagaattttatagtggcatcagtctgggcagattatgtgtgtattttctcataactgtatctgtattgagcctatttgtttgtgttgtcatggatgtgtggtttttagggtcataggtcccaatatgataatattggtgtttctactagacaaacttcttattcaaagtctactcttaaaatgtgtttccaaaaac

SEQ ID NO: 172442 - DNA, 289 bp, Homo sapiens
gagaggccttcctttaccaccagaggctgctgttagctttaactccatgaaggaagatcactggagcacaagtttagtacctggaacccaatagctaattagctactgaatgaatgagtgaacaagtatttatcaagttcctactgcatccagcattatgtcaagagctacaaaggatccaaaagaaagtttaaataaaaactcttcaagaattactatctatttaaagaaaatatgccataacaacttggtatacgtttttaagtcactgcaagaagcatttgggaag

SEQ ID NO: 172443 - DNA, 169 bp, Homo sapiens
cctgaggaagaggctttgggggcctttaaaagtaagtagaaacaagttaaagggataatttgagaggaacgaggaagtggaatactggacattgaattgcaaggaaaaagttagaaggataagtatttaaaacaaggctgaagtagagagaacttactgtttagaagtg

SEQ ID NO: 172444 - DNA, 199 bp, Homo sapiens
agctcaagggaaacaccatatggacagccagggttccctaagaatcaacccaaccagatcatcccacagaggaaactgtaatatcagtgtcccttccaatcagttttgtagtacacaactcttaaggatcatcagaaatgtaatgaaagcctctactgtaacagacagagaccaaagaaaagaaacagaaaaagcgatt

SEQ ID NO: 172445 - DNA, 210 bp, Homo sapiens
acttcattgttgtcttattttcagaaattatcacagcttccccaacctttagcaacaactatcctgataagtcaacagccatcaacactgaggcaagactcttcagcaaaaatattgcaacttgctgaagactcagatgatgatgatgatattttagcaatacagtttttttttttcttttttctttttgtagagatgggtcatcctatg

SEQ ID NO: 172446 - DNA, 362 bp, Homo sapiens
gcagatgcaaaaatcaaaccaagaccaactataagactaaatgtaaaagctaacacccatagcaacttacaaaaaaaaaaaagagagaaatttaaaaagtcttcatgaatttcagttaggcaaaggttttttagacaggatccagaaaataattactataaaagaaaaaactgggccgggcgcagtggctcatgcctgtaatccctgcactttgggagggtgaggcgggcggatcatgaggtcaagagatcgagaccatcctggccaacacagatactaaaaaataaaaaaaattagctgggcatggtggtgggcgcctgtagtcccagctactcgggaggctgaggcaggagaattgcctg

SEQ ID NO: 172447 - DNA, 300 bp, Homo sapiens
  misc_feature (35)..(35): n is a, c, g, or t
  misc_feature (40)..(40): n is a, c, g, or t
  misc_feature (53)..(53): n is a, c, g, or t
  misc_feature (57)..(57): n is a, c, g, or t
  misc_feature (60)..(60): n is a, c, g, or t
  misc_feature (116)..(116): n is a, c, g, or t
tgccctcggactcccaagtgctgggattacaggcntaagncaccatgcccggnccanatnggctaatgttttaaacagatccttcttgtctgccctgtaggacgacaaattatcangcgcaggggtggaagctggagccctgttcattcctctcttccctctttccctcctctcctccctctaggtagtgcaagcagcagctgttgaccctaggggcacatatgcttgcctggcctatctgcacttgagcttcctatgggtgcccatcttggcctgcatgctgcaggacttgcgcttctg

SEQ ID NO: 172448 - DNA, 329 bp, Homo sapiens
gaagaattccctgattctctgatatgcttttttttaattaaaagaaaaaattgtatcaaaaaaatccacacacttttttctttttggatacaggctcataatgaaaaacaggagacccttgccccactcctccaatcccagcatgctcctcaggcaatcacattcttctggtggtgaccttcatatccctaagtaaaacgcttatattgctatttcttgatttatgaacgccagatataaacaaagttgatttttctttcttttttgctgtgatagatgagagtttgtctcaattctccctcttttctttttttccttccttttttttt

SEQ ID NO: 172449 - DNA, 688 bp, Homo sapiens
gtggggagcagagtaaaaacaccaccaggagctactcccttgctgctcagccttaattcaacattgccctgcttgtgacttggagctatgagcctccaggaaaatcctcgggttatttctaacagaaccctcttccatcttattcctatggctaatatcaacaacagcatcaatagtaacccttcgcttactgagcacctactatgtgctttacacacatttaatctcatttaatccatgcaacaatcccatgagctagatgctaatatactccattttatagatgaggaagctatacttcggagagtttaagtaactgttcaagctcacacaactagtaagtgacataacaaagagaaatggtagaaaggcctgaaaaggaagaggagtggagtgaggggcaattgacatcagagtaggcctctttaagctgctcctgtttgagcagctgcccaagtgagctggcagagtatgggaacaactgaaagcccccctcccagcagctcacctcatggcctacctggaaaagaaggatccctgggccccaaaggttgacactctcatctcttccaaggagacttccaaactagcagaggttgttcagggaccaggggcactttatcctcagggagaggataaagaccatcatgctttatacttcctagaccgagacactttacctttccag

SEQ ID NO: 172450 - DNA, 418 bp, Homo sapiens
ggcggccccgccccccgcagctccgggcccagctgtcagagcagctttccctcaggctgggcggagcgtggccacttccgccaggaggcgcctttgtgtcttctaagttaagcctattcagtggatttcttattcctggaacccaaacctgggcagtaaaccctccggggcttagaggccgctgcctccacagactggccgatcccgccctgaagtgccgctggtggaacagcccgggcggaaccgcccgggcggaaccaacgggctgccgcggggggtggggccacggtccccccccttctgccttcagtggaacggccccggcggaaccaacgggccacggggatgcactacgcgcaccgtcgtcctctccctctgcctgcagtggaacggcccgggcggaaccaacgtgcggccg

SEQ ID NO: 172451 - DNA, 445 bp, Homo sapiens
ccctaagcatgtggctaagggactccgccatgtacacactgaagatgttccctaagaatgtggccaagggaccgacgccatgtacacactgaacacatttcctaagaatgtggtcaagggaccgcactgaagacgttccctaagaatgcagccaagggaccgctgctgtgtattcactaaagacattccctaagtttgtggctaagggaccgccatcatgtacacactgaagatgttcccgaagaacgtggcaaagggaccgcactgaagacgttccagaagtgtgcggccaagggactaccaccatgtacacactaaagacattccctaagaatgtggctaagggactgccgccatgtacacactaaaaatgttccctaagaatgtggccaagggacccacaccatgtacaaactgaagacgttccctaagaatgtggacaggg

SEQ ID NO: 172452 - DNA, 511 bp, Homo sapiens
atgcaaatgacctcaaatacatgtcagcttactttgctgtggcaacatccatgtgaactgctttgtacactgtgaaaatatttcactccagcctgcccattttgtgtttactctgggctggaaaagactttgccaaaacattaaaaactattcttttcactaaattaatagtctatctgctttcagaagatgtatcatctatctgtacacatttttgctggttttgtatatcagattttttcctctcaagaaacatacttagataagctaatgaagttgttttcttcaaagtaatatatctatataatgactgcattggcaaatcaaccgaaatgtgaatgttgtgcctagtgagtgagtcatgttccatcattatttctttccaaatttctttgccagttcagtttgaaccatatattttgtagctcagcattgcaaacaacagtaatactgttttaagaatgagtgttataattgcatagcatttgtatgcactttatactttgcagag

SEQ ID NO: 172453 - DNA, 470 bp, Homo sapiens
aatctttccaacctctgaaatttagataggatctggctcagaaaaaaataaaatttgttcaaagtcacatagctaacatgtctagaagctcaaactggacactaagtctcttcatcctttatcagcaagcacgctactaaatacaatgtgggtacatataaacatgtgcacagtcaacccgttctaaacattgctggcactgtcataaatagaacagggtctttgttttcaggatggaagagggtccaatgagagaaacctcagacatgcacatgtttatgtgtataatgtaattcttcagcagtaaatacaagcccacgggtctctaggagaaacaatgtggaggattgggttggcaacagttttccataaacagtgacacttgatctgagcatcaaggtacactgaacacatctgaagtcagaacaccaggataaaattactcagtcacttataagcaatgaaacttt

SEQ ID NO: 172454 - DNA, 622 bp, Homo sapiens
gttcacaagggggtattgtgtactcattttcatttgaataatctgaatcatctttctctgtatctttccaacacttcagcctctgcaatctcccagccaccgcttcacctcttttgccttccagatctggcttccttcctgacattccttacgtttatgctccactgagacagaaagacacaaatccagttccagcagaaagcacagatatggaacaagagaaacatttcagttaaacagattgagtgttacagggcccagaacctataaatgcatctgttcaactggtctttttgttgaattaaaatttggtgaagctaggtcagcaaaatataatgatgtcaggactttcacagagatgaggaaactgcatttctaaacaaaagccttcattaggtgatttttattgaagggtttatttctgcctttatgaacaaaaacatgtatatatcatatagatatatttagtatcattaatatttcaatgttgatcagccaaacttatcaatagcaactattgcctcataataataggtaccactcaatcagttgctttctatgcatcagacactgtgctgttttaaaataaagcctttatccctggacttctctattttccgtg

SEQ ID NO: 172455 - DNA, 515 bp, Homo sapiens
gcggcagtgaatcgagctcggtaccgcatcgaatcatcttgggggactgaggtgggaggatcgcttgggcccaggaggcggagggtgcagtgaactgagattgcgccactgcaatctcagcctgggagacagagagagacgtctcctgttctcctggagaacaacaagtcatgatgtcagacaagaacttggattttggagacacgggtttgaatttcagtcattcattcttttattcagtaaatatctagcaagtactgacatgtcccagatgttgttttactcactggttatacgatgggagggagacagagaaagagagagagagagagagagagagagagagagacgctattctaaaagcttgaagtctaggctgtgcagagtggctcatgcctattatcgcagcactctgggaggctgagatgggtggatcatgaggtcaggagattgagatcatcccggctaacacagtgaaactccctctctacaaaaatacaaaaaattagctgagc

SEQ ID NO: 172456 - DNA, 455 bp, Homo sapiens
tcttgagtaaagtactgatgtcggtgaacaatgagcgcgatgtcaggcgcacagcaggtcctcaggcagcactagctgaatatgtgaacaaatgagtggacagagggatggatggaaggattcttgaagcttccactgcacagggctgttgaaacaacacaacgcgggacctggatgtagatttcatctcgcagctgagccatgtgcttctctgccttgcatttcacccaagcccccagtatgagggggacacagggctggctcagagcagaccccgctcagcaaaactcactgaactcccaacagggcaaaacctgcaggccccacagggagcttgggacctgactgagaagaatcagggttcccaggggtctcagtcacagggaaggtcacatccatctctctggggaacattatcactgggttgaaatggtcgccaatccggtaaaaagaca

SEQ ID NO: 172457 - DNA, 717 bp, Homo sapiens
agaacacaaaaggcaaggcacagagagatgacctgggaggcagggaaggaaagcattcccagagagtctctttctgtcacccggtctggagtgaagtggcgcagtctcagctctctgcaacctctgcctcccaggttcaagcaattcttctgcctcagcctcccaagtagctgggattacaggtgctggacggctgaaagccggggttcaaggcatcagcaggtgtggtgtcctccgaggactttgcccgtggtttgccagcatggtgacgttcttcctggggtcctcaccgtggttccccttcctctgggagtgccaggcatcgcgttaagtgtctacttctagtgtgtccgacttatccaggcccccgccgaaccctagggtcttactgatggagtccacgccaggactggagtgcacaggcgtgatctagtgatcaatgctggctccgtatactgtgactggcggagttcactgcgccctcgactcgggaaacgctagaaggggggaagactcggcttgagatctgtgcgacgcacgagaggtagagcagtccacttggcgatccaagctaattgtatctccaggtactgagcaacacaagcatagacatataatctcaattataaacaagatgccacccgtaagactgcgtaagcgaaccttaatggcgggtccaataaatgactctatgttgaattgcttttttgggaaagt

SEQ ID NO: 172458 - DNA, 136 bp, Homo sapiens
ataaatgttctggccttggcctagcctggggtcagattccactatacagatggcctctgttaagaaaactacttggggacaggtctgcctccctccctcaaatcaccctgagggaaccaagctactactagctaca

SEQ ID NO: 172459 - DNA, 545 bp, Homo sapiens
tgtctactattcaactgcggtttgcatttaaccttcctatcaaaacagtgctagtctttcttgcaacctctttttaaatttaatacgatgattgcctgacaatgggaaaagggtcctggctaattaattaatgttataatacatggccattaaatgatgtttctggtaaccccataattaacatgtgacactcttaataaaataagtaaataaaaattatgctgttacaattatattcaaagtaacttgtgttacaaaaatcctgaacaaaagtatacatcactgattttctatttttcaattctatttttgtattttccatctttaaagaacatggtttatatttttttttaaataaaattgtttgccattagtaagttcaaattcgaaggctaggattcctttttgaagtgcctgggaaaaaaattcaaccgcagttgaaagacgcatgcgtctttcaactgcggatccttagagcagcagaacaaggttctggacaccaagtggaccctgcttgccagaccacgccacccaagactgtgagg

SEQ ID NO: 172460 - DNA, 404 bp, Homo sapiens
ctccaacaccctagttcctggcaaccatcttcttggttaaatttattattgattcaatccttacttggtgtttgtctatttagattttttatttcttcatgattcaatctttgtaagttgtatgtttctagggatgtatatttcttctgggttattcagttttttggtttataatttgttcatagtaatcccttacagtcccttgcatttctgtggtattagtgacgatggatcttatttcattcacaattttatttatgtgcattctctctcttttccttggttagtttatctaaaggcttacaaattttgtttgtcttttttgcatttatttttaaatttttttttaacttttgtttttgcttgagggatgcatgtgtaggtttgttatatacgtatattgt

SEQ ID NO: 172461 - DNA, 181 bp, Homo sapiens
agtactatattaaggttgtagtctcaatagggacatagggaaaaataattagaaagaaaaacattgtcattgttttagccttgaggggatgtttttctatgtatatttaaattaactgtttaattaaatatgcatggcatgaaaacagtgccctaagggacagtcctagcctttggctagg

SEQ ID NO: 172462 - DNA, 842 bp, Homo sapiens
ccagcggtgcccttagctgtcaaggatgctgtgggaagagtggagcctcgaacccgagacgctagacccaatttggtgcccatgggaggagtgggagtggcagaggcagcgagaccactcctttcttggcccaccatttctctcaccatttttactgcagtgaactcctctcagggtggggggctggtacagaggcaactccgctttcataactctcacagggtcctttgtcggaggtgtccctgccctcctaccccagcgtggtgggagtgcgacgccaggcttctccctcctccctggcctcctgtgcctccagcctccacatctcctgagatcctccccaccccacacttacacaggtccccacacgcccctggtgcccctaaaccgccacccaaccccactcaccctggggccgggactggggtgtcagagctgagccagggaccttgggaggtggctgggaccggcgcctcctgctccctctttcattttccctttcggatttggccaggatggaggacaggacaggatggctgagaggggctagcgctcccccttctcttaaaggaacagggtgaccctgctggctggctccgcccttgggaacaggcacggaccacgccccttgctgggctctgtggccctcactctttagctaaatttccatctggaaatgggggaggtgttgatctagggtttcataccccatatacgtacctttatgtcttgctagtgtcttggccttcctcaaccttaatttcgtaagtttatcccttatgctctgatcttaacatatcttatatgtgtcttcctctatctatttactgctttattatcct

SEQ ID NO: 172463 - DNA, 1165 bp, Homo sapiens
ccagcggtgcccttagctgtcaaggatgctgtgggaagagtggagcctcgaacccgagacgctagacccaatttggtgcccatgggaggagtgggagtggcagaggcagcgagaccactcctttcttggcccaccatttctctcaccatttttactgcagtgaactcctctcagggtggggggctggtacagaggcaactccgctttcataactctcacagggtcctttgtcggaggtgtccctgccctcctaccccagcgtggtgggagtgcgacgccaggcttctccctcctccctggcctcctgtgcctccagcctccacatctcctgagatcctccccaccccacacttacacaggtccccacacgcccctggtgcccctaaaccgccacccaaccccactcaccctggggccgggactggggtgtcagagctgagccagggaccttgggaggtggctgggaccggcgcctcctgctccctctttcattttccctttcggatttggccaggatggaggacaggacaggatggctgagaggggctagcgctcccccttctcttaaaggaacagggtgaccctgctggctggctccgcccttgggaacaggcacggaccacgccccttgctgggctctgtggccctcactctttagctaaatttccatctggaaatgggggaggggggtaaccagagccacatcctttatcgaggaagctgggggattcctagaagcccttcccagacagaccctcagtctggagcctagatccactacgcactaaccatgccctgtgaagatggtcttcggggacagagggaggtttggtgctggagtttaaggggcagcaaacatctaacagcttctggttccagctctgccaccgctcaccttggacaaatcattcggcggtactgagccaggctttcctgccttgtcaacaaaggcggccagtccagctgacccccaagtttccttccagctttacatcttttttggaacggggtctctctacatagcccaggtcgatcttgaactcctggcttcaagtgatcctcacaccttagcctcctgagtagctgggattctctacttcttaatattgaattcccaaccatattacagagaaccaaaaaaacccttgtgcctgcaaaaaaaaaa

SEQ ID NO: 172464 - DNA, 536 bp, Homo sapiens
acagtcggacaaaaacaaacgcagacacaccctgctcaaccgagatcctctgccatcagctctgaagacagtgacgtgagcgtgtcccagcagctcaggccttggccacaggtgacccactacgcagcctgcacgagcccacaatcccccccgacatgtggcttcctccagccacaggcactgacgagggtgcggccaccccaaaaagaaaggccccagcccacagggagcgccatcgggcccaccccaaccaactccccgtgtgacacgaagggccccagcctgctacgtctgtctgcagctctgccacgagcatccttccccagcccacaggtctgcaggcggctgccacctgagccctggcctggcagtggtgtcctccgcctggctccctgaatgttcaccagctcctgcgggttttcctctcctcatgctcctgggggtggggcacccatcctgcccgtgttgcctcctgctctatgttcttgacgtgggatggcggccagggactctgccctcgctcagtgcctgccctt

SEQ ID NO: 172465 - DNA, 450 bp, Homo sapiens
ccttgaccttttctggctcctaaaacagcactctagaagtcttgccactgggcaggagaggattggatttcaagctcctaagtatgactatgtgatattcaagttttgccccctgtgctttccatgaggaattaggggctgactctgtcatcccactcctacttcatcttcatggatttggtcaggcatgagcatagacttagtggccaacctctgaccacaccactcactgctagaggctccctggggcggtaaggatggagtaagagactatggttcacaaggacagacttgaggactagctggggcccctctgctacctctcactggcttggagaatggtgtttttctatttgcttgtgacagcaggcacttcattttccctcctttgggaaatttgaatggatctggtagaatgaatgaagaaagcccatatgtagtgtgggtggt

SEQ ID NO: 172466 - DNA, 321 bp, Homo sapiens
tcaaactcattggcatggggtccatgagatcttggccttcctgaatgggaatgacttgctcagtgccttcaaaaggtgagccctgaagacaggtaagtacctatttcatcacagatcctggtttcaatggtttctccagtgccactcatcaacttactagctgtatttcttcaacagcctgttaccaatttaggaaaaaaaagtctgactttaagaaaaccaattcctctaaaaatctaatatttgctccataaaaagactcaagagtttcagttagtaacaggaaagtctaaacatggcagttctgtggtcctctggttg

SEQ ID NO: 172467 - DNA, 499 bp, Homo sapiens
tgaattcaaagaagatgaagaaaaccatgtcacaagttgtgcctgctcacttctctggccggggaaatgtgctcctagataacatgctctaccccgagcacgtttggagcacacacacatcccatgatccaagaaagggggaagatctttccctaaaaaattaacaaaggaagagttaatggatgctgggcagatggaattagaaattgtgtatagctggtatcaaggacccaaatgctgggcagaaggaattagaaattgtgtatagctggtatcaaggacccaaatgctgggcagaaggaattagaaattgtgtatagctggtatcagggacccaaataacaatgtgttaagccaattaaggcttcatttttcttttaactaaaacaaggacagaagtaggtaatccaaagttggtgtaatagctccactgtcatcagagagccagacttcctatgttttttgctataccatcatggtgcatgatatgttcccacag

SEQ ID NO: 172468 - DNA, 343 bp, Homo sapiens
atgataagaaaaaaacctttttattttggaaaaatgagagtaaaggaattaaaaatgtgcttagagttttggttttacatctggttgcttaaaccaactggagtttgtttttgtatatagcatatccatgttgtaagttaatacatcagataaagataggtttaggtaagatagtccacatatttaacaaacagtatggtacaggcattgcccaagcaggtagtcgtgaacaatttgtacagatatagcagtgtgtatcatttgactctcagccccaatagatccatatgtaccaacatgaagtgatctctaagacacattttttagtgggaaataaaagcaa

SEQ ID NO: 172469 - DNA, 1412 bp, Homo sapiens
tctcaaaaaaaaaaaaaaaaaaaaaaaagattttctgagtctggtatgctagggtggatttcatggtcattgtgctcaaatgtagagataggatatatttccctgctcctgccacaggcaaggtgggactaccctaacttagaaaactgtcggccgggtgcaatggctcatgcctgtaatcccagcactttgggaggcaagatgggcggatcacaacgtcaggagtttgagaccagcttggtcaatatggtgaaaccctgtctctactaaaaatacaaaaattagccaggtgtggtgatgcgcgcctgtagttccagctactcgggaggctgaggcaggagaatcacttgaacctgtgaggcggaggttgcagtgagccgagatcgtgtcactgcactccagcctgggcaagagagtgagactcgcctcaaaaaaaaaagaaaagaaaactgtcacttcaccttggtttgtaacggcaagtccaagtgctcctgggtttctacaactgagagaagctcctaatatcctgggctgtaccaaataatcaaacgaggtctagtcataaaatcctagtcaaattgtctgtctgatcccctagactttgtaaaggagtgaagagagaaatgagatgaaggaacataaagaatgtaacttcaagggtcaaatgaaacaaagccggcctgaaggagagaaaggagcggtcaaatccatcagcctaagacctttagtccatgtttaaattgatttatacaatttccaaacattacaggtagagtaaaaacttcgaacttttggctccaaacacttctctgctcacattcagaaatggaaggatcagataagacctgagaacaaacttcaagagatagatgggagtctttttgatggctgaaaaaccggttcctacgagatctgagccatttcgtcacaaacaaaagtaagaagatgggtagttttctctgatacccccactgcatctgagatttctcatgctttatctgaattcattatgctgttctttttgaaaatccaagatatccagcctggctaacatggtgaaaccctgtgttatccaaaactcaaattataccagacctggtgggcatcctcttagtccaagttactggagagtttggccggaaaatccttgaaccgcggatgtgcagtgtcgggcccaaatttgcctatggcttcaaactgtggacaaaaggggcctttttccaaaaatgcgccattgggctattggcattagcatcttggggggtaaactacctgcgcgttacaaaaggcgcgtgaacctgtttccctctatattgtgaaaactccttctcctggcgatatagccacctaggcttcattctcgcctgtggcgtgaatatggtcattttttttacgcgtcctttcttctccct

SEQ ID NO: 172470 - DNA, 1353 bp, Homo sapiens
tctcaaaaaaaaaaaaaaaaaaaaaaaagattttctgagtctggtatgctagggtggatttcatggtcattgtgctcaaatgtagagataggatatatttccctgctcctgccacaggcaaggtgggactaccctaacttagaaaactgtcggccgggtgcaatggctcatgcctgtaatcccagcactttgggaggcaagatgggcggatcacaacgtcaggagtttgagaccagcttggtcaatatggtgaaaccctgtctctactaaaaatacaaaaattagccaggtgtggtgatgcgcgcctgtagttccagctactcgggaggctgaggcaggagaatcacttgaacctgtgaggcggaggttgcagtgagccgagatcgtgtcactgcactccagcctgggcaagagagtgagactcgcctcatcctgggtttctacaactgagagaagctcctaatatcctgggctgtaccaaataatcaaacgaggtctagtcataaaatcctagtcaaattgtctgtctgatcccctagactttgtaaaggagtgaagagagaaatgagatgaaggaacataaagaatgtaacttcaagggtcaaatgaaacaaagccggcctgaaggagagaaaggagcggtcaaatccatcagcctaagacctttagtccatgtttaaattgatttatacaatttccaaacattacaggtagagtaaaaacttcgaacttttggctccaaacacttctctgctcacattcagaaatggaaggatcagataagacctgagaacaaacttcaagagatagatgggagtctttttgatggctgaaaaaccggttcctacgagatctgagccatttcgtcacaaacaaaagtaagaagatgggtagttttctctgatacccccactgcatctgagatttctcatgctttatctgaattcattatgctgttctttttgaaaatccaagatatccagcctggctaacatggtgaaaccctgtgttatccaaaactcaaattataccagacctggtgggcatcctcttagtccaagttactggagagtttggccggaaaatccttgaaccgcggatgtgcagtgtcgggcccaaatttgcctatggcttcaaactgtggacaaaaggggcctttttccaaaaatgcgccattgggctattggcattagcatcttggggggtaaactacctgcgcgttacaaaaggcgcgtgaacctgtttccctctatattgtgaaaactccttctcctggcgatatagccacctaggcttcattctcgcctgtggcgtgaatatggtcattttttttacgcgtcctttcttctccct

SEQ ID NO: 172471 - DNA, 358 bp, Homo sapiens
ggggcccctggggtcaaaggatggacaccgccttccctggggccatcccagtgatgggatgtcccatctcacgggcctgccattccagcaccactgggagagtgcctgctccgcctccaccagctgtgtgacccccaccaagtctctaaccctccacacctctgttttctccatgtaaaactgaatgagggacaactgagtgagtataggtcaaattgctggcacttagaagcaatcaatgatgttttatttatttatttatttatttttgagacagagtccaggctggagctgcagtgagctgtgttagtgccaccgcactccagcctgagtgatgggagtgagattctgcctcaaa

SEQ ID NO: 172472 - DNA, 584 bp, Homo sapiens
ggccttggggtcacaatagatggtacattaggatacgattcaacatggttaagaaaggttaactaaggttatagggcaaattggaaaatgttttccaaatgtttgtcttaactctgaaaaatgtttggcaaactccccctcccccctaatttggaagtggtttgttttagtcgttttggaagaaataaatatttgcattagaccaaacatttggggcaaacagttctccccatttctgaggctctgtgtgagtaggaggagatgtttcatgccgataacactcatcccttttttggccaaatcgaaggtaactttcgatgtgagcttcacatgcttttcacataactgctagaatgaggttgagcaaatggaaagaaaagaggaagccaagcagcttgatccttccagacctagggatggctgatgacctggcatttgaaggatgtaatcgttaaagaaaaattgcctttctgctcatgggcagggaggctggatccaattaagacaaggaaaacgtatgttaacttggaggaaaaatttctaaacagtcaattctgtaatcctctctgaagaggaagaggcca

SEQ ID NO: 172473 - DNA, 678 bp, Homo sapiens
aagatcatgctggccatcatcaccaagatgaccctcacccaggtgtccacctgggttcgccaacgcacgccggcgcctcaagaaagagaacaaaatgacatgggcgcccaagaacaaaggtggggaggagaggaaggcagagggaggagaggaggactcactaggctgcctaactgctgacaccaaaggtactgaaaacgttcaccaccccaccttaagggttttacaagtcatcaagcagtttggtctttcaaaagctgccctgtagggtagattttctggaaggtcctcagacttacccttgcacttccctgcctgtctcagagcattagcctgtgcactgccttctacctgtaattctctacacaaccggcttcttcttgacatcaaagtgttacctcctaaagttcttcctgcctcacccaagccaaaatagcctcccagttattttctgttctgccagcctgtttggatttcctttgccatacttgtcactgtgagaaagtttacatacccaacttccctctctagaatggcagctccaccagaagccttacttgctgccatatgccctacacacctaatacctaaatgatggctggtgctcagtaaatatttgctgaattaaatgatataacagcagccacttgtagatgttgaaatcgagtaaaaactgcc

SEQ ID NO: 172474 - DNA, 541 bp, Homo sapiens
tccaggaatggagatggagacaaaagggaagcccgtagtcaaagtcagatttggcaaaacagaattgggatccaagataaaaacagtcttaagatgggaataaagaaaaagtaatgattaccaggagcccccagacacacactgcatggaacagaagatcttgctgcttttcatttgctgaagaagcaccagccatttcttcgggaaactctttatgattttgcctcctcgagaattttacctgccttttcagttaagcatcaagatttatcacactgacttctggctagggatgaataagatgtaacttgctgaataccacaaatgagagacctggaagctactatgagccatgaaattcccaaaggccatcactggtgaaatactggtcgggcttctgggaaaggtgaataagagcatcatggcaagatgtcagcagtaaagcagagtggagactgaagctaaattgttcccaactcaggcgttctctgctcatagaacaatagcagtggctaaggtacatgattgagtgctaactcta

SEQ ID NO: 172475 - DNA, 181 bp, Homo sapiens
cccttcccatctccaagcctgtaggtgtcctctttcctttggcagggactccctaccctcgggcctccaccttgctccctggtttgcatcactgaggtcccggctcaaatgccacccctcagagaggcttccctgacgcctcatcccactcacagtcacatcactctctttgttttttgtt

SEQ ID NO: 172476 - DNA, 558 bp, Homo sapiens
tcagttccaagcctgcccgccaataatctcgagttaacgattttctgaagggataagggtactcaacacaaaaatagtagttttccctcaaagatttgtctttgctactttcaatctttcagacatgcctgattaactatgaaatctgagtattaatagaggaaacttcagaatgaaggaattgtatgaaagacaaatattaagattatgtcaattacatgggagaaattaatagatacattcttgcacagaaatgaagcttgaaaagaactggtattggccaggtttgaaggctcatgcctgtaatcccagcactttgggaggccaaggcaggtggatcacctgaggtcaggagtttgagaccagcctgaccaacatagtgaaaccccacctactaaaaatacaaaaattagctgggtatggtggcacacgcctatagtcccagctactcgagaggctgcggcaagagaactgtttaaacctggaaggcagaggctgcagtgagccaagacagcgccactgcactccaacctgggcaacagagcaaaactccatctc

SEQ ID NO: 172477 - DNA, 643 bp, Homo sapiens
aatacatttatggtttgtaaattatatctcaataaaagtgttattaaaaaaagattatagggtgggggaaaagggtgtagttatcggggaggaaaggggtgagaaagccatgctaaggagtaccaacttgatgctggaggccgtgagagacactgaacgattttaaacaggaggatacagtttggatgtttgtcccctccaagtctcatgttgaaatgtgatcccccatgttggaggtgatcctagctgggaggtgtttgggtcacaggggtgggtccctcttgaatggcttggtgccctcctcacagtaatgagtgaatcctcacactattaattagttcacccgatagctggttgtttaaaagtgcctggtctctctctctcttgccccctctcctccccttctaccatgagtaaaagtttcctgaggcctccccagaagctgagcagatgctggtgccatgcttgtacaatctgcagaaccctgagccaattaaacctctttcctttataaattacccagactcagatattccttttttttttttttttttttttcagatggagtcttgctctgtcgcccaggctggagtgcagtggtgcgatctcggctcactgcaacctccacctcttgggttcaagc

SEQ ID NO: 172478 - DNA, 379 bp, Homo sapiens
cccagtgaatcccaagcaaaagaaacatgaaaaaaagaacatgaaagcacatgataatctatttatgactacaggaacaaagataaagatggcagtagctttcctgttgaaaataataaaagcaagaagacaatgaagcaacatctttaaaaatatggaaggaaaactaaattgtcaacctagaactctatatccagtgaacatatatttcagacacacaaaagctaaaagagttcattactggctggacgcagtggctgacacctgaaatcccagctactcaggaggctgaggcaggagaattgtttgaacctgggaggtggaggttgccgtgagctgagattgtgccattggactccagcctgggcaacagggcgag

SEQ ID NO: 172479 - DNA, 164 bp, Homo sapiens
ataagagtaaatgtggagtactggggacaaacactggactgcagagaactgaggagaaaggtggggaaacaggcaacaagcatggggtttgtttcttcgggagaagtcaactataaaggaatgcagagaagaggtgttgagagaggattctgttttcagtgggg

SEQ ID NO: 172480 - DNA, 602 bp, Homo sapiens
gtgaaaaatttttcttaaagacttttcctgtccaaaacctgaaaattccaaagtcatgcatataaaagatatttagaaacaaaattgttaaaacgcttaagaaacaaaattgttaaaactcttaaagtatacataaatgagcttttttgttgtaatatctaagtcccaacaacttgttcagtatctctcaaaagagtgtgttcagcattgctggtgccattattatgctttgtaaaactcttaaagatttgattgtgtgaaatgcaaaagaggaagataagcccaagaagaaaaacagtttatgttgtctcacacttaatattttggtaagcattttctgtgcaaataaacgtttacataattgtgaatctcatctttggtagaggttttatgaagagtagaatgacttgattttttttgaagttagactagttgaggcttttttggagggggagtttggttgcacatgtggacttgttctggaagggtccaaagcttaaatacactcctgtaaaaaaaagtaatgggtcattattttgctttttttatttattcatttttaaaaactagttacttcccattaaagacatttgcatatcccc

SEQ ID NO: 172481 - DNA, 414 bp, Homo sapiens
ttaacatctcatcccaaccaggtgaaagtgggggaaagttgtgcatgtgtgtatattgcatgaacaatatgaaaaggaaggataatttagttcatagtagtttttcttctgaacgtatctttgggagtttaatctccttttgattctctaatatggattagtcttgttatataatcttcaagtcttttccatgccagtacttttcaagggcaccttatgttcatatggtttttccttaccttttattcctttgtgtgtttttttggtgctgaattacaggtgattgtttcagaaattagaagaactactctggctgtttacaaagtgatgatctgaaatgcttttacttagtgcctagattttctctaacattgaatgatagtgggttataagaagaagttgaacatactttgt

SEQ ID NO: 172482 - DNA, 217 bp, Homo sapiens
tttccatagagtgtctataaacgtctccagaaagacgtctagcatttgtaaagtatatttcattaagacagagtagatttcaagcatcagattccaagagaagagcatgctggtcctatccctaacactacaatttctcttctcctgaagccacttttccaccatctctaagcacccatcacccacacctgtcccttaatttcttcccatgttctct

SEQ ID NO: 172483 - DNA, 391 bp, Homo sapiens
taactgaatgtattccttccttcctaagtaggtttgatattacagcctcctgttgttgaaaatccatttcttccgtgttcttctgccaggggaaattccatttcattaatgtaaatgggaattttcagaatagaaatagagaaaaaagcttatccagaaaaaggggaaaatactgagccagaagcagcaggagatgtaccaggagaatattacgggtcagatatcaaagagaaagttcacctttaacagcacaaaccataatttccaccctattttaattgcaaaaatggaatgcatattgtagcccttcatacataatgtatcattttatcaaccatcttgaatgttaaaaagattcagacctgtaaaactcttgtgtatttttgagaag

SEQ ID NO: 172484 - DNA, 555 bp, Homo sapiens
  misc_feature (180)..(180): n is a, c, g, or t
acggccccgccgcgcggccacgccagccatgtttatatagccacgcggagacctcgcgcacgcgcccaggccgccgccaccgccccgggtttccccgggatccggccgcgtgattggccaaggagcggagccgcgcccgtgacgtcactggggacggctccagggagcgttaaaatcttnccccagaatcgccagcaaggaggggcgatgccagaaacctatcacgtgggaggggcaagctgcacttggaaaactgcggcatccgtgttcctctccttgtgtcccctgtagtgtgttcctcgaaaagccagcactagactatctccaggattctattttttaaggagaaaatggggaggactgatttccgagaagagtgactcaataagaattcaatcacgcattttcagtgtttttctctgctgtcttcacactgaagcgttgctaaaattcgcagttagaattgacattgtaaaaattaaaatggcgtatagttttatagtctgtgagatgtgcctattttcatattttagagttaaactgcctaaaatctta

SEQ ID NO: 172485 - DNA, 442 bp, Homo sapiens
aatcaagtccccaactactgtctaagaaagatgaatattgatttataactccttgtcacctggctaccatgcttgggtaagtttaggggcatttaattatgactcagaaagtgtggatgtaaagtctccagggaaacacttggcttgtattttggagatgtcttatttaaaggatggaccatctgttgaaaaaggagatcctcttcctcttggtgcagtagcccaagaatttcttctagttcttagacactagggattacctacaagctaggcagtaggatagacaggtctggccaggaaatgcccagtcattcgactgaacatcacgctctccttgcacatacatggctgctccacctctgtttccaccgccgacacactgcacacctacatcccttggacccaaaacccactgctgctgctggtgtggacttctagcgtt

SEQ ID NO: 172486 - DNA, 162 bp, Homo sapiens
catgctcctgccatttccccacaagcatgctgcggccttgcgtgagaggaccagagatctcctgtcgtcttccaggcttgctgcaagtgcagctgagatgaacataagtaatagactcattaattgtttcatcgtgactcaggaaaaccactctgtaaagtc

SEQ ID NO: 172487 - DNA, 255 bp, Homo sapiens
tcctataaccagatacctctgttctggaaagaagaataaaactgatttttgttggccttccagcacaacaagcattataatgaaacaaacaaaataaataaataaataaatatttactcaatacctaaagagcactgtccatgatctttttgctttcattttaagtgtattttaaaatttacagatagtaaaagtcccccttttggtgtactgttctatgagtttaaaaaatgcagagactcatgtacttaccac

SEQ ID NO: 172488 - DNA, 290 bp, Homo sapiens
actggtttggaaggaggtgaaggcaggagctatatgactaccaggggaagactgccgcaggcatagccggggcaaaggccctaacgtacccagggaccaacagggaggcccgagtggcttgagcaagagagtgatcagtgagtaggagaaggcagcaggagaagctagagacgactgaactttacaggccacaaaagactaaggctttggggaggaagaggaacggaagagaaaggagctggagtccagcggcagaaggagttaatgcgccatgagcagcagcacaagag

SEQ ID NO: 172489 - DNA, 424 bp, Homo sapiens
aggaacaagtaactgatgtatcaggcttaaggaaactgaattctaaaccagtagagggaaagcacaaaagctaccaagctgcactgcagaaactacaaagtactcaggactcaggaactgatggcaccaggtacctctggaagtgggggtgaaggtgggttgaaaatctacttaagaagcagtcagagtcccatattccttacccctctgctgcaccagtgacctactcctcccctgttcctccaggtggaggactggaggtttaccctagcagacaataaaacagtaggtctctggactggaacccccaggcacaaaggtgattcagtaaaggaaatattaaagattgagcccttggtcctcttctcctacttggttcccaaagtaccagcagccaggatttccaaaaagagaaaaaagagta

SEQ ID NO: 172490 - DNA, 533 bp, Homo sapiens
caacaagtgcaaagaccctgtggattgatctaagctggtgtgtgttaggctcagaaaggtggccagtgttctagaagtaaagtgaacagaaagaatggcagcaggtgaagttaaatttgaccttgatgggtctgttctgcagccagctgtagctacatcagcaagtcagtcagatatacaagtagggatgtcaatcaggagcctaaatctgagacatgagacagccatctgtgagtgtattgaattttaaaccaatggaactcagtgagagggaaactaaagaatagaggatgactgagcacagagcaccccatcatttagagatctagaaaaggaagagaaaccaaatgagaggctgagaagtaaaacacagtgaggcaggggaaagaccaggtaagcctgcatgattgtctagggaggaaagtgatttgtgaaggagggtgtggccaaccaacagtgtctgatacaagggaggtgctcaaggaatacctgacatatgattgcatgccctatctacataatggctttgtaag

SEQ ID NO: 172491 - DNA, 257 bp, Homo sapiens
cactgtgtttgtcaggatagtcttgatctcctgacctcgtgatccgcccgcctcgccctcccaaagtgctgggattacaggcatgagccaccgtgctggccaggaactaaatttcagtacttgaattgctaaatgttatgctatggactatggacagtaaaatattaatggtcatgcaagaatgaggtgaccattgttcattgagagattttagggggtttacaaactccctcaaattgtatggtaaagtttatacg

SEQ ID NO: 172492 - DNA, 405 bp, Homo sapiens
agggacaaaattttcacattccaacttgaacagggaagtggtaacaattgatttagataggagtatcagaatttcattttgctaaggccttttttgtgcttcttaatgcagtaacactttaggatagaatgaatattgttggtatcaccacttctgcaaatgtgctcactcttcttttctgtttattctagaaggtttactcacacactaaatatgggatgcaccagttttttatgctgcaagtttgaaataataccatttatttcaactacttaaaaaatatggggctaggtgcagtggctcatgcctgtaatcccagcactttgggaagctgagatgggaggattgcttgagcccacaagtttaagaccagcctgggcaaaattgtgagaccctgcctctgca

SEQ ID NO: 172493 - DNA, 473 bp, Homo sapiens
ccacactaacgccctcacgctcagctcttaggaagccacagctgggaccccacgtctccttactgaagaggctgacagttcttgaaggtggaggggactcagcagcaacactaaacaggctgggatgcaaatacctggtagcagtttagaagaaaaggctacctgccacttggtcccctgtccctttctgcatcctcggcgtgcacaggcacgcattctcagtacacaggctcacatggccgttccttggagatggggctgagcaggatctgacttctgtgtctccatcttctggcttttctgttgaggggtgggcactgagaactcattgtttgccaccatgctagtgcgtgctgcagaggcctcggttaatccctagagcggtggctcccaaactctactgcatgtaggatcacctgggatcactgaaaacagatgctggctcctgcccccagacagtctgatttaattgg

SEQ ID NO: 172494 - DNA, 439 bp, Homo sapiens
agcagcttgaaatcttgcccttagaggataatccttcttttaaggttttgttgctcctctgttaaagtatggctacctcagtgtagagttcgctcccctaaggatctctctgcatttataaacatactgaattcttctaccggctctctttcaaaccccaagctgggaagaaatgggccttcacatgcaaagccttgtttggtggtgagattggggtattggtgagcagtgaagagtgtgaaagagggagaaaacaaccaggatcattacaggaaagctgggcctttgaaggttgtaggtaccaagagggtacatgctgacagggacatcaagatgccaaagatgtgtttttaaaataaaaatacaggtttattaaagtacatctacatatagtaaagttcactctttcagagatactttctttttttaattctctttg

SEQ ID NO: 172495 - DNA, 260 bp, Homo sapiens
atgagacaatttgtaagcatgtgcttaaaggccaaagtggaatgttaagagcatgaaaatggctgcatggggtggtggtggacttacaagtgattttccaaaaaggtttccagcatcacacttaccattaccacctttgtattataaatgaaaatggggccgctgctggttggaggtgcccctgctgggaaggagaatgcttgctacaatatataaggctggcagtcatcataaacagggctccttggcttcagtgttgt

SEQ ID NO: 172496 - DNA, 410 bp, Homo sapiens
tggggtttcaccttttgccacacttaaagtatcattgggtctgttgagtcagaaggacaagtcatagagcatcttgagaccaccttgttgcccaggctggtctcaagcccctggattcaagctgtccacttgccttggcctcccaaagtgctgaaactacaggagtgagccaccacatccagcttccttatttcttctccaaagctcaactcacacattgctccccagaaaggttgcactgatgacaatggtttgtctcccctttctcttgatcctgtctgtgctcactcctctgccccatctttgccacactctgtttcctttcagagtcggtggcttccttctgtctcatccagtgaactgagagctccttaaggaacagagtcttactcttgtgtttcaccttcaat

SEQ ID NO: 172497 - DNA, 590 bp, Homo sapiens
tgcagctggtccaagtggaagaaatacagaatatctttttgaacttgcaaattctattaggaaccttgtgccagaagaagcagatgagcatcttttcgctttggaaaaattagtaaaggaacgtttagaagggaaacagaacctcaattgcatataatttagtcttcagagaattaacttcagtgcacaatgacaatatgatttggaaatacgtttacttaaagatcttatttttaatgtagtgaggatattatttaaacttttattttaactggaaatgtcctgaaacacatatttaaaatattgggatacagtgaaagaaaaattcaaattttaataacataaagatttcctaactttatgttattgaacacttactcactagaagtgagttctttagaaaaatacagtgaaggactcagttcagtcttgtttttatcagagtgataatcatcctgtttcacatcccaatactattttgaaattctaaacaattaaaccaaaattccaataaatataaggttatgccttcaatatattcctatacaattctgtacccatggtttaaaatacacaaaccttaaataaca

SEQ ID NO: 172498 - DNA, 499 bp, Homo sapiens
  misc_feature (308)..(308): n is a, c, g, or t
  misc_feature (353)..(353): n is a, c, g, or t
  misc_feature (416)..(416): n is a, c, g, or t
tagcctaacctgtgaattacattgaatatccaacggaaaataaattctattcctacacaaactcttctagaagttcagaagtttctattcccaaagaactggtgttaccttcctcaacttattttatagagctaacatgaccctggtccccaaatctgacaaggtaaaaatggaaaaattaaagactgatctcctttataaacacagatataaaaaccctaaacaaagtattgttaaaatttagcaacatataaaaaggatagtacatatgaccatcaggttatattaaaaaaaaaaaaaaaaaaaantgaaagtggaccgctgtctcataccatatgcaaaaaattactcanaatggatcaaagacttaagtgtgagagctaaaactctataactctgacattgtttgtctgtgnccccatcaaaatcttcattttgatttcccacatgtgtgggagggaccctggtggtcagtaatgaattcatgggggcagctccg

SEQ ID NO: 172499 - DNA, 208 bp, Homo sapiens
tggaacaaaaacagtgatgggaaagcccatcactatttcttcagttgttcttactaatagagcagtagcagttattgtcctcgtgcaaggtggccattttttagtcacagagtcttgtatccttctggtctgttttggtctgcacgtttttgtgttagactgccctaaggcattgtatgatttcatgaacaaacaatgaaaatggaat

SEQ ID NO: 172500 - DNA, 457 bp, Homo sapiens
tagtaacttatgagctctgattttgagtgcccggtaaatactgcatgcttaatacatattttttttttaattacaaggatggaagagatggactttaatccagactgaagaatttagggaagaaaaagaatcctctgcatggtaggattcattgtaactataagaatggtgaagttcgtgtggtaaacaatcgtggaaatctaacatcagtttctaatataggtcaatatcctacaacttaatctttgactcaggcagaactttcctgattcatcaagacctgctggaacgcctgattaaaagcattaaccaaacatgagcagagtagaatggatgaaataagtagtataacagggaaagtactgccttatttcttacaaagcgctagactataaagaaacgcatgaggcgtggtagctcatacctgtaatcccagcactttgggaggccgaggagg

SEQ ID NO: 172501 - DNA, 646 bp, Homo sapiens
cagacctggatactgatcccaaagtgttaaattcaactacatgctggagattagagatggtgccaataaaggacccagaaccaggatcttgattgctatagacttattaataatccaggtcaaagagagtgacacacactctctcaagacctggggtgagggagtctgtgttatctgcaaggccatttgaggctcagaaagtctctctttcctatagatatatgcatactttctgacatataggaatgtatcaggaatactcaaccatcacaggcatgttcctacctcagggcctttacatgtcctgtttactctgtctagaatgtccttctgtagatgacctggcttgcctcgtcacccttcaggtccttgctcaagtgtcatcttctcccctagttaaactaccccacaccctgtctgctttccttgcttatttttctccatagcattttaccatctcttacattagacatttttcttatttatttgtagtttataagcttcatgaggcaagtaactttgctttgtttcttgctgtatctccagtgcccagagcagtgcctggtatataataaatatttattgactgagtgaatgagttttacatggccttatgaattaacggtgagtctaaatgttataatca

SEQ ID NO: 172502 - DNA, 558 bp, Homo sapiens
tctgcatggcaaacccactattttcacttggattacttaaggttattttgagtgtcaaggagcagggagctgatgctactactgctaatgaaggatgaagagaaatgaggggtagaaggtgggtgctgaggaatggcagggcagagaggaattactaactgggatggttggaatagggatggcggctcctctgtaaagtggagtggttaatgaccacacgacctcgaatgtctaaccccgagattctttaagcctctattttcaagtgtgtctaacaccccctcattcaaagaccacctaggaaagtcagagggccccattaagcacatggactttgctatgggatggacttagggtggagtccctacctactctgctcctcacagggtccctctgaacttcaccttcctctgtaaaattgaagtcatagttacatggctgctggaacagttaaacaaacagagcatactaagagtacctagcacacaataaatgcccaacaaatgctaatattacaattcacaaaggaagcttactatttccaagcaatcgccaccc

SEQ ID NO: 172503 - DNA, 899 bp, Homo sapiens
tcaaatatcctgatgtttgaaacttaaagtggttcagcggtacagggggcagagagagagagagacaagaggcggtgtgtgtttggggtgtgggtaaagcaaatatggtgaaacatttacagttggtgagtctagaacaagtggtacaaggttattcattgtgctgttctttcagcttctttgcagactggatatttttttcaaagctaaaagggaaaaaggaaaaacagtaattgactgtaccctaattcctcattattaagcatactttttcagttatggcaatgcttcagaaatataaagacataccctcctttataaaggaaagaaaattattgcggaccccccccccccaaaaggttaacttaaagttctattaatgtaaccaatcataaggtgttttttacaccattttttattcacaactgtgttacaggcctttgtacaaccaattttaaattattgccccctgtttctccataagagtaaaacatattactccaaaaacacaatttcaaatgtaataaaataaagtgtgccgatttttttataacttccaaggttttcaagattaaccaatttgtgcgcgccttacataattaaccaataatctcggaataaacgggcaataaattggtggctgaaagtataggttcccccattctaaagaatatacaagacgggtaagtgacgtaccccaaataccggtcctgtggcaagtggccactctattgacaaacctctggccatgtgataaatccccggttaaaaagcctttgttggcgatacacccaattttgagcgcagtgaaaaacctttggtcgcgggccacacgggacaaattaaacctcttatatatgtgagcctgcaaatataacccctttggttatacctggaca

SEQ ID NO: 172504 - DNA, 153 bp, Homo sapiens
acggtggaaggggaagcaggcacatcttacctggcggcaggcgagagagagagagaaaaggaggaactgtcaaacgccaataaaacattggatctcatgagaactcactatcacaagaacagcgtgggggaaaccacctccatgatccactca

SEQ ID NO: 172505 - DNA, 398 bp, Homo sapiens
tcggaggaaggtcgtggggcgctgggggcccggcgccagcccgtcgcggtctttgggcgtccgctcctcgccgcccctcgccccctgcccggccggtcggtgctgagttcggtctccccggccccggcggagcggcgtgcggcggcgccccccagcggcagcctggggcccacgcccccgcaccgtgtaccccgtgcaccccgtgcaacccgtacgcccggcgcgccccgggtccgcacccagcgtcggtccggggccgaggctgcggctgcggggcccggggtgcagtgaggcgctggggccgccagggggtgccgctttccgggccgaggggctccgagggtggggaacgggacgggcggcggctcagcccagcagggggcgtgctccggcggccg

SEQ ID NO: 172506 - DNA, 419 bp, Homo sapiens
gtcctttgaagaagataataactaagttactgattctcaaagtgtggtctccagaccagcagtaacagcattatctgggaacttgttagaaaattcttaggtaccatcccagacttaccgagtcaaaaactcagcatgaagaaccaagcagtctgtgttttaacaagaattctgatgtacagaattctgatggcttagggcaggatttggaaacctttttctgtttgagtccatatagcaaatattttaggtttttaggccaaaaggcaaataaaaggataccatgttggttcttatataatgaaacagaaagacaaatgtccacaaaatttttattgatgaaattcaaaactttatttgtggacatagaaatttgaattttatataatattcacatatcatgaaatattaatcttcta

SEQ ID NO: 172507 - DNA, 523 bp, Homo sapiens
gaggagctgacagaaacggggggtgccagtggccagggcgggtggtgtctcagagctggtctcggaaacatcagttcctactgtgtagagagatctcaggttgggcgcagtgttggagtgtgggtatggagcccagcatccatgggaaggacacaaaaaataaagggaagtttcagaaaaaggtctgggcccagtacagtggctcatgcttgtactcccagcactttgggaggcagaggtgggtggagtgcttgagctcagtagcttgagaccagcctgggcaacatagagacctcatctctgtttaaaagaggagagatgggggagagagaggaagaaggagggagggaggacgggagggactctgaaggactatttgatttgaaatatgaccttcagaatatgtacactccagagacggtttcctgagtctgctagtgctgaggaggaagagcagtcagaaccaaatggggattgacttgtgaagacagggaattgttccttagggacagagaggaacctg

SEQ ID NO: 172508 - DNA, 513 bp, Homo sapiens
agaagtgcagggaagactattttagaagagctgggttaagtatcaaaagttttgcttacttgctatataaacaaaggcaattcttttaatccaagtttcagttttgtcatctaaaacaagggaggtacagcctctatgtccatctgagagggcagcttgagcattcagcatggaagcactttaataagccacagataaataagctgtaactgaaatcgaaagagtgctggaatatgagtcacaaaatcagaaactgaatcccagctctttaatctactatgtaaatttgagcaagttacctcactgaacctcagcccctacacctgcagaatgagatattccaaaatgactgtagattaaggaacatgataaaatagctggtgaaaagggagctctggacatagtcacaatcccagctctgccatgtgactttggccaagtcactcagtttccccaaacctctatttcaaaaatggggtgaggtattatacctatctcttaggaggtgttatt

SEQ ID NO: 172509 - DNA, 526 bp, Homo sapiens
tcaccacatccatgccaacatctactatttttttttgattttttgattatggccattcttgcaggagtaaggtggtatcacattgtggttttgatttgcatttccctaatcattagtgatgttgagcattttttcgtatgtttgttggccattttatatcttattttgagaattgtctattcacgtccttagcccactttttgatgggattgtttgtttttttcttactgatttgtttgagttcattgtagattctggatatcagtcctttgtcagaagtatacattgtgaaaactttctcccactctgagggttgtctatttactctgctgactgttccttttgctgtgcaaaagctctttagtttaattaagtcccaactatttatctttgtttttattgcatttgcttttgggttcttggtcatgaaatccttgcctaagccaatgtctaaaagggtttttccaacgttatcttctagaatttttatagtttcaggtcttaggttcaagtccttaatccatct

SEQ ID NO: 172510 - DNA, 705 bp, Homo sapiens
gctatggtaaaaaatcatatcaaaaagctacaacttttgaatatgaagaaatgcttttatattactgaatgcgaccaacaagtaggctgggaatccttctcctgatacctcactagaggcaacactctattttcttgcttttgtttgaatgggctggtcaactgagtgtctgatgaagtgctgagctgggcttctgtgagaaatccgcatataacctgaatatcccaaactctctggccaagcttctaactcttgtagccattcctgccaaatgataatagtaagttagcattttctaattcagtagcaataaagggtaagaaaagaaactgagtatagatactttcttttttttcttttttttgagatggagtcttgctctgttgccaggctggagtgcagtggcacaatctcagctcactgcaacctccacctcctgggttcaagcgattatcctgcctcagcctcccaagtagctgggactagaggcatgtgccaccacacccagctaatttttctatttttagtagagatgaaacatcttttaaatccaataaactcaatagaatggttggcagagtatactaaaaatttaattaagataaagcaaactttatattcactctctaagatatttaggttttggaattattttctcagtttccctttatgtatgtcacccagatgttaagtcatgatggggga

SEQ ID NO: 172511 - DNA, 286 bp, Homo sapiens
tgcagatggccatagggcattaggtggtggcaggacatgctgctggtgatcatgtggcagctgcagttgaaactgaggggctgtggctcagctgagaggccatgccacatggcggagcatagaaagagatgagcagagggtgacaaaaccaggcttgggcaacacccatgactgggggtggcagaaggaattaagccagtggaggagatggaaagcgagtggcccaaagtgggagaaccagtagagcattgttgcagaagtggcgagaaggaggtggtcactagtg

SEQ ID NO: 172512 - DNA, 600 bp, Homo sapiens
tgctttggggactagcatgctgaagggaggctctgagaacatcctgtttgctggcattaatagtcctgaggtttgctgtttccgatcttccccttgtgaatgatcagtgttgacataggaagctctgtactgattcccctcccttcacggaagcctggcacagaaagcatgcccatgactgcccaaccactggttataagggagcaccggactgaaaaaatggagcttgtcaactctgggaatgaggctgacaagaagctgctcccctggcacattccttgaatcttcctcctgcttaggcctgtgtcctctccatcccacccccatttcattgatggttccagggctgagtgcccagagtgaggggatgtgtcttaatgctgatacaaatgggtctttaaaggtatataacaggcagcaaaagccatgtgtcacttgggtacgaaggggatgtatgtcctctttctacttcagagttttcaggggactgtatcacaattttggagcactagcaaaacccacttctgactttatgctacatggttatgtgtttaagcagctgagccccaggtgatgcgtagcaggtgaggctcaaccctg

SEQ ID NO: 172513 - DNA, 130 bp, Homo sapiens
actgatatgcagtttacaaggattagataatatcataaaatgttgattctcaaatgacctataatttataatttaaagccatctcaatcaaaatcccaaatgacttttggaacttcacaattctgaactg

SEQ ID NO: 172514 - DNA, 192 bp, Homo sapiens
ggacaaggggcagtattgtaagctgtgctctgagatggggagcaggaatacagtcacttccttgcaggttctggtgaggaggttgagggggaggtggccacagcagctgcactgctagaagttccctgtggagtcctcaccctcacagggcattttatgctgtttttattgaagctgaggcagaagcgtctt

SEQ ID NO: 172515 - DNA, 642 bp, Homo sapiens
tagcaagagacttttggaaatgtccttcttagctttctcacctagctgtcaaagaaagctgctaaagagcatcagaatccgtgtggactgagtcaatgcacagtactcccagagatgcataaaggaggggttctcaaattgtattccaaggaaccttaacatttgcccacccacctaaaggtcaccaaggaggaagaaaaggcaaaacaaacaagacttcatctagagaagctagttccgtgttaatctggtcctctgttgggcatgtctacgattgtcatttgaaaaaaaaaattcttttgtcgttgttgtttttgttaagtttgaaaaccactgctaatctacagtttacattcatcaatcttccatcttttgtgttaggtggactgtcacaaatgtagcctaggattcctttccgtagcaaaccttttaatagaacatcatcattttcgtagccaatatttgaaaatgactacaaatcatgtgcctctcccacgtcctcagagaaagtgctgccgacagcctcattcatattagggtttttaatgtgaagttgccacctcctgagaacatgtcttttagttatttcaaagcctttccagcatcttctcagaaaacctcagcagtggagggcagcccagt

SEQ ID NO: 172516 - DNA, 625 bp, Homo sapiens
gcccacagtgatgctttatggtagaggtctctgtaatgcaacaaattgtccaggcataataaccaagcttttgtaatcaggcagagaatttcttctggctttgctttttctccttgatttctttccatcttgttgtcttttagcatctgactcgctttttccatgatctcctatgtccgaagggttccccgggtagtgtcctgtgatggagcgcatgggaggtcagcatgggttgatgttccctttgtgccgagcctccgtgggcaaccaatggcccgccaggctggaagaccaaagttctcagactctgaattggtggagggggttcctttttaagaacaaattggcttcaatcctgaatatagtccttgccttctttatcctccttatttaattctgcccgggctttcctgttttccacatgcatgtcatagtatccatttatggttttctcttaattcatgccatctaacctttagggaccagtggcaagggctcacatgaaacttagaagttactggagggagagtctcaatttgcttgatatagcacaggatgggcaggtggagggcacgtgcttgcttacagcaaattccctcgcataacctagatctgtgtcatttgg

SEQ ID NO: 172517 - DNA, 346 bp, Homo sapiens
gcgagaggctcccccccgtaatatgtaacacaaagaaattacaacactggaagtgttatgtggttttttattggtctaattaagttttttaaaaaggaaattcccaccacacatctagatcacaagttttcttccccacagtgacaactccacagcactgaggcactgttgacaatggtttgagccagggccattaaattgctttggaacttacatttacagtgttaccaccaactggacctacagatatttagctgggagtcccctgaggatggggtctatgtctagtattacaattactgctatggttaatagctaatttttttagagcactttatatgcctgg

SEQ ID NO: 172518 - DNA, 298 bp, Homo sapiens
gtcaaccctacctcaagctggaatcatgaagggctgcatgcttagactaagagtgaactagttttgcatcagctgggtaaatgagagacacaaggctttgattttggattaaggtaaacccagacttatggtgcttagccaaaggagatggaattttctggagcaagttactatcatcctaggctacaagcttctcctgctgataaattttcaaatacaatattcagcccacagttaaagatccatgcacatgaagatatgagattccatgaatgtaagtgactagaaataaaagaaa

SEQ ID NO: 172519 - DNA, 487 bp, Homo sapiens
ctatggatgtggcatcctcagagttggtttgtaaaccagctactgctgggatcatgatgtttgggatcacaccccagaccagagcacagcaacattaagaagggggcagcatattcagttgtgctgtaactgacttgacatgaggtggtggggatgactcctgcaaaggagaactaaacaccatgcatgaattaagaccctgtatttagcagacaagagtacttcatccaccaggaagaaaagtattaagcacagggatgatttctcagattctatctgtttggtcagcatctcccctgagattttgcaattcgctttgttttgattctgtgatcactgagcaagcttctgactgttacttcagtcaccccaggcaccttaatactcaaaaggggtatcttgggtcatagaaataaatatctcagttactgggacggtagtgcctctcattttataggaataaatttgttttgttgcatatacatca

SEQ ID NO: 172520 - DNA, 246 bp, Homo sapiens
acttctgacctcaagtgatccaccctcctgggtctcccaaaataatgggattacaggtgtgagccaccatgcccggccatttttggtggacctttttatggggctaaacgtctggtgtcttgtggctacagaagaccagtacttgcttgaggaggagacctgagaggtcagctgttctcaggtggagttttgcccgcattcccctttgtagttgcaggcatcacccccattgtccccacccttctg

SEQ ID NO: 172521 - DNA, 196 bp, Homo sapiens
cccagggaaagggtgatagccttgattacctgtcacatgcaaattgggtgttgactacttgacacctgctttctgaggttttacacatcttccaccataggaagagtcctttcctataaaccagagtctaattagaactagaagagttttcaacaagtaagaaatgtgggaaaaccaagaggagtcattgttcagt

SEQ ID NO: 172522 - DNA, 394 bp, Homo sapiens
gcaggcacattagttatccccaacacaaccacacatccctaggctgaaaacatcaacaaaaggaaggtactgtggccaggccaggctgggtgtgttgaagtaggggtgtcttgggaggagtgggcagaggaagagagggcaggatagttcacaacaagttcagacaaatgatgcaggaagtaagaggagcgcctgccaggcacccaggacaaaggagacaggcctgacccctggcaccttctccacatggcctgtttccacaactttgttctttgggggtgctgtagcccgaagcatgtccccactctgccctgtgcatgtgtgtgtgtgtgagtgtgtgtgtgtatgtgtgcatgtgtattatagacaaatgtaatggtgttgggcgataatt

SEQ ID NO: 172523 - DNA, 364 bp, Homo sapiens
gttcgctcagtcttggtgttaaagatgcctgagcagtaacaagtcactgtacattaggaacatttctgtgataaatgtgagagataaaaaccaaaatgcagtaaaaaatatgacctaagataattaagaaaatagaacagaacccaccaacagttataaactataaattggaaaactcgaacatcagcacagagatttgggaagttataacatccatgaaacaagaacaagatgctctggagagaacacaggaaaaaaagaaaagagttcctggaaattaaaaaaaaaaatcttgacaaaccaaaacattcaatagaagggctggaagattaagtcaagagactctcccagaaagtagaatgaa

SEQ ID NO: 172524 - DNA, 166 bp, Homo sapiens
agaaatcaggtgggagccacgaagaacagcaggcaggagccaggaaagctgcaggggcagggttcccagagactccctagactctggagatggcaccgcaggcttctggtacctctcatgccaggagatgcttcctcacagcccagaatgagtagctggcaacaat

SEQ ID NO: 172525 - DNA, 119 bp, Homo sapiens
tgtcttacccctcagagagtcccagaagacagaagcacagggacaaatgaaacccttgcccttttcttccccaacctaaattctgattcctcctctttaggtgatctccttttcttaag

SEQ ID NO: 172526 - DNA, 104 bp, Homo sapiens
atagcttatgccctccttactttctttgctgtggcaaaggacttaatgactagtctcctagtatatatttgataagatgggatagatgcataataggggtcact

SEQ ID NO: 172527 - DNA, 460 bp, Homo sapiens
agtagacagggtcttgctctgttgcccatgctggagtgcaatggcatgatcatggcttactacagcctcaacttcctgggtaggtaggactacaggcatgtaccaccacacctggctaatttttgtttttattttttgtagagatgaggttttgccgtgttgcccaggctggtctcaaactcctggcctcaagcaacacacctgcctcagcctcccaaagtgttgggattacaggcgttagccattgcacccagtctcttttttttctttctgttcctcagacttgataatttcaattgctctattttgaagtctgctgatgctttattttacctgctcaaatatgcttttgaatcattctagtaaggttttcacttcagttattgtacttttcagctctggaattttggggtttcttttcttgttttctagctttccatcgattatttccattttgttc

SEQ ID NO: 172528 - DNA, 249 bp, Homo sapiens
accgttcgtgcagggatgcctgtatgccctgtgctccaaagtatgtcaccacatcagcctccaggggagaagcaattaaaggacagttctcactgcagaactgaagcccagttcctgagatacgaaagctaagtgaaaccattctggtgtggagtatgttattcagtttacttcttggctagaaacaaagaggttaaaattgagaacacaggattcttcacatcaggagatgtccgaggcccttccttc

SEQ ID NO: 172529 - DNA, 513 bp, Homo sapiens
atcttaaaaaactagagaaacaaagctgcagtcctagctactcaggaggctgaggcaggaagactgcttgagcccaggagttggaggctatgtgaaggtggaggctatgtggagttggaggctataagtgaagctatgatcgtgcttgtgaatagccactgcattccagcctggccacataccatgtctcttttaaaaaaaaaagaaagaaaacaaaaagtagaactcagggctcattaaacagggtaaatctgaaactaaaaattgccattcactagactaaaaggtcaaagaaaactcaatcaatttataaattactccaaagtgggccacaatcaagtgaggcactagggccagttcaatgaggtctcaatcatctttgtatctgcaaagcctagcataatgctaacaattaggaggaaaagaattacgtaaaaatgaaaggctgggcccggtggctcacgcctgtaatcccagcactttactattcttttctacttttctgtaattaac

SEQ ID NO: 172530 - DNA, 265 bp, Homo sapiens
tccgtctcaaaaaaaaaattgtctttgggttttagcagtttgattatgagtctggacatgaatttctttgtattttgtctgattcaagtttgctaagcttttggagtctgtagagttaatatgttttgctaaatttgggaagttttcaggcagtattttttctttcttttttttttttttaaatcgagatctgagaaaggccatattttaaataatgtttttaaagaataaaaatactctttctcctatccttatgggatttttt

SEQ ID NO: 172531 - DNA, 1120 bp, Homo sapiens
gaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctcggtgcagcggactcgagcccagcgtgggctacacattagggtttcatcccagaaacataacggcgcatcaggtgtgaacaaaacacaaggggggcgccgaaggaaaccccgagggccacactctgggacccgttttggaacagggccaaaggagggtaaaaagagaggggcgacaaaaagagagggaaagcagggcagagagcacacttgggcacagaaaccagagagccgaaaaagtgggagaccgcttgaccacaacgacgcgcg

SEQ ID NO: 172532 - DNA, 382 bp, Homo sapiens
catttaatgcatgcagacgaggctgagtttgggaaaagagaagtaattagcccaaaggcagagttaggaaaagaccaggacgaaaacccagaccactgggtgacctgataaacatttcggttggaaagactcctcccacctgatgccctgcttatgcctggggtacaggcaagttaactacaaccaaaacctagggattcagaaacagcaggagcccgcctgtcagaactgcgccctcatcaggctggtcttcaaaataacttgaggtcaagccagtttgagattctgcacagggagctagagctggatccctgaactcccaaatccacatccaaaaccaacactgcaatcaagttcacttttccagcacttttgatataca

SEQ ID NO: 172533 - DNA, 303 bp, Homo sapiens
gcacctactgtatgtcaggtccaagaccctaaagatgtaaagatgaataaggtggtgaccctgccttccagtttccacagaggtggggaatatggataaaagcagacaaagccattgccatgggataagggcagagaatagcatgtgcaaattatagaaggtgagggataatataccattttccagaaactgatggttcaatgaggctaaagcatggagttcaagaaaggaaaccagatgagattaactgcaatgtggttctcaaacttaaatgtgcataaaaactggccttgttggctgggc

SEQ ID NO: 172534 - DNA, 293 bp, Homo sapiens
gttcaggaggtgtttgcactcacaccattctactaaagaagctccaatcagggactctgttgacctgttctttggcaaacctaatgaccaattcctagtcggcctaactacgatagctagcagcttttaacaagctgacctcttccttctttctgagattttttttttttttcactaggctgtctataccacatcctctcttggttttctcctacctcattcctgatcagttttcttcattggtgcttccttgttttgggaggaaatcgtgggactctttcacctcagcacag

SEQ ID NO: 172535 - DNA, 307 bp, Homo sapiens
attttttagctccaaggtttgattaaatttttatgatatctcttttgttgaatttctcattcagataatgaactgttttcctaatttcattgaattgtctatctgtattctcttatatctgagttttcttaaggtcactattttgaattcctttttaggcaatttgtaaacttccctttctggggaggggggaaggtcagttgcctgagaattattatgttcctttggtggtatcatgtttcctggctttttcttcttcctttttttgggggaggaggggagtggggcagtgtcccattgtcaccca

SEQ ID NO: 172536 - DNA, 649 bp, Homo sapiens
tgcccttgtgacctgctcactggaaaggaagaaatgaccgagggagaagggagggcatttgaggggagaagaagaggatggagaaaaaaactggatcatctcgtgacatggaaagaaaggtctgagctctgacgatcccctcacgtgattataggcatgaggactcactcttcgaattgtttgaaaattgaatggactggctcacaccttctgaaatttcttggaagctctggagtaactattccactaaagaacagcgtgtttttggctgaaatctgtgactgtttgtttttgagttattttaatctctgtgtcaagcatgaaaacctcagcagcctgggatttataattagatcccactggcatgccctctcacctctcaaacatgccacagtgctttggctctctccttgtgcaaacctccctttgatatttttggatatcgataccaagtgtatctgcatattttaaccaactgatatgcatatcctgtgatctgaggcattcgctcaatgtggggcatcaggccagctgtgaacttcctttaaaatttattttgtgtcaaatgattccctaatgctatagctcccttgaactgctagatttatgaaaattctgcacaacacatagctcagagaaaaaaaaaaaa

SEQ ID NO: 172537 - DNA, 280 bp, Homo sapiens
caaggccctatctcaaaaacaaacaaacaaaaaacccccaaaaaaccccaaagcaaaaaacacatctttggaactgtttaatgcatttagggagcatggagtccttatggtggtctgttatgggcttgaggcttcaccaagcccctgtgaaaactctgagtgctgtctccatggcggggttgcagtcagtagcaagataacaaaactcagatgggaaggacaaagcgcaacatggacgctcacgagtccagccaaattctgagtgcttaagaagaggcct

SEQ ID NO: 172538 - DNA, 308 bp, Homo sapiens
ggaactgaattttaaattttacttagtttaagtttcagtagctacatgtgagtaagtggccaccatgttgaacaatgcagatgtataggaatccctttcatccttcaaaactcattcagacttctggttttcagtccagcatgtaagaccttagaagtcaccattccatcctaataacaagtaaaaagctaaacaaacttaaaaatacttaactctttgtatattttttggaaaagtgaggttatggggcaaactgcatttcccaaactggagagacagacaggtagatacagagaattacagaatta

SEQ ID NO: 172539 - DNA, 695 bp, Homo sapiens
tgtcttcttctgagccctccaaactgttccaaactctgcctgttacccagttccaaagtcacttctacattttctggtattttttcagcaacaccccactcctggtaccagtttactgtgttagtccattttcatgctgctgataaagacataccccagattgggaagaaaaaatgttcatttggacttacagttccacatggctggggaggcctcagaatcatggtgggaggcaaaaggcacttcttacatggtggcagcaagagaaaatgaggaagaagcaaaagtggaaacccctgataaactcatcagatcttgtgagacttattatctgtcagaagaatagcacaggaaagaccagccgccatgactcaaataccacctcctgggtccatcctgtgacacatggaattctgggagataaaattcaagttgagatttgggtggggatacatagctaaaccatatcagaacctttgtatataaaaggaacattgatagaggatgatgaaatcataggaaagaccgacagtttctgaaggactaattctataaagtctgctgtttaagagttcttaatagtatttttttaatgaagtgatttaagttgcatggttaatgatcaaaacttctggtagaggctgggcacggtggctcacgcctgtaatcccagcattttgggaggctgaggctgg

SEQ ID NO: 172540 - DNA, 388 bp, Homo sapiens
atttagtacaggtttctcgggcacctgaatgctatgctatgcataacaggcagtggggatgagcaatgagcaaaacagacaaaatccctgtagagcttgcatcttagtgggagaaataaaagtatactaggtcagacggtgataagtgctatgaagaaaagtgagacaaggtaaagaagttggagagtgactagggatggagggggttcagttttagtaatgcgggtaatggtcaggggtaggcttcacggaggtaagggagcttgctgtggggatgtctggcggaagagtctgagccagagggatactgtgaatgcaaagaccctgaggcaggggtatctttggcttgctgtggagcagcaagaagtccaacatgcctcagaggctt

SEQ ID NO: 172541 - DNA, 698 bp, Homo sapiens
ggctaatttttgtatttttagtagagacagggtttcaccacgttggccaggctggtcttgaactcctgacctcaggtgatccgcctgcctcggcctcccaaagttctgggattacaggcgtgagccaccgcaccctgtgtggtagagtacttttacagatatcatttcattttattctgatggcccagggaaggataggcattgttgtgcccactttaaacagatgaagggactaaagccacaaatggctaagtgacatatccaaattagtgaagtagctctttgggtgaggaaactggccctgaccttgaatttgggccttcagacaccaactccaagcctgtttcccttcatcatgctgcctcaagtttgttggtctttttccagtttctttatatggatgtgtgagttcaacaagttctgttcgtgaagccactaatatttagatataaaatagagccctggtgccaagcagttattgcatctccctggaaatgatcactcaagtctacagcaaagaaaagattaaagttgtttactgagatcacctaaactttaaaggaccatccagccacagttgagtaaaggtcactagtaacatgtcaccagccacctggtttttttgttgttgttgttgttgttttttaagcttggttaaaagctactgtttaactgaggagagctaagcaggtacttct

SEQ ID NO: 172542 - DNA, 675 bp, Homo sapiens
gagtacagtggtgcagtttcagctcactgcaacctctgcctccctggttcaaatgattctcctgcctcagcctcccaagtagctgggattacaggcgtgagccaccgcaccctgtgtggtagagtacttttacagatatcatttcattttattctgatggcccagggaaggataggcattgttgtgcccactttaaacagatgaagggactaaagccacaaatggctaagtgacatatccaaattagtgaagtagctctttgggtgaggaaactggccctgaccttgaatttgggccttcagacaccaactccaagcctgtttcccttcatcatgctgcctcaagtttgttggtctttttccagtttctttatatggatgtgtgagttcaacaagttctgttcgtgaagccactaatatttagatataaaatagagccctggtgccaagcagttattgcatctccctggaaatgatcactcaagtctacagcaaagaaaagattaaagttgtttactgagatcacctaaactttaaaggaccatccagccacagttgagtaaaggtcactagtaacatgtcaccagccacctggtttttttgttgttgttgttgttgttttttaagcttggttaaaagctactgtttaactgaggagagctaagcaggtacttct

SEQ ID NO: 172543 - DNA, 615 bp, Homo sapiens
tattcacatgcccaacactggggttagtggtattcactgtgtatgtgacacaccagcatgggttagtggtattcctccatgatgtgacaacatcggtatgggtcagtggtattctgctgtgtatgtgacacaccagtttggattagtgggtattctgccatgcatatgacactggtatgggttagtggtatttgctatgtatttgaacacactggtatgggacttcggccctgagcactagtgacactttgagctggatgagttgtgggtttgagctgatgagccgtgcccccactgctacccgctacgtgccaggagcacaccccccataaatgtctccagacagctccagatatttcctgggtatccaagtcgccctggcagagaaacactgcatgagacacggcgttagggtctggtgggagactcaccacagtgccaaggtggctgcagtttgcttgtgacatgggcgtgtatctgagtgtgaaggaagctggtttttgtgagctgcctcccgagctcagaggtgacagtgggcactttccccacagagacccctgaagttgttccttggagaacaaagtggtgaggggcggggattccagaccttgaggc

SEQ ID NO: 172544 - DNA, 742 bp, Homo sapiens
cgcgatggcttacgcctgtaatcccagcactttgggaggctgcggtgggtggatcacttgaggtcaagagtttgagacaagcctggccaacatggtgaaactccatctctactgaaaaatacaaaaataagccgggcatggtggcgcacacctatagtcccagcttctggggagtctgaggtaggagaatcacttgaacccaggaggcagaggttgcagtgagctgaggtcatgccactgcactctagcctgggtgacagagcgagactccatctcaaaataaacaaaacaataacaataacaaaatcagcatgtactgggcaccgtggatacgccaggtactgctctatcccgtttacatattgtgacttagtaaatgcccacaacccagtgagattgatattattattgcccccattttatagatgtggaagctgaggcccaggtcccttccatgggcaatggcgcactgggctacaggctacttagctactctatgataagatgataatgtgcactgtttactgagcacctcttatgtgccaggcactgctcatagaattgccacacatggccaataatccccattttacatgcaaagttatgataggagagggggaagaggggaaagggaatggagcaacaggatctggggcaatgggacaataggggatgggatgtgtctgggtgagacccaaggtggggtatggatggggagagctcctgggtctggggcaagagg

SEQ ID NO: 172545 - DNA, 595 bp, Homo sapiens
cttacagatcgagctgtttttcttgaataaacactcgtcagagtgctgtaagcctttagttaatttccagaattttgagaaagttggttatttgacagtttttgctagggttttcattgcttttatggaagagtggattattagaggtcttactctaccattctggtatggaggtgagatctctttaaaaatgtgtatgttgaatgaggatgtcattctttatgcatgatgacaacgtctgattggtaacaccttggttacaaggtgtacccatgctggtgggcagcatcaagttacttctcatggtccacccacagattaagatccttaccacatattgtttcagccaagtgtggtttcttcctggacagtctgcagctctctgtgacattagcttctttctgtgttgtggtatcacgctatgtcttagggagctatggtatagagtgttgctacatgatatacaattaaagtcagcttttactttgcagttactttgtagtcataccaaatgtagcatagttactctaccaccaattcttctaatctgaggcaacactgtacttctaatctgcagtttccttgtgaaagaaaa

SEQ ID NO: 172546 - DNA, 622 bp, Homo sapiens
cgtccaagcaacagatgcccgcttctgtgactccaccccttacggaaagtctatgggactctctgaaatgtatgagtgatactgttagaaagcggcaagaaaatgaaaagaaaacgtggatgttttccatatttgagttgatgcaggctggagacaacagctgccagagctgcaaggcagaacaccctgagaagtggaaccggaggatccaggcgcctgttgaagggataaatgagagccgtggcgtgtggatgggactctttctgtcttccgtttggctgaagctccaaacgccaggagtaacccagtgggtagcaagcacccttccctccacctctgcaggaattgcaaaaagcaatggtaaaaaaaattggtttgtgatccttaccccagtgctcaaggaggttggagaagctgaaagagaggactggttttgatatggtttggatttgtgtccccacccaaatctcatgtcaaatggtaatccccagtgttggaggagggactggtgggaggtgattggatcatgggggcgaatttccccttgctgttctcgtgatagtgagtgagttctcatcagatctgattgcttagaagtgtgtagtgctggccgggtgcggtg

SEQ ID NO: 172547 - DNA, 259 bp, Homo sapiens
agtctttgtccttaatggctagatgattatttctcacagcagtgctttagaggccaggagattttgcaagttctgtgaagttctgtgtccttcagttctaaccttaaatgttgtaagagggatggaggagaatctttcaagttgaacaaactgccgcttgtctgtctagcgttaggagacatttgtccactgtctcatcccattgtcttcaaattgaaggctgtatatttaactgtctttttgtagcactcatattctg

SEQ ID NO: 172548 - DNA, 666 bp, Homo sapiens
acaaaagattgttttgaattttcaaatttaaattagtggacttcctaaactttgggataatttcggtaaatgttttttgcttcaaaattacaaacttctatacaattataaatgtaattttcacctaacttatttaatttgagataaattcaaagatatcatgaatagttattataacttttaactacactatatttgagatacttatttttataacactttaagaaaaaaattacaggtcatgcattattcccacttctttttattgttaatttatctcatttataaaaagtgatctctgtgttctgggggaaaaaaagctttcactatgacattatatccattttctctcttcaataaatttataaaattttcacagttaagtgtaacttattcaaaaaatgttagttaacaagatttttaagtacattttattagcaaagttcctagaatcacttagatccctaaatttaatttcctagttagttactgaaaggattacttaactactataatcagatacctttacaacatcaacaaaatcaatggaacaaaatgtcaaaatagaagaaatctgtcatgtttctgctgggagccacttattcctatatattctaatataaaaagatgatgtaaaacaaaataaacagttactggatttatcat

SEQ ID NO: 172549 - DNA, 315 bp, Homo sapiens
gagtgcaaacggtcttgagactgagaggtctgggaaacactggtttagcctccagtctgcaggggacaggtgtgaaagtcagctcccaagtcaaccacatttagtcaaaatgctcacgatgcctcaggaaggcacagtgtagcaaacacactctggcttctggggagtcctggtgaccccaagcctttagtcccagagatggctgctgtttacagtgttggactctagacactggccagctgtgcggagtctgatcattttggggaactatgagatgttcacgccgtaggtgtcgttattgaccggaggagctcc

SEQ ID NO: 172550 - DNA, 552 bp, Homo sapiens
tgaaacttgggctgagcaatgctccaccatttccgtttcgactgtgggtctctttcttgcctctactgggaatgagaaacaggagttcagaggttcctggtctgggaagacatacaacaagcacatgggttatgggaagcctcctcctgctaatgtgtatttatactttgtaagctctgattcatccaagcattggaacagaaatctgcttcctgaggttctgtttttaaatagatagtttgcaaaaacaacaattatttttcttaacattttttttccaccccacaagcagctaaacatcccagctcagggtatgtcagtctccagcaatgccaacaaacagcttggttatctgagctagaagggtgccctgaggcagttctctacagttctggccccagaagtcttaaaaacaaagtttagaaaccattagggcaatcttgttgcatcacttcaaatccacgaggtatttcggggtctattaaaaataacgaatttccgtttgcgaaccattgccttccaatggctgttaaaataaaactaagagcaggt

SEQ ID NO: 172551 - DNA, 462 bp, Homo sapiens
tgtcctgggcaaaggacctgagatagatcaatgctattccagccaccctggctttatgttaatgtctactaaaaagtagagtttaggtattgtaggcacacaaatttaaactatttgaaagctatcatattcttaaaaattatgaaattcaaaatccctttttttttcttactggacttgtgagcatatgttaaagccataggtactcaaaaaaaaaagtgggtgaatatttaaaggggaaaaagtctcatgatggcagacaggggaagtactgttaatacacaagacaggattgatttgaacgggactcctcttgtaaccaaactgaatgagacctggagaaatcaaatcagcaaacagctatatcaattttagcaggaggtctctggcataaaacaatacttaggaatgaatctcaacattttcaatttcaggccaagtatattagcctctgcattatct

SEQ ID NO: 172552 - DNA, 262 bp, Homo sapiens
gtgattgcatctaatcaggactttttctgaaactgctgccaggaaaatgtgtgctaggaaggttaccttctgcagctggacttttatgatgcactggattatcatggccttagatataccatcagggcatggagtggcaacagtgctttgctgtcttgacgcatctcaggtagaggatctcttagggagctttctgattgaatcccacgcccattttgagggaagggaatgggccatgggtctcatccctgcctagcgctgc

SEQ ID NO: 172553 - DNA, 647 bp, Homo sapiens
gctgcgcttggataacaagtaattcaacgcacgcacttaacagaaatgttaaactataacaagcaccatttgaggattaacaggaacatttttttgaagatttcaaacgaactcgactttcagtataattgtacctaaagtatttataaacagctcatcggagcctctatttgtcatagacttttgagttgattgtgggaccacataataggaccatttttttttggtctttaaaatggtggtaaatctctgtatgcacttggcttttttattaaacgtactccaaggtgagtcttgactctttagtgtaggacaagattgtacactaacaccagcatggacctgctttctcatgtgtgtctgaaatgtgagccacgtagtgtcggcctgctgtgaagttaacattgccaggacgattcttctacagaaataattctcaatttttttccagcatttagtagtgaacgatcatcaatccatcactggtaatacatttctggttcaatataacttaaggatgttctagtagtgcgtgaatggctgcaagttagtaagtttgttttgacattgtttaaatatgtaatgttaagcttaggtttaaaaaagtaaagctggtaaactgggtctttgtcatttgctttaaaaaa

SEQ ID NO: 172554 - DNA, 169 bp, Homo sapiens
ggaggcatttcaaagaagaactgacattgtgacagattagaggtaaagagtagaaggacacagtctgttagattcctttatgcattcattcaacaaatattaagccactccaaagtaccaggcactgtcctaagctctgaggatttggttataaataagacagttatgt

SEQ ID NO: 172555 - DNA, 524 bp, Homo sapiens
acgaaaccagctttctcttaaggattacccacatgcagtccacgcaccctcacctccattcactcccaaaaccactgcagttgggtgtcccctctcgagtccaaggagatggccttggtcaaggtcaccaaaaaccttcatgtttccaatgacgataaacatttctgtcctcctctctccaacctctcagctcctagagccctgcttggctcatcttattctgcttttcctcttgcggctcctcctctagccaaacagaaaacctcagggctcctcagtgttcttcctctaagctcttttccctggtaagctcctccacacccacaacctgaaatatcatctagaagaatgaacgctagtgactcccaaatgcggaggtcctaacagtgacaacaataagtgctatgtaagtattagctctcacgtgccaggcactgttcaaagaactgctttatgtcccctaacaacacgaggtggatactatcattacttccactttcagatgaagaaacggaggcacaaaa

SEQ ID NO: 172556 - DNA, 448 bp, Homo sapiens
ctacggtgtcttccttcgcaggtctgtccccccaggcagaaggattccagcccagggatcccccatcccaccctgactgcatcctgagaaggggggacgccacttcgggaaggttgttggggcagcacaggccctggggccctgctctgtgaccttgggcggccccctctgtctctctaggcctgtatgcaccactggcaaagggggcagggcccaagtctactctaaaagctcccctttctctccagaagctttggagtctcccaaaatgcctgctgggtctctgcaggactggcacctgtcaccggaacctgtctgggagggacgagaacacgctttgcaagaggaagctctgcctcacagagccctgggctcactcagggaccctggccagcagctgcttcctctccccacagcggagagagacccaagggtcccagggcggatg

SEQ ID NO: 172557 - DNA, 292 bp, Homo sapiens
gtaactgactgactgaaggacaactgctcttatgcaaactcctctgtgggtctttcaagtttatttctggtgaaaggtcccactgtggagaggaggaggccttcaggctatgcctctaaggccttggaaacatcagagaccacgataggtcactgggaaaaaactaaaggcagatacacccctctgcccacctccctgccagtccctttgttaatgcattgtaagtcaggtgaaaataagtgagaaaaggggatctgcctaaaaaatgaaacagcaggccaggcgcagtggc

SEQ ID NO: 172558 - DNA, 780 bp, Homo sapiens
cccactccccagggctgcctggggtcacccccaaatcttgctcccaaggcctgcctctgggggcccaggcccagaggccagaggccgcctcagcaatcctgaagcagacagcagatggcagccttggatcagccctttctggctgtttccaggctccagctgaaggtggaagggtggttctgctgtgttctcttccttggaatttctgggaaaaccacgagcgggactagaacccaaaatcttcattccatcgtcaatgaaagccaaagacacctggaccttggaaacagtctgagccttcctgatggagagcggatgaggaccggagggaaagggacaccggactttggaaacagtctaagccttcccgatggagagtggatgaggaccggagagaaagggccctgagaaagtaggctgctgccctggatcccagacccaaccagagtggcacagagtcctccagaacagagcgtgcccccgggagagccaccggccctgctgcacctgctggggtgtccctgctgttcaccctccctgggctcctggaccacagcggggcagagtggaggaggaggtgtgcacagaggcaccattgttgtgggaagcagtttgttggtgaggagggagctgcggtcctgcatgacatccacacgtgtgacatccacacgcgtgaaatcagcacacacgcgtgacatccacacgcgtgacacccacatgcgtgacaccagcacacacgtgacatccacgcacatgacatcagcacacacgtgtgacatc

SEQ ID NO: 172559 - DNA, 248 bp, Homo sapiens
ttcaagttcccaatcattctcggcattctataatcacaggcctcagagagtaatgctcccaatggccctcaaattatggtttccttaggaggctattaaatcttgatttctgagaggaaaattggggattttgtgttttcccttttagacttgagtgttctgttactgtggatgagctcttctagaaacttccaagcagtttcaaaggggatttagatgtcatcaggaagtgtggttgacaacgtgat

SEQ ID NO: 172560 - DNA, 333 bp, Homo sapiens
agaagcattaagtgtgataatatatcttatgctataataaggagctagtgtacaattttgatcagggaggaaataggcaatgtgggctagaaatcttaccatgatgttgtaatcttacagttcattttcctttaaataaaagaaaaactttcattgaaggatttttcacaaacaccaccatcataggtttgtgcttttctcgttttgatcaatgtttttatgtagtaaagcaaaatgtatgctatagatgtgctttacttttttaattgtaaaactattttataacacttgaatgtttgaggatagacattgtggttattttaaatagcttgg

SEQ ID NO: 172561 - DNA, 226 bp, Homo sapiens
acaaattagagagatgacgcacctgaataggaaagataaggcctaagagtatgtgagatacagtaagttcctaaactaggataatgagagtgaaacgtaagaaataaaacagaaggaaagtcggtaagacttgaacagccacagaatataagaaaattggtttatagggtgatgagccggtcatgctttctaaccctgaaccttaattttgaaatcccaggccagg

SEQ ID NO: 172562 - DNA, 127 bp, Homo sapiens
gagtctacagtagatatagagaaaacatttgttagacttcatcaatcattcataataaaaaaaaaatcttagcaaatttgcaataaatgatggtttcttccatccaataaagggcatttactaacaa

SEQ ID NO: 172563 - DNA, 268 bp, Homo sapiens
tggccccggcttgaggggtcttcccgttctcttcatccctgtgccagtttctgaattgttaggccagggttggaatcccacctctgagtgatttcaggcaagtgtcttgttctctggttctccatttctgcacctgaaaaatgaaaacaatggtttctcttcatgaagggagttcctgacccaccggttaccagacagacggtggctatgatgattgttattctccaaaggcccttctctaggacccacagcctccagaccccagtag

SEQ ID NO: 172564 - DNA, 151 bp, Homo sapiens
cagcggccgtttcagcaggtgctgcagttgttcagatggaaagtgggatgccctgggccaggtttggcagtggaggcggacacagcagctggattacagacatttggcaccaggacatgttgatgaggaaaagggcagaccagggatgact

SEQ ID NO: 172565 - DNA, 502 bp, Homo sapiens
cagcggtccagatgtaacacacaggggcatgggggtggcagacctgggggtcaggcattggccctgatcatctctggaaggaatgaccctaaatggagcgagaagcagagcttagacacctggcggccacttcctgctcaccttaggcaagcgccttcctctttggctgtagttttgtgcctccacaagctcttagtcctggagtcagccagatctgaggttccatccaggtgtgatactgatgcttagcctcaggctagtgccttcaccgctaactgttgttcgtgaaaggagcgctgctcacctgagaggagggctggaggaagtgagagaggcagagtaggagtttatccagcccagtttctttatcgacttaattttctttgccccccttcttggagggagtgagggtgaagaagggaggagggtatcgacccgctaatgagcacttttatttacagaacgctttttatatagtccttctggacacctacagcagccc

SEQ ID NO: 172566 - DNA, 107 bp, Homo sapiens
ggatctgggtgggtatctgcttccttccccaaataagcccatctagggctaggctgaaagtgactcacttatgcagaggccaccaaaccatgaagcacaggcctgca

SEQ ID NO: 172567 - DNA, 508 bp, Homo sapiens
gacacacttcgtccactctgatttcagaagaagtgtttgggcactcggcggccgagagaccaacaaatgacccaaagggccacagggaaaggataagatgtggcatctcccgttaagtcaggcccacagaaggagcctgaatcaacggagctgctttcggggttccaggtaaggagagatcccctattacctgcctcctgctgatgctacccagcaagagctccctccccatatgcagaactccccatgatgtgatctaatactttcatctcagaactaagaaagctctttaaactcatgaaaagatcaacatctttagggactagctgaccagttcacttgtactcaaccactatctttaccaaaaggcggatttctttttctttaagtagggacagagtttcaccatgttggccaagctggtcttgaactcctgacctcaagtgatctgccagccctggcctcccaaagtgttgggattacaggcgtgagccactatgcccggctt

SEQ ID NO: 172568 - DNA, 537 bp, Homo sapiens
gagccacctagatagtatgtataatgacagatagaaatggtagatagctggggttgtgtgggactgttttctgctaattccatgccagtcagttacaaaagcattacctgttaactagggaagtcagtaaagttcaactacaagataccagcttaacaggttcaagtgctacacagttttaccagaggaaggatgttaaaggagtttagaggtctgaaaatagcctaaatgtcaagagaaaataatgtattcttgttaaataagtttccaatagatgaatttcagattgttacaaatacaatttcagactgttatacatacacacactattaaaaagcgataattttaaaatgcatattccaaggtatattcatataattttacaatgcatatgcaaatgttatgaaccaagctttaaaatatcaaagattaagccaagttccagactccactaggcccacaagcagggcaggtgaattctaactcctccattttcagcttttcctgctacttccaataaactgaacatcatcctct

SEQ ID NO: 172569 - DNA, 318 bp, Homo sapiens
tgctgagactacaggcatgagccgccatgcctggccccttaatccgatgtgtttttaaactagaagagcatcgacacatacacataaatctcacggttaactaaataaccgtataactaaaatgtcatactttaaactatttaagaatgacatgagctttcttaaaacccatgaaacttgtacccaagctaagtatcattgactttcccagctcagtagctgggtttcatcacttaatatgctccctctactctttctgtccttgattgaatcagataagcatgtacaaacattgagccacaggagagccattaaaaa

SEQ ID NO: 172570 - DNA, 686 bp, Homo sapiens
gacttaagtgaagttagtatttttttttcttaaatgtgtagtagaattcaccagtgtaaccactgggattggccttcacatttggagaagattttaaattactgattactgataaaataaaaatattttatcagtatagatattcggatttttcacttcttctttgaactcattttagaagtttgcatctttctgggaacgtgtacatttcatccaattatctaatgtgagtttttgtaattgtcccttaaaattcttttaatttatggttagtctgtagtcatgtctcttattcttgattttatgattggctgcttgtctctccctccctctctcccaccttccttccttcctttctcttcttcccctcaccccaaatcctcagtctacttagaagtttgtcaattttgttaccctttcaagaagttgttgctttattttagtttttctgttgcgttttatattatgttttattaatttctgctcttgaatttcctttctttcttccctttatttttttccctcctttagcttcttgaggtaaaaactatgattattgattttagatctttcttcttttgaatctaggcatttaaagctgtaaatttccctctaggcactgacttaattgcatatcatactttttgacatgttgtactttctattttcattcagttagagatatt

SEQ ID NO: 172571 - DNA, 503 bp, Homo sapiens
cagggatgctgtcaccaacacagaagagtgaccctccaaccttagcctgtccacttctctgtcagtcaacatagcccagcaaccatcaggccatacaggcagaagatggctttgctgtcacataaacaactgtatgtttttccctcactgtgggtacccagggaaagctgtggacagtggcatgctctctacctccctgtttgcactgtaacctgccaaatggtagattttaggacttgtcattggaacaggaattaatacgaaaacatccaaaactccatgaagcctactcaccctattccttaaacactctccaagaggaccttcccctccctagcaacttggtaagacacttgtcaccccagcctgaggtcaaagaagagcagttcttctcttcttcctcaattcatagtctccctttcctggttccacccctacttgatgtgtcagccccaggttctctgctagagcacatttatttgccccctacccctgaccagcac

SEQ ID NO: 172572 - DNA, 570 bp, Homo sapiens
gtagagtgagtttggaagtattccctccttttcaaagagttttagtgggattcataatcattgtttaaatttttggtagaattcagcagcgaatccatcaagtcctgggcttttctttttttgagacagggtgttgctccatcaccaaagctggagtgcagtggtgtgaacactgctcactgcagcctcaacttcccaggctcaaacagtcctcccaccttagcctcctgagtagctgggaccacaggattagcctgacaggattaatcctcacaggattagccaccatacccagctaattttttattttgtagggactggatcttgttatattgcccaggctggtctcaaactcctggcctcaagcaattctcctgccttggcctcccaaagggctgggattataggtgtgacccactgtgcccagcctgggcttttcttcaatgggagagtttttattatagcttcaatctcattacttgttattggtggaattccccaaactgtcccccgaaccagataacagtcagatagcacaaaccaagtcaccgtcagaaaaaaaaggtgacg

SEQ ID NO: 172573 - DNA, 440 bp, Homo sapiens
gaggactgcttaaacctaagaggctgaggctgcagtgagccatgatcgtaccactgcactccagcctaggcaacagaccaagaccctgactcaaaaaatcccaaaaaaacaaaaaacagaaattgcttttcttatggtatatatcttgcctattataatcaataaatatcatttttattaatatcctcttaagtagtataaagacatcaccagttgcctcataatactatttcaagatctcaggttatcttcttagtaattttgcctgagttcccagtcactctcaatattctgtcctctcattcagtcccaaacaaaaaataaacaaacaaacccttttctaaatgtaaaaaggggcaaggaatggtggctcatgtctgtaatcccaattcccttgggattacagggggggagccccccgcgcgaaactgaaatttttt

SEQ ID NO: 172574 - DNA, 349 bp, Homo sapiens
tttacctggactgaccacactttgtttagtcccttgctctcctttggctgcttctcctgtggtgatttaaacagaaaaaaaaaattcttcacctgatcatagtatcctcagctaccatcctatttctttcccccctttgcagccaactatcttgacaaacgttttgtatctgcgtctcaccaccaactttctactcagctcctgcttcgctcttgcccagacactttctaattacaaagtgtacctctcctttctctgcaatctttcgtgtgaccgtgatgctgcatttggttctgtttcatgttctccctttgggcacctcaaacgactgcaaacccttggcctctat

SEQ ID NO: 172575 - DNA, 542 bp, Homo sapiens
gtgaacaccagtcccctgtgttatcattatgctggtgtccataaatcgaacctggccctttttcctcttcatctctctggatcctcccaaccaccctctgaagcaggtggtcttgtttccacttcacagggaagaaactgagctcagagagggaaagagacctgcccagggtcagccagctagggaaatggcagagctgagatttaaagccatgaccactgctggcagagctggtatcagatcatcttagggttgtttaaagccttccacaggcggagcgcggtggctcacgcctggaatcccagcactctgggaggctgaggtgggtggaccacctgagatcaggagtttgagaccagcctggccaacgtggtgaaaccccatctctacaaaaatacagaaattagctgggtgcctgtaatcccagctactcgggaggctgaggcaggagaatggcttgagcccaggaggtggagattgcagtgagccgagatggcgccactgcacactccagcctgggtgacagagcgagattccgtctc

SEQ ID NO: 172576 - DNA, 505 bp, Homo sapiens
ctagaggatccccaacttcgacggacggcattcaaaatatatacactgaggaatggcattctagtcgtgtgggagctcaaaacaagaactgaagaggctctttgtttctcacaggaattagtagacaaaagatagctcctgattcttccaactttattagatttctattgcaactttatagtgtatcagactctggcttctggaatccagccagagatccccaagccttgagaaacagaaacaacaaatttaatctccaaatcttctttctctgagaccatgctggcctggaaaaattgggcttaatatagacttaatgctagaatcaacatcattaacgagacctatactctctaacacagtagctgctgggtgaatgcgtccgacggagcgcttacggagattcaacttcttccgggttaagtctggggagagtgtatgtgtcgaggaatgtatccatttcttctagattatcaagttaattggcgtagaggtgttagagtat

SEQ ID NO: 172577 - DNA, 364 bp, Homo sapiens
tgagtagagattgcacctgggcaacagggcaagaccctatctcaaataataataaaaaatagtaaaaatagggaaagagtttcacaaccatgacctgaaatgtaactttcttcacaaagacatgaacgggttcaccagtgaaacgaccccggttgccacttgcatgtcacctcaggcttaaggaggctgaagcatgtgcttcctgtttcacagccacaggcacccgtgagctgacgttaaacactgacagcagatgagccagttgctgatgcacggccagtgggcacggcactctccctacccatgtgttggcacaaagctgtttaatgttagttaggagtagaaatattttactttttccctg

SEQ ID NO: 172578 - DNA, 528 bp, Homo sapiens
agacggagtctcactctgttgcccaggctggagtgcagtggtgtgatcttggctaactgcaacctctgcctcctgggttcaagtgattctcctgcctcagcctcccgagtagctgggattacaggcacccgccaccaagcccagctaatttttgtattttcagtggagacggggtttcaccatgttggccaggctggtcttgagctcctgacctcacgtgatccacatgccttggcctcccaaagtgctgggattacaggcgtgagccaccgcgcccagcctgactatgttttagccactgttatacatacttattctacatgaattattccactccattctaacagccctatatggtgggtactattaaccttcacttttcacaaacagggaaactgagtcacagaaccattaagtaacttgccctaaggaaaggcagctaagcagtggtagaggcaaagattgcaatcccaccagtgtgatgggctctcttgtctgacactctcagaggtgtagggagttgactaa

SEQ ID NO: 172579 - DNA, 665 bp, Homo sapiens
ttacttaaagaaatatttcatcagctcctgtcttggttttctcttttatgcaactcttattgcaaaatactctggattgattcattgtcttgaatttttcctcatatgttatctttttctttttcttatgttttgaatttttcctgagctctgtcttctagaaaatcaattaaatcttcagcaacataatcttttgtttttaagtttttcagatcttctgcctctgtctctgggtgctaaccccctggtgggagattcctgtcttcctgcgtgcttggttttatttctgtagctctttggcttgatcctgggggcggccctactgctgcgagtgactgcaggtgggaaggagtggttttgggattgcagagacattccttcaattaaccagccagatttcagcctcatggtcccacagctcaacctgcttgctggagccctgtgccctggcaggaagaggggctgccaccctcactgctcagctgtggttcctgcagccagtgatcatctgccacagcctgcctgtcctgtgatcccgcctacgttccgtcttctggaaagccacctgactatctggtctgcttaaggctcccatgctcgctgctttgctctgtgtggattaatgtactttggtgaattcttattgtcatgccataaaatttaga

SEQ ID NO: 172580 - DNA, 727 bp, Homo sapiens
tgcgtaccagacatataatacattgtgcttacgcttaagctaagcatttagtatttttaacaattccataacagaaaaggggaaagcagaagtttccttttcggtacacagcagtgcaagcagaagtttaaatctcaatagttgactattatttggaattaaaatattttgcaacaaaagaagatagtattcctctaaaataaaaaacctagtttgtttctcctatccctatacagataatccaggttatcaaatcccagttatattttcctatgccactcatatacacatttaaatctcaatcctcatgaatcatgaaagagagaagggaggaagggaagtgaggcaggcagagaaaggaaaacagcacatcccaggaattggagaaaatgctcacaaactgttaaaaattttccactaaacaatcccctatgccaaggcttttagtttactttagtttataaacaagcaggatttccatcaatccaccagaacaaggaatcaaatcatttttaaaaaggtatctcataatagagaagaagctagatgtaagtttcacaccttgaggctaaatcagatgtgtttaagctctttgaaactcattatgcactatactgatcttgattttcaaagaaactcacaatctaagtgcagctacgtcttacagcaaaatgtgctggcagatacacctaggaagctctcagattgtcaggtactgtggggctga

SEQ ID NO: 172581 - DNA, 356 bp, Homo sapiens
gcctctcagaatgcccacttctgtgttctcccccaaatccttgctaaccgcttcatcctacagtctctgtccatccctgttcttttgtgtttgtctctgtggacttgggctgaggagagtgtggtttctgcagcaccactgtgttcttgaccctggtcctggctgtgtcccctgatccgggtcttgaccctcagtcctatcatgccccctgaccctaaccgtgcctccctaaccatgattagtccactggccctgaccctgatcacgtccctgaccttgatcacgtccctgatcacaatcgtgcccccgactctgaccgtccctgaccctgattgtaccttttggccctggctgtg

SEQ ID NO: 172582 - DNA, 607 bp, Homo sapiens
cctcagccctcaccccggggtcccctcaaccctcaccccgggttctcccctcaattctcacccccgagtctcccctcagccttcaccccagggtcccctgagcccacaccccggggttccctgccctcagccctcacccctggatcctctcagccctcaccccagggctgcctcctttccctcaccccaggcttccctcccctcgtcccttgccctttgcccctcatccgcttccaggaggagctgaggtctgagcctgggtttctggctcttgggtctccctccctgtttgtctgtgctgttctttgttgatttctctgtccatccctgttcttttgtgtttgtctctgtggacttgggctgaggagagtgtggtttctgcagcaccactgtgttcttgaccctggtcctggctgtgtcccctgatccgggtcttgaccctcagtcctatcatgccccctgaccctaaccgtgcctccctaaccatgattagtccactggccctgaccctgatcacgtccctgaccttgatcacgtccctgatcacaatcgtgcccccgactctgaccgtccctgaccctgattgtaccttttggccctggctgtg

SEQ ID NO: 172583 - DNA, 471 bp, Homo sapiens
cttagaaatcgcttaaaacaccttttggatctgctatgccctgccaaacaatctccaatggatccccatcacctatggggtaaagtttaaacttaggctagtattcagagtcctccacaatctgagcccgactatttcctctcggcaatcctacatgaacattttactcaagcccgatttgtcgacactagtgtttctctaacagaactcagggcttgttgtttaaggatagagccttgattttgccgggaggctagtggtatgatggtgggggtgctgatagcatttcaaacaggggagggcaggatcagagaaaaaccatgtttctcttttctctctctccctctgtcccatgaagtatgcctagattgtcttagccagaaagtgtttctttaaaagaccaattactgttcctgcgtgtttgggggagtggggagggcgatgggaaggagagcatcaggaagaacagct

SEQ ID NO: 172584 - DNA, 1787 bp, Homo sapiens
  misc_feature (1180)..(1180): n is a, c, g, or t
  misc_feature (1432)..(1432): n is a, c, g, or t
  misc_feature (1744)..(1744): n is a, c, g, or t
  misc_feature (1770)..(1770): n is a, c, g, or t
accaagaggaagatgggaatacctctggccgctccgggccctccctgtcgctgaagcccctccttcctccgctggccgggtctgcaccgagcaaccctgcagatccagtgggccatggaaaattggattctactcacgaacctggcctggagggcgggggtgggatgggggcgggttaccgggaaggggcgcgagtgcgtgctgtttagccctgtagggagacatgatttccagaagtctttaggaacccagaggccgccgcaagagtcacggaatccgatttcaacctgataatttctaagggactggccacgttcttttattatatggctattgcctcgtaccatatatggcttgaaatcggtagatcattagctagaatttgagaatcctacgacatacggaggttctacagaactaagaatgtaactgtccttaacagggactctccttcagtaaggcgttccactttgtccaaggaaaaggactggcgttacagtagacacctcatagcgcaggagtagaggggagggtgcttcagcattaatattctgcgattttaaaggacttccggaaatgaggggggcgtctcaataatggatttgggcaagtcgtttctttgtgtgtttttctattcctcaagcttaagcaaaaccttaggctcaccgtaaaatcatcctttccaccccttttcagtagcagtgccttcaggtttcatttcctccttcctctgcatatcgatccacaatgcaaattgcaggccctcatcctcacaccaagattcctacacccagctaaagctgtcccagacttcatatccttaactcgagttcacctttttaatcctagaattcaaaggacttatgaactgtgaccatatcttacctagtcagtctcttacacatttttttcaaactgtgcctctgctttttcccccagacccaccgctctgtgcccttatcatgtttttcccttctatttgctaatcccaaaagagtaatttcaagtctcttatccattagctgactaacctgcccataaaaaacgctgttctacttaaattccccggccattcaatgttgtataaccttatgtacaggatgagataatgtttgcaaaagtccattttaaagaaccctcaaagacaggcgccatagatggccacttgcagtgatgtttngttcttccctagctcctgcagatacctaaagatagtccataatctttttgggtctcacttctgcaaattggagttcatacttgcgctatcttttgttgaagaaccctcaagatagttgcaaaaagtattttgaaaagtataaagtgatgggtttaatgtaaatgttttattcaatactactatcctctagactaatttggttgtagttcacattacagtagctgcttcgtaagtgatttttgggctgggcgnggtggcttatgcctgtaatcccagcacttcgggaggccatggtgggtggatcaagagaccgagaccatcctggccaacatggtgaaaaccctgtttctactaaaaatagccgggcgaggttgcattgagccaagatcgcgccactgcactccagcctggcgacagagcgagactccatcttaaaaaaaaaaaaagttatttttgttttgggggcagtggtggcatgcacttgtaatcccagctactagggaagctgaggcaggagaatcgtttgaagccgggaggcagaggttgcagtgagcggagatcacnccattgcgctccagcctgggccacangagcgaaactccatctc

SEQ ID NO: 172585 - DNA, 663 bp, Homo sapiens
tttgagaccttgtgtcaaaaaaaataagaagaagaagaagaagaaaagaaaaccaaatctggattactcttacataactgtcctactccagaattgatcatggcttcctgcttttggggccccaccaggcctattcagccttacttcccgccccctaccacagtcatcttctttattaagcatttagtaaaatggaggatagaatggttaatttaacctttattcagtcttgtcacattcttgagtgatctctgcaagtgttcatgattattgtagcactcagtagctggcaaagatgtaaaaagttagagtgaatatacctggaacatattctgaaaatctgtttgttggcagtggtggatttgtctttgtacctttttacaaattccatcagcgtatttttctcatttgccctttattaaaggcagaggatcggattgcttcattgcagattactggaggttcttgcaagatatgacctctgagttcttcaaggaagaaattcctgttttaattgttgaactatacttcaaagatgatgtaaagaatttgctgaaatatttatgttaaaactcattagacattaaagtctaatttcattgtattgattgtggataatgtggataatttcattgtattggtatctttctttctgtatctagt

SEQ ID NO: 172586 - DNA, 660 bp, Homo sapiens
cttaaaaaattttttttttttaaacaaagacacaagccaggcatggtggctcacacctgtaatctcagcactttgggagcctgaggtgggctgatcatgaggtcaagagattgagaccagcctggccaacatggtgaaaccctgtctctactaaaaatacaaaaattagctgggtgtggtggtgcatgcctgtaatcccagctactcaggagtctgaggcaggagaatcacttgaacccaggaggcaacgtttgcagtgagccgagatcgtgccactgtactccagtctggcgacagagcgagactccatctcaataaaaaaaaaaaaaaagacacaaacatacacattagcctaggcctgcacagggtcaggatcatcaatattactgttttccaccttccacatcttgtcccaccagaaggtcttcggggcaataacatgcatgaagctgtcatctcctgtgataatgatgccttccggaattcctcctgaaggacttgctttatagttaactttttaaaatacataagtagaaggagcacattctaaaataatgataaaaggtacaccatagcaaatacataaaccattaacagagccaaatactatcattatcaagtgttatgtaaggtacataattatatatgctatgcttttat

SEQ ID NO: 172587 - DNA, 474 bp, Homo sapiens
catctccttcccctggggggatcggcgaggtgaagaagtcgtcggtggtctttctcggaatccgtgaccatacttatttgctcaggaagaatgcgtgaatgctggccatctgccaggagccgtgtagctcacgggggttgaacttagagactgagcccacccctgtatgtaagtggcctgaagcttaacagctcttagagatgccaacaggaagggccgtctgggcccaggaggcccatgaatgagaaagcagcctgctctaagcagtcaccatggctgtcatcccagtctctctcccctctctcccttgaccactatgcatgggccacatccacctcctttctgtgctttctacattctgggctcaccatagggctttcgtgcttgctattcccactggcgggaacaccctgaccctctgtgtttaaatgtctcagctgtgacatcacagaaactttgcaatcccctaccccc

SEQ ID NO: 172588 - DNA, 593 bp, Homo sapiens
gagtgcagtgacacaatctcggctcactgcaacctctgcctccagggttcaggccattctcgtgcctcagcctcctaagtagctgggattacaggcacgcaccaccatgccccgctaatttttatatttttagtacagacaaggttttgccatgttggccaggctggtctcgaactcctgacctcaagtgatccacccacctaggcctcccaaagtgctgggattacaggtgtaagccactgcgcccagccacagtcatcatttctaaaacagtgcccaagcaaggggaggtgaaaccaaaaggaaaggctcaaggaatgtttgtgggcttcaaaggataagccactatggcagcaaacctcacacaatgaaaatcaccagtgcctcttattcactattcacaatttgtgccttgctgcctctttttcccatgaatcccttttccctttaaccaacttcctgtgttatgaatcaggcctgtcaatgatatccaagggcactgcttagcactgctagcagaacttcacttattcaacttaataaattctaattatatattcagcattgggccaggtgatgagaatcttaatgct

SEQ ID NO: 172589 - DNA, 353 bp, Homo sapiens
tgagctcggtaccttcctgtactgttctttgagtttgctattaaaatacacaaactattttttaagaaagcacttaaggccaggcgcagcggctcacacctgtaatcccagcaacttgggaggctgaggtgggagaattgcttgaacctgggaggtggaggttgcagtgagccgagatcctccagcctgtgcgacagtgagaccctgtctcaaaaaaatagccaaaaaacaacagttgcatacagtgtttgttttgatggaaacaattattgaaatgaaggctgtctagagtttttaaaatacacttagaaagtagtgatttatttagaagaaaatggctttaatagttgaaa

SEQ ID NO: 172590 - DNA, 142 bp, Homo sapiens
gggacagtgtcttgacatgtaatgaaatgactgtcatttcatcctgccatgtaacttacaatttttatagggattaactactagttagaaaaatgcagcatttgcctagagacctctaggaacccacacaaatgggccacat

SEQ ID NO: 172591 - DNA, 485 bp, Homo sapiens
tgttatttttatttcttgggggtggggagtgtgccttctggtttcattttcctgtcccagtcttcctggcactgaccatggccacgccagaaagaacagggcttggactttggagttagacggccctggggccagatctagctcttgccacctagcagggtaactgcaggtgacttacccatttcctcactgaactggaaaagcacccccagggtattgtgagacacgggctgaacttgggatctgtttccttccatgccacctgaccattccgaatccctgaggctcctgggaggggggtaggagtaagctggggatgtgactgacagcagagagaaggcgggaccaggaaaggccaagttcaaatacagcacagagatttacatcaataccacgcgtgtctcacaatttgaataaggacacgtcaaataccagaagagctttccatggtgggcgtgggggaaggggtaggcctggggaatgga

SEQ ID NO: 172592 - DNA, 293 bp, Homo sapiens
ttcttagtattctttgcagatagaagtccctttgcaaggtacagtttggatataccctctcagataatgccttataatcactgttgtaatagaggtggttgttatgtagttacagtgggggcaaacagttgaatataatagactggtgccagcagattggattaaataggtatgagtacagcacagaagatacggatggctctcttcctctggactacaacaaatggccctagctgcccaccagaactcttctttgcttgcagagctttgggatatgaaggcaagggaatgtt

SEQ ID NO: 172593 - DNA, 176 bp, Homo sapiens
aggccccaacacaggttagcagagcctgggggagaacagacatctgacattctccccctacactgccccattgaggctggctccactggtgacattttcatacctgaggctcgaggatcaagtacgcccattttattattttatttttagagacagggtcttgctatgttttgcaa

SEQ ID NO: 172594 - DNA, 308 bp, Homo sapiens
taaaacccaggctgtttgactcagcctttttcttcttgtctccttaccaatgtggaacacattaagggttagcttagatactgccctattacatgtaaccttgcctaaaatttttaatttttagtatttttccatcctgaattcagaaagcatttaaaaatttttatttatttatttattttttgaaatggagttttgctcttgttgcccaggctggtctcgaactcctgacctctcgtgatccgcctgccttggcctcccaaaatgctgggattataggcgtgagccaccgcgcctggctaattttt

SEQ ID NO: 172595 - DNA, 897 bp, Homo sapiens
cacctaaccaagatgagccaggatggagtcacaccaggcagagcggggggcctcatgccttcttccagtctagctcagagcccctcacagctgcaagattgactggtttttttcccccaatagggtggaactggctttattttgtagttataaagaacataccatggagttggttcttgggagttgtgttctaaaggcaatctattaggcaagaattgtctgtgatcaaaactcccatgtttcattgactctaagatgccattggttgtaagaagcatcatttttaaatgcatcagtaaaaaagaaaacatactgcccttcgaactatgacaaagcacttctgtgattcacactgattttttaaaatgaaaaatatatctgcatcttagaattaatgacatatggtgtttgaaaacccccaagaaggcaccactttggagaccaacacatcttattttcccagaaactctaatagcattttctgcattagtacagactgctgctttagattaggcagcaggctcatgttcaggccatgttgtagagaatcctccagcatagcaagataccatcctccaagagactgaggggatgacagagttgcatcttccatcccaggcttgctgcagggcatctacccatggacaatgggcaaggttgctgctttactgaaatttaactgttatttccttgtcttctctcactcccaagtgcacatttggtaacagaagtctcattagtgaaatgtgggtgctctgactccactgtaggctcattgtgaaaactgaacaatacaaacaaatataaaaaagaatgtagaaaacacctataatcacaccaaagatcatactatcaacatttatgcctagatctttccaattaaaaccctttatatga

SEQ ID NO: 172596 - DNA, 583 bp, Homo sapiens
agagtaagcctgtttctaaaaaacaaacaaaaaaacaaaaccccgtgtcacaatattagttttgagtgcatcaagcagcaagcctcttttgctcagtaacaaaacttttggcttttaaatttagctgctgcagtattttatcttctccttacctgtcatattatttattttcccttctttcattacactttactgtccttttaagcatttctgattttttcttatttttcatctctttgtttccaagtcttacctgggttctctattaagactcttttttcttttccttttcagtttctaagtggcaggcaagggagggtatcaaataaccaggaaaggttgtatgtctttcttcttcccttgagacaaatttgctaccaccctgatggttctccttaataaattttctatcttcttcaatattgattatccaactccactcccaaataaacatatatacttccaatctaggtaactcaattcccaaaacaaaaaatttatctaatgtaacaaacattacattgatgaaatgctgctgctttttcctgtcattcactaaactgtacttttatgaggagcttca

SEQ ID NO: 172597 - DNA, 580 bp, Homo sapiens
tgaagacagactaggagccattctcatctggggtgtgtactgagatcaccacatttctagacccgccaagataggacctctagggaggaaagtactgtgaaggaaatatgcttttttcaaactccacaaatgtttctaatgcacaagaagggttgaaaagtactggcttaagaaaactaaatcaacagtgcccaaaataacccagtggtggcagcagtaaaagtcattacacgacagaccacatgaaaagcatgaactggttctccttgctttcaaattataagtttccctgctacatcccatgaccaagattccctaggacgccaaaaaaggccactactgctactgctacagagctctaagcactaacagtggctccaaagcaaatactagctttaaaaagaaaacagcctccctcttcctgggtaggtgtctggtgcttgaggggtatcggagtggaccaggcttgaggggcacaatgaataaccctataccttccaatttgaaattagaagcaaaaaacgctgctaaaatattaattcacagaattgacttccagaaatgacctgataagattatt

SEQ ID NO: 172598 - DNA, 611 bp, Homo sapiens
gctctgaggcgctcacttcacacttgggaggatccaggccggggcaccatctctgctgagtattcgctctgctccctcgaggagcagtgcctgcctcagcatagtgacttatgtgacactggagcctgtggcccagctccctgccctgttccacggggaggccacttaggaactcaggcagttgtatggtgtggtggcagcaaaccctccaggagtctctgttctcatcgatcccatgtctggagacatcaggaagttgaatctggagcaggacaacccagacttctgcctgtgtcccaccggggcgccctcaggtcctcccaacttgcctggtttgctctgctgtgaactcatccctcattgtccctgggttttcagagaagcagaggtagtttctctttggatttcctgagacagtagctgtgactgcacctccgcagagcttgaaaaggcaaggggatgatgacagcagcgaggggtaatgatgagggtgaggagaagtatgaggtggtgaaactcaagatccccatggacaacaaggaggtcccgggcgaggcgcccgcgccgtccgccgaccgggcgcgtccccacgcgtgccccgactgcggccg

SEQ ID NO: 172599 - DNA, 344 bp, Homo sapiens
taaaattttacccaaatataattaagagaattatcaagcttttaatgtcaggagggcccttagcggatatagtctcccactcccacgtttacaaagatggaattaagctactgacaggttaagccccaagttagctcggcacagacaagaacccaagtctctgactcccactctgtacttcctctctccccatgaaatactgtttgttaaattccttttacgagtatgtatgtttgtgtaggtcttccctgtaagactggctttttgaagttaaacccacagttctgtatatttcctttaatgtattaaatcatacattaaaaacaatttgctaacatcaacag

SEQ ID NO: 172600 - DNA, 490 bp, Homo sapiens
aaaatatccatactacccaaagcaaaatatagattcaatgtaactgctatcaaaatgccaatgacagtcttcacagaaatagagaaaacaatcctaaaatttgtgtggaaccacaaaagaccccaaatagccaaagcaatactgagcagacagaacaaagttggaggcccgtcacgccacctgacttcaaaatatactacaaagccgtaggaagcaaacgtcctagtatttgtataaaaacagacacacggaccaggagagagaaactagaaataagtccacattcacagccaaccgatttttgacaaaggcacaagaacatacattagggacaggacatgctgttcaataaatggagctggctctactactatttggaaggtcattgggctctactttgtcctttgtattgaaaacagtgtgggatcaatgtgtgtgtatgtgatttggttgttgggttggctttgctttttcattttttattttcctt

SEQ ID NO: 172601 - DNA, 539 bp, Homo sapiens
gtaggccggacctccttcaccagcttaagctgtgctagtactaaattgaataaacatttccctctaatttccccttaatgtcctcagaaacacagatgagggatacatcttcatatgactcctcagagcactaaaatgatattaaaacactcttcccacaagaaacgcacagacgagggattcttcagataataggaataagaaatgtgaaataaattagaataaaccatgcagctattttaaatatttactcctggaaaaatagtaagttacacagaatcagttttgggaataacttttccattttcacctttttatgattattgtaataattggaggaattaataaagtaaaaccatctgaataagttcatcccaagctgattctgatggatggtgtggcggatttttaaactctcctctgtcacgggctgctgaacagaaggaaccctgtgaaagttgtgtcatcgtcctcatcagcaaacaagccattgaacctctctcctcctgtcacctgcagccacacctcatccccgagct

SEQ ID NO: 172602 - DNA, 202 bp, Homo sapiens
gaccctcacaaaccctgtgtccttccctagttctctttcctattaaaaataagaacctgggcagaaggcagaagcaggaagcaggcagaagcaggaagcagaagcaggaagcaggttaatggccatagaaaaacagaggtaagaaattcagttaggtcacaattatagtagataacaagatctggaaagcagtagcagtggg

SEQ ID NO: 172603 - DNA, 869 bp, Homo sapiens
tgtagttccagctacttgggtggctgaggcgggaggattacttgagcccaggagtttgatgctgcactgagctatgattgccactgcacttcagcccgggagacagaggaagactctgtatctgttccccccaaaatttagtgattgtatttctttacatcatactgtagagagttgatgtttgtgttcactccactaacctcattccactttcccctgccagtatacttcagaatatctcagatccaattcaaaatttaatcttaaaaggtataattattttcacagtttcatagtttagttttgatcactgaaagcatttctttcattttgtctaatcgaacaaatttatgcaaagaattggggacttattcctcattagtattgttcatctataggtggaaataagttcaagtatgtgttgcagtattaattaaaggcaaagtgacctacttgtactatattctgaataaatacttattgaatgaatgaaaaatagaagagtgactcaattattttagaatcttaagttatacagatttatgtaatgtctattttgatttttattaattaaccatgaatttatcctactctagtattgagaaaaagaaaatggaactatagacccttctttcatatgatacttaggaatgtatctgcactgtatccagaaagtcagttacatgccctgtttaccaattgaattctgcttcactaaggataataataactgacattgagtgcatggcatatgatgggcactgtgcaaattgctttgacatgttttgttcatttaatccacacaatggtcctatgctataaaaacagttaatatctacttttttaatagatgaggaaactgcagctta

SEQ ID NO: 172604 - DNA, 369 bp, Homo sapiens
ccgtgcccggcccgaattttaacactacgctttttagttattgattgtgggtcctttggcaagttgcttaccctttttgagctttaattttctcttttaaggattgcctttaaaaatataagtatttattaggcatctagaataatgtctggaagacactccagacatggaagtcactcaatacgtattacttttgattattattgcctttatgcctttgattttctttctcctattctctttctctagtcacttgccattcattattaggcttggatgaggccatacatttacgatctttgaaaaagatggtttacctcttcttccctcttaatattacgtcatcagtgtgatatatctgccaaaaaa

SEQ ID NO: 172605 - DNA, 336 bp, Homo sapiens
aactaagtaaattctaggataatttctgttgatctgttctcaatttcactgattctatcctctgtcgttcccactctactagtaagtgtaacccgtgaggttttttcttaattttggtgactgtatttttcatttctataatttccacttggttctcttttaaattacttctgtttttggctaagattttctaattttcatttgtttgcagagaatttgtaattgcttcttgaagtgtttatataatagcttctctaaaattcttgttagataattccaacatctgattcattactgattcatgtggattgtcttttcttattaaagttatgattt

SEQ ID NO: 172606 - DNA, 939 bp, Homo sapiens
  misc_feature (787)..(787): n is a, c, g, or t
  misc_feature (798)..(798): n is a, c, g, or t
  misc_feature (819)..(819): n is a, c, g, or t
  misc_feature (825)..(826): n is a, c, g, or t
  misc_feature (834)..(834): n is a, c, g, or t
gattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacattgaccacagcttgagtcgtcagaactgtcctttcctggctggggagacagaatctctagccgacattgtttgtggggagccctatacccattactgcaagatcccgcctacctccctgaggagctgagtgccctgcacagctggttccagacactgagtacccaggaaccatgtcagcgagctgcagagactgtactgaaacagcaaggtgtcctggctctccggccttacctccaaaagcagccccagccagcccgctgagggaagggctgtcaccaatgagcctgaggaggaggagctggttaccctatctgaaggaggagattgctatggctgtactgcttgggagaagggctagaaagtttggccccgtggggcccagcagaatccagtggtgctgtgntggcgaaggantgtgtcatcaccagggccccnttgttnnattccccntggacactggtgtgcaagcgagtttgcggtccgcgggaacctttttgtggcacttgtaccaaacgctctggtcccgattatactacgaacggatcgatggccgaa

SEQ ID NO: 172607 - DNA, 767 bp, Homo sapiens
  misc_feature (615)..(615): n is a, c, g, or t
  misc_feature (626)..(626): n is a, c, g, or t
  misc_feature (647)..(647): n is a, c, g, or t
  misc_feature (653)..(654): n is a, c, g, or t
  misc_feature (662)..(662): n is a, c, g, or t
gattcacggcgaaatgagactgttcgtgagtgatggcgtcccgggttgcttgccggtgctggccgccgccgggagagcccggggcagagcagaggtgctcatcagcactgtaggcccggaagattgtgtggtcccgttcctgacccggcctaaggtccctgtcttgcagctggatagcggcaactacctcttctccactagtgcaatctgccgatatttttttttgttatctggctgggagcaagatgacctcactaaccagtggctggaatgggaagcgacagagctgcagccagctttgtctgctgccctgtactatttagtggtccaaggcaagaagggggaagatgttcttggttcagtgcggagagccctgactcacatgtcagcgagctgcagagactgtactgaaacagcaaggtgtcctggctctccggccttacctccaaaagcagccccagccagcccgctgagggaagggctgtcaccaatgagcctgaggaggaggagctggttaccctatctgaaggaggagattgctatggctgtactgcttgggagaagggctagaaagtttggccccgtggggcccagcagaatccagtggtgctgtgntggcgaaggantgtgtcatcaccagggccccnttgttnnattccccntggacactggtgtgcaagcgagtttgcggtccgcgggaacctttttgtggcacttgtaccaaacgctctggtcccgattatactacgaacggatcgatggccgaa

SEQ ID NO: 172608 - DNA, 158 bp, Homo sapiens
gtattaaatgcatgggacaaagttttagttaatgcaaaatttagtttatatcatatttgctccctcatattctcacaaatctaaattgccatgctcttccacagaggcaagaaaaaagtaatgcctaactcgtgggctctaatcatggaggttatggg

SEQ ID NO: 172609 - DNA, 401 bp, Homo sapiens
atcccagctactctggaggctgaggcaagagaattgcttgaacctgggaggcagaggttgcagtgagccaggatcatgccactgcactccagcctgggtgactagagcgaaacttcatctcaaaaaaaaaaaaaagaaaagaaagatcagtagggcttcctggccagagtcaggtctgtcatttagttatcaaagcccagaacttggcttggagcgggggtggctgcctccaaggaaaatctgaaaggagagtagggcagaagcaggcagatgctcatcctgtctctgttcggaatgcccttgagatctgaccctgtgccatcgagggactccaggagcagaagaaagcttcctgtgaccatggccgacctcgtgggccattctgaagccactgagcatca

SEQ ID NO: 172610 - DNA, 552 bp, Homo sapiens
ttatgcttggttctgggaaattcagttctccccctacccagacacacacacacacacacacacacacacacacacacacacacacacactcctgatctaaagctcttggcctatcaagaaaagatggttaggtatctgggcagttgtgtaatacattgtcacaggtatactgtcagaagcttacattggaaagagaaggcacaggagaagagagtggttggggttatctggaggttggagaagctgttctcaaggctttatgacagaagtcatccttgagtgtagtttcaaaagattatattttaaaccaagtgaatgacatctgaaaaacatagctttcttatattcactttaggatattaataaccaatccttttccttaagtagcctcttgactggctaaatgtacctcttcaggttcagagacacattctagaatgttacagttttctcattatgcattgtatctgttccgtgttgaagtacctgtaggaagaaaattaagtacaggttttgtgtgtaggttgagagctgatcctatcaagggtgtgt

SEQ ID NO: 172611 - DNA, 499 bp, Homo sapiens
aaggtggagggtgtcaggagtactgggtgagagtcctggcctgtactcccaaagctgaacccaggggttcagtcccccagatgggctttctgttttttgctccttttgtctctgtttctcatctttgtttctttcggtttttttgtttgtttgtttttgagacaaggttttgctctgttacctaggctggagtgtgatggagcgattgcagctcactgcaacccaaaacttctgagctcaaatgatcctcccgcctcagcctccaaagtgccgagattgcaggtgtgagccaccacgcccagctaatttttatttttatttttgtagaggcaggatctagttatgttgcccaggctggtctccaactcctgacctcaagtgatcctcctacctttgcctcctaaagtgctgggattacaggcatgagccgcggcactcagcctgtttctcatcttcccatggctctgattccttatttgtctctcatctcttatttgtc

SEQ ID NO: 172612 - DNA, 534 bp, Homo sapiens
atcttaactcataatctaagaactgcagctcagtggagtgaagcaagtactgcctttggccatgagataacctggattctggctccagcccaccattaaatggttctctgttcttgggccaggcatttaatcctatgagtcgttgctgcgtcattgcaagaacataatgtaaagttctttcagtgcccagaagttatgtaacagctgtgaggtggttagcatatggtgtagaggttaagaggtctggttttggatccagctaagttcaatttctaccttcatcacttgccttgtaccgttgggcaacttatttgatttctgtgagtcttatatccttatatatgtaaaatagggtcataaacacatttaatgcctaggttgtattgagtgttctatgatatgactcataggaagttctgaatagtgtcttgcttttagtaagggcccataattttagctattactattattatttcttaacaacctcttgtccaaaagctgttattgttaattaaaattatatttattaaaatg

SEQ ID NO: 172613 - DNA, 360 bp, Homo sapiens
agagctttgttgagctagctgttgccgcaaaactgccgggagaatcccactggtttgccttggggaccacaaaaatggtggtcctgggggctgtttgtgtaaatcacctggtattttgtgtgtttcttgcgtgcaacccggcttggccgtgccttcgtggtgggcgccttctccatgcaggcccattttccctccaccaactactacttgtagattcactttatagcgtgcaaaagcggagaaacatctctgtcccctcttttggagggctaagctggtggctgattatatttcctcctaatagaacaaagtaaaaaactgaatcccaaataaagcctgttgattggacaaggcttctca

SEQ ID NO: 172614 - DNA, 216 bp, Homo sapiens
ctgcttctgccaccccaacaagggacaactgagtcagcccatgacaggggcctcccatcctccccttgaacatgtatgtgtacatggttattatcagccagtgtgataataggttttccttctggtccctgcagcaggatagatgctgtcatcagtgagaaatggccctacaggacagtctcggactcaaaggaatacttggtgttggcattttta

SEQ ID NO: 172615 - DNA, 214 bp, Homo sapiens
tttccacttgtcacacagacttcccgctgggtgccctgcaggttcctttccataaacagcatggatttcaaatcaagcagggcacaaggcctctattcaggggccttcaccctgttacaaaaaagcacaaaggtgcaggacagcctcacaatgggcaaacaaatgagcaggccccgcctcctcctccaacacacgtgcacacagtgtctgccca

SEQ ID NO: 172616 - DNA, 689 bp, Homo sapiens
ccaatgtccaatttgtcatccccaacacctacatctgcaatatccccatctcccctaagattcaccatggctatcatcatttccatacactataattggacaacaaaatgaactaaaacaacaataaaacaacagaattatgagatacagcaacaatttcattataccaatacaaatttgcttgactttgatcaccaagcaaattatttaaaactaagtacaactcccattgcatttatacgggacacatccaaatcattatcagaaaaggtgcaaagtgttcattatctgctcctccaggtaaatacaaatacaaatctcgatcattttttaagttcctaagacactgggtttatgttgtgtgtatgcgtgtgtttgtatgtatgtgtgaattgttactaacaactgctaactctgtggaatagaagactaaaggtatttttatttaattctgtaatcccagaacatcatcacaaagtggcctaaattaacacttttgtttagggggaaagtttatgtattcactcaataaatatttactaatagcttataatatgtaggctacagagctgtgtgctagagatgctgtaacgaacagttcagccaggaacctgccctccgctaatggatcctattggagactctatatctctttactctctggtatcagtgttagctcattgtgtttt

SEQ ID NO: 172617 - DNA, 493 bp, Homo sapiens
tgtacaatctcacaccctgtaaagagaaagattgctgatttccaaatattacttttgccttttcctaaggccataacggatgcccatcagaactaaagcccgcacatgcaaataaaataagagacagcttagagggagattcatgattcacccgacattaatcatggagcctccaattctgacacatccaaggtacacagctgagcttatccatctgaactgtttccaatggcagcatcctagatataatgtaattacaatacaaaacatatcaaaaccagagtttcactctgagggccgaaagacaaaaatcaattaaaaaaaaaatctgctgagcttgagaatgtaaactagataaaaggttaacactctgaagtaacatattttatactgtgtcagaggcaattaaattcccagtgattggagatatgtatcagagtttgaatgaactatgtgtaggatttgctttaaaataataaggtgttggggagga

SEQ ID NO: 172618 - DNA, 421 bp, Homo sapiens
gggaaaggaggagaagggggctgttgggcacctggaggaggtggaggaggagaagaagaaaggggtctgggaaaggatccggttcaaattaagttctcaagcgctggtggaaggtttagctacaggtcacggagaagatcagggaagcaacaggacacgcggggcaagggagcgtgaggcttaggagcaattagagggagacaaaaaggttctgctatccgccaaaccttcttcggtctgggccctcccttagcaaacctggggctttatactccctctccaccaatccctgatgaccccggtggtgcctcacaatggacaatgccaagtagcgcccgcatcattccaatgacccctcccccatctcagtctcccacactcctcgcaaggacaggtcctctctggaaccttcacaaacctg

SEQ ID NO: 172619 - DNA, 233 bp, Homo sapiens
ggtgatcgagctggtacagggttgcttggttgcttcccacaacttggcaagagagaatgggctatactccctctccaccaatccctgatgaccccggtggtgcctcacaatggacagtgcctcacaatggacaatgccaagtagcgcccgcatcattccaatgacccctcccccatctcagtctcccacactcctcgcaaggacaggtcctctctggaaccttcacaaacctg

SEQ ID NO: 172620 - DNA, 214 bp, Homo sapiens
gtttccacaagatctcacaagtactttgatgttgatagttcactcagggatagtctaggatgaagattgggaaactcatctttattcatgtaaagagaaatgtaacagccaagcagactagatatttatctaagcaggtgagctcattttcttcccagtaggaacctgttcttgggaaaccaaaacaggatcaaaaggctgctgaatgggttta

SEQ ID NO: 172621 - DNA, 173 bp, Homo sapiens
cacccccaggtgggaacccccagccagcagcccctttcccttcactgaagttctgcttcctgaccctttctcagtgtacgaacccaggccttgaccttcttcccacatctttatttttatttgtttgtttgtttatttatttattttgaggcagcgtcttgctctgttgccta

SEQ ID NO: 172622 - DNA, 398 bp, Homo sapiens
tgccattactataagaactttcaagataatgagggcgccagtatgctcatccttcttgataacaacaaaagctttgggaaccccttgctggatgaaagaagcattctttccccccctctatcagtgtggcatcactcaggtgtctacctggaacagacggaactacctaaagaatggtgtgctgaagtctaccttaaaatctgccatggcccatgaccccctctccccagtgctctctgatcctcgtctggacgccatggaccagtggctcctgagtgtcctggccaccgtggagcagtgcactgaccagtttgggatggacactgtatggtagaagacacaatgcctttctcccacttgtaactctcaataaaaaataagtgaaacttctttttaca

SEQ ID NO: 172623 - DNA, 278 bp, Homo sapiens
tgagtcacaagtctctgtgctaaaaaataaccaatttatatgtttgtttttagtaataaaaacggtaaagacaggtgaccataaagtatgggcacctttttcaatgttatgatctaggaaagaaatagattactatttacatgtagaaactctctgatcatactttatctatacagaaatacaacgatgtttgactgattcatacaacataaaaggggggtcctgactgaaatgaatgtaagtcgtcagtgcaggtgggggtttaaggtagggatctg

SEQ ID NO: 172624 - DNA, 249 bp, Homo sapiens
ttccccttgaaacccagcagaagacaaggatgctcattttcaccacttctattcagcatagtactgaagttctagccagagcaagtaggcaagataaagtaataaaagacatcaaaatagcaagagaggaagtcaaactatttctctttccagatgatatacttctataccaaaaaacgatatagtcactggctccgagataagataacttaagaaaaggctcagcatacaaaattgatgagcaaataa

SEQ ID NO: 172625 - DNA, 220 bp, Homo sapiens
taaactggaagacggtcaattggttggtggcttaggcaactgggtctgtgatgtcatttgctgagattgggcagtgggtcagggggaggtgccaaaatgagctccacttgggacatgttgaggctaagataactgtggagcattctagagagaaatgcaataggctggatatgtgagactgaaggtcaggatggagcctaacaccagaggtagagatttg

SEQ ID NO: 172626 - DNA, 511 bp, Homo sapiens
agaaagagaagagaaacataagacaaaatcaatattttagaaataccaaattagtatttttcaaaacttatgaatatcgatccccatgtttaaaaaactcagaacctcaagcaagagaaacacaagcaaaaccacaagcaggcaaatcctagtaaaactgttgaaaagtgaagagaaaatcttaaaagcatccagaagcaaaaaaaaagacacattaccttccaaaaaacaacaatagaaatgacagctgacttctcaacagaaatgatgaaagctggaagtaatttaataacaactttgaaatgatgaaagaaaaataagacacaatctagaatcttaactcagtaaaatatgcttcaaaaaatatagtgaaataaaaacattttgaagcaaatgagaactgagggcatttgttgccaacaggcctgcgttaaaagaataataaaagacagttattctggtagaagaaaaatgatccaggatggaactataatatgcaggatgaaaagga

SEQ ID NO: 172627 - DNA, 338 bp, Homo sapiens
actccatgcaaatggacaccaaaagcgagcaggtgtagctattcttataccagaaaaaacaaactttaaatcaacagcagtttaaaaagatgaagagagacattatataatgataaaaggactagtccaacaggaaaatatcacaattctaaatatatatgcacctaacactggagatcccaaatttatgaaacaattactattagacctaagtagtgagatagacagcaacacaataatatgggggactttaatacaccactgatagcactaaacaggtcatcaagacagaaagtcaacaaagaaaaactctacctaaatgataccctacaagtgaa

SEQ ID NO: 172628 - DNA, 247 bp, Homo sapiens
ccccccctcccccccgccaccgtcccacccccacagagcagctaagaaagctgtttgatttaacccgtggtttcccaaatactttagaccactaattaattttgttttctgaaacattcgttaatatgttcacagaaaattgtggcattcactttggaaaatatatctgtttaagaacagataatgaatacataacaaatttagaactgtgttaagattccataactaaaaccactctaaactttct

SEQ ID NO: 172629 - DNA, 379 bp, Homo sapiens
ctccctcactggctgtttcttcttaggtgccttggggctcctcttgccctatttgaacatcagtgttgggtgctccaacgctgtagcctcagcctagctcccttcttgtctactttaactttctgagagctctcattgggcttggggctccagaatcatctgtatattgatgactctggctcagacttctccttgagttctcaatatggatagccagctgtctactaggcacctacacttgttttgtttaaatctatgaaacagaaccattaactcctccctcccctttcctcctaattcttcaattctcaaaattgcctgtcttggaatatgactaccatccacccacttaagtgcttgaagacccctccccctcgca

SEQ ID NO: 172630 - DNA, 804 bp, Homo sapiens
acaccccagccctgttgcccagatcacttggtgacccgaagctccgttttctgcactccagataacagagtcagcttcctagctgcttccttcttggactgggcgtccggaggagttcaccctcttcctcagggtgtgtgttcaggagctgtcttggagcatgcacataaattcagctcctggaacttcaaggcataaggaaatgggaccatgcgaaagtcaccatcacatcttaatccgtgactgcgctgcccaacatcgccccgagactaaacttcccctagaagttcagtttcacaaagatagaaaaattatttgggcaaaatgctgctgtccaatctgaatgcttgcttctacgaagccaagaggaggcgcctgcagctcctttgaacggaggaagtcacgtcgcctggtttggaactgaagacaaggaaagagcgagccgtcgagggtgagcacccggagaccatgaccaggatgaccgcaggccctgacagcaaaacatcatcgttgtggtaaaaaagatgcccctcaggagagctgtttcctccctggaatttgggtcgaatagaaaatatttcaccagcgcccacctgagcatttggcaactcagtccccgaccacaaactccatcatcttagaagagaagtccaggcacccaggggctgaacggcagtgcgggctttgacaccacacgagccgccagagaggcggcacactcagccacacacactgtgtacacccacacacctgcacactgcgcacacccacacgcagccagggacactgcacacccacacacct

SEQ ID NO: 172631 - DNA, 247 bp, Homo sapiens
tctagcctcttttataaggcagcagtcacattcatgagggtgaagcccttatgacttaatcactttccaaaagccccaccttttaacactatcacattgggtattaggttccaacatatgaattttggggagacatgcagatcatagcagtgtggaggatcatatgtaatttactttaagtggtttaggtttgcatatgtgtgaaagtgaagcaaatatggcaaaaggttaacagttgttgagtatg

SEQ ID NO: 172632 - DNA, 197 bp, Homo sapiens
gtgccactggcattgagtggctagaggccaggaatgcttctaaacattctacagtgcacaggtcagcccacgacaaaaaaaagaaaaaagtttggcccaagatgtcaatagtgctgaggctgaggaatcgctgagaggtttaagaggttgagcgctctcaaatgtggggaagaagacttatttttcatataatgctt

SEQ ID NO: 172633 - DNA, 318 bp, Homo sapiens
atgtcatgtggatgggcctgtttacgtgatgtgccatggaagggagtggcaggtgggcagcttggagtgaaaagctaagagagtgaggtagctaactgcatctgtacggagaatcctgggtctcttttatggaaaactggaggcccagacctgcgtagctccttgaaggccatgagagcacctcgtccaggagtgggcaaggttgggcatgcagtaatgtaaatggagtagtaaatgtcagctctgactgcagcatttcagttcagctttctaccacactttggaggtatgcagccaactgcacctaaaacccagcca

SEQ ID NO: 172634 - DNA, 468 bp, Homo sapiens
gcaaatgtttattgagtgcctactgtgtgccagaaactattctaggcgcttaggatctagccgtgaacaacagatcgaatcctgctctcaagaaattgcgtcctagcgggaggctggaacccaagactgactgactccaaagtctaggcgccttagggaacagggaagaaggggatgtccctcacctgtgttcaggaccttcttggtaaatgattccaggacttccatgcgcattatgctggtgctgcacctataactcaccaagtccaaatggagtctgtcttcccccactccaccctcccctgcatatcccaatccacattctgttagatctgtgcccaccttacacacagcctttaatttcccaccccaactagtgggataagtgcccataagactccagtttctgtgccattccattttccgtgcagctgccaggaatactgataaagtgaaaatcaatattta

SEQ ID NO: 172635 - DNA, 229 bp, Homo sapiens
taagtgcacctggggactccaggtgtgcaccagggcgagagatgaatttttacttctgcgcttagaagaaggcaggcttggagggtgagtggcatgggcagtagccctgtgagcattctgtggagtgcctaccaggtgccagacattgggctgggatgttacctgtgtctccttgaaccagttttgtgggctaggtattgctattcccattggacaggaaaccagaggc

SEQ ID NO: 172636 - DNA, 339 bp, Homo sapiens
gcagcgacgcacgctgatcgccatcttcaaggagaacaagcggccgtccaaggagatgcaggtcaccatctcgcagcagctcggcttggagctcaacaccgtcagcaacttcttcatgaacgcgcggcgccgctgcatgaaccgctgggctgaggagcccagcacggcccccgggggccccgccggcgccacggccactttctccaaggcctgaggcgccccggccccgcgccctccctgcctccacggcctgggcgctgtgcccccacgtcacctccccacatcctgccggcccggagacccgcccccagggggcacctggagggggtgctatccggg

SEQ ID NO: 172637 - DNA, 435 bp, Homo sapiens
gatatgccactacacatttaaccagtactcgatgtccatgttggttatttctaatttttcaccattataaacaaccctaaagttaatatcctcacatatgtgtttgcatactcgtctgtcaccttaggatacgttttctaaaggtagaactacagctttgaactcctaggctcaagtgatcttccctctcagcctcccaagtagctgagactacaggggggtaccaccaaacctggctaatatttaaattttttatagagatggagtctcattctgttgatcaagctgtttgtgaacccctggcctcaagcaatcgtcctgccttggcctcccaaagtgctgggattataggtgtgagccaccatgcccgccctcttctaattatctgtcatgagatggatctccagtcattgcattgaggtttatgtatttaat

SEQ ID NO: 172638 - DNA, 273 bp, Homo sapiens
ggtgaaactgcgtctctactaaaaatacaaaaattagccgggcgtggtcgtgagcacctgtagtccagctactcaggagactgaggagggagaattgcttgaacctgggaggcagaggttgcagtgagccaagatatcccgccactgcattccagcctatatgacagagtgaggctccgtctccaaagaaaaaagaattaagccccaggaaagtctgaaaggaccagcatcaaaagattccctagccaaggcaacagagtgagaccctgtctc

SEQ ID NO: 172639 - DNA, 328 bp, Homo sapiens
tacctcaccctccagagtaactggaactataggtatacgctaccatgcctggctaattttttttaatttttaatttatttttatttttatttttttcgagacagaatctcgctctattgccaggctggtcttggaataagcaagacgccaactatgaaaaataatgggctgggcacaataacctgtaatcccagcactttgggaggccgaggcgggcagatcacctgaggtcgggggtttgagaccagcctgaccagcatggagaaaccccttctctactaaaaatgcaaaattagccaggtgtggtggcgcatgcctgtaatcccag

SEQ ID NO: 172640 - DNA, 434 bp, Homo sapiens
agcatttttgtactacagcaataatcagctaaaaatacattcacaaagcaaaaaaatcaaaacttttacattgacagaaaacagtttcaaagcactcccaataaaaattccagtggcttttaggaactcaacttattctaaaattagtatgcagccgggcatggtggctcaagcctgtaatcccagcactttgggaggtcgaggcagacggatcacctgaggttagttcgagaccagcctggccaacatggtgaaacctcatctctacttaaaatataaaaattagccgggtgtagtggcacatgcctgtaatcccagctactcaggaggctgaggcggcgaatcacttgaacccaacagccggaggttgcagtgaactgagatcgcgccattgcactcgagcctgggcaacaagagcgaaactccgtcccaga

SEQ ID NO: 172641 - DNA, 508 bp, Homo sapiens
ccccatggaagatgatgcttcctaatatccttaattattctttgaagtgtccacagcataatcttaagtgagctcgtggtcttcactgcactctcaaacctgctcttcctgcagttttctccatccttccagtggcttgggcaagaaactttggggtcatctttgacctctctcacatctcatagtgctctgcagcaaatcctcagtcccacattttgtaagattctccctactttccaggccttctgcaaagcatgaactgcaaaggctcgaggaggaaagaaagcaacactgaactcccttgagtggttagggttttggttcctaaattaaggcacagttttccttttccttgaattaattatctaactcttcctcctagggcagaatcaatgggccaaatggcctcattgagaacatgacatccaaagggagagtggcaggagtcaaagtattattataatgaatagaaataggtgagggagaaagtaatgggatttcattggtg

SEQ ID NO: 172642 - DNA, 173 bp, Homo sapiens
atggaaattcacacaccatccacagcatccattaagcacctccatccaacctcaaaggaagagtctggtgggaggtcaagtcaaatgatgtccctttttcaatgagaatagatcataactattcaaaaatctgcattcaaatgtgctaagaagaatctgggtgggcctggcac

SEQ ID NO: 172643 - DNA, 394 bp, Homo sapiens
ggtaaagactcctgttatccctattttatagatgagaacactgaggcacagagattataccagctgggctagcgagtgaccgggggaagcctccagatccatgcacacaaccgccaggtttatgacacctctagaaatgtggccagtgcccctggggtctatcagcatctcttgctagaccagcagagccctaaaaaagaagacaacagtctcccagcaaaatgttgcaagcagcacaggctcaggaatggacagactggcaggcaagacacagcaagaaggcagcagtctgcacaccaggaggagagtcctcaccacaactcagccctgccacaccctgatcctggactttcagcctccagagctgtgagaaataaatgcctgctgtttcagc

SEQ ID NO: 172644 - DNA, 541 bp, Homo sapiens
taaccacattgaaatgtctgaaataacagacatagaattcagggtctggatggcaaggaagctcaacaataaaatccagaatttggatggcaagcaagctcaatgaaattcaagagaaaattgaaagccaatgcacggaagccagaaaaacaatttaagacttgaacaatgacatggccatattaagaaaaccaaactgaacttccggaattgaaaaattcactatgaaaatttcaaatactgttggaagtcttaacaaaagactagagtaagctgaggaaagaatgtaaaggctcaaagacccagtcagacaaaaataaaaaagaatcaaaaatatgaacaaaaccagcaataaatatgggattacataaagagacaaagcctatgactccttggtattcccgagagagaagaagaaagaataggcaatttggaagacatatttgagaatataatctataaaaaatttccagtcttgctagagaggttgaaatgtaaatttgagaaactcagagaactcctgcaagatactatacaagat

SEQ ID NO: 172645 - DNA, 1027 bp, Homo sapiens
acaagattgtttcaatattaggcaatccattaatatacgatattaataaatatagagataaatcatataattatctccgtagatgctgcaaagacctttaacaaaaatcaacatcttctgataaaagcactcaagaaaataggaattgatgggtattttcttaacatgataaatatatatacacacctttgatgtataggtatatgtatatatacacacacacaccttaaagtcatcatcataatggaaaacaccaaggacatttttactagtaccatcaggagcaaggcaaggatatctagtaattacgctattattcatcatattactgggaatattagccaatacagttaagaggaatcagtagaagtacaacagaacagaagaaataaaactatctctatttgcagatgatatgatagtatatctggaaaaccctagagcagggtttagcaaactgagagccaaatttagccatatatacttggttttgtattgcctctgtcatcttttgcactacaccagcagagttgaacagttgtgataggaactttttggcacacaaaaatgaaatatttacagtctggtgtttttactgaaaagatacagtgtgcggacttctgcactagaaaatcaatggtaaaactaactcaaataataaatcagtaactagtagcctataaaattggcattcagaaattaatattttatatatatatgtatcaataactaccagttagaaaatagagtggtaagggaaaccccaattaaataacaatgaggaagataaaatacttaggaataaatgtaaccagaagtatgtaaaagctatttgagaaaagctttaaaatacttgtgaaagacaatctcaataaaaataccaacatggccttttggctctatgagcagcaccacggcagttggcgagaatgagcgccttatgaaaggtggcagaagggagccaagacgaaagtggctgatctattttctaagaaagattgatataatgtgaaagcacctgctatgt

SEQ ID NO: 172646 - DNA, 486 bp, Homo sapiens
tttttccatgttggtcaggctggtctcgaactcccgacctcagatgatccacccccttcggcctcccaaagtgctgggattacatggtaagccaccgcgcccagcctctatgctttctttcaaagggtacatacaatgcataggatttggagaggtggggaagtgtggagagagaaggtgtttttaagaatttggcatggaaggacaagcacaccttaatcctcttccaggctcaaccaaattccattctgaagtgtttaaaagcaaagctttggaatcagacacacccaggacaccatatggaaactcttgcacagtgctgggcccagaggactgcctcttcccagctttggaatcaattccctgggactcctgggagaccagcacctgacggtcagatagcttatgaggagatttggcccacagagaccataagtgccctcaagcaacaagaaaggtgcacccaaacctgacgactggatctgg

SEQ ID NO: 172647 - DNA, 463 bp, Homo sapiens
ccagccggtccaatgtatgatatgagttggagaagggtccatgtgaacagcagttgaacatgggtcagccttctctgcttcttttctagaagcctcctgcagtgtactgatatctttcttactgcactgatcatagttattctaagtaattgtttactgcttgctttccttgcttcactgctggtacctgaaaaaccagagactgcctgtcttggtcaccattgcatcattattgcctttcatgtggttgacattcaacaaatttgttgaattgaagaatcttgagaaaattgaggttgaattgaatagctcttccaggcacctaactactaattgacagaggtgactgcaaaacctgtggctttaccctattcacaatgactttatgaattaattactctgggcctgggattcttcttccataaaaatggggcagttgtactaagattaagatccttgtttc

SEQ ID NO: 172648 - DNA, 801 bp, Homo sapiens
aggctgcctagattcagggggaggggccgtagcctccatcatctaatgagaggagttttaaaggctatgttttaaagttgatatagtcccattcactgtgtgtggtagagtttgttcaattgtggtaaacttactgttttaaacttagccttcttgaacccttgacaagttgaaaagacagccttctgccctctgagtgaatactgatgatcaaaaataacaccctatactctattccttcttacctgttcattctccgatatagtatttgcaaacagacattttacttgttcaactaacacttcgtggcccctcaatcacttcttaggctttattattgttatttaatataaagaatactgtgatcttgaaaagtagagtttgagaacatcttccatgagttttaacatagaatgaagggcacaggatgtttttcagccatttcatttccaataaatagttatttgacataaagaagcttgtgatagtgccagtttcacctggcagaacacaccatcacacacacaaaaaaatttagcagttggaaaatagcaatttatgattaaacaaccaaactgcctgatttgatgcttttgtgtttccataaagtgagatactttgaagcttctctcctggagacttgtatttatcctcagtataacaggtggtggcgtaaagggttgaaagaaattatttaagcaaatattacaggaaagtggccagaaaactccaaatacaaacatatctgcatctccaaagaagcataatcatttttttaaaagtctaggtgggtttttttgt

SEQ ID NO: 172649 - DNA, 656 bp, Homo sapiens
acaaagaaaatgaaaaaccaagtcccagaccataagaatacatcagcagtacatacaagtgaaaaaggaattatatacatagaaccagaagtataaagaactcttaaaactcaacaataaaacaatctaataaagaacaaaggattttgaacatatttttcaaagaaacagatatggtcatctctctaagcataagtacatgaaaagatgcataaagccattagtcactgtggaaacaaactagaccacaataattttgcactcaactacacacctactagaatgctggaggtagggcgagtattcgcaaagatatgcaggaactagaattctcaacagataaatggataaagtgcagtattattcagataatggactactattcaaaaataaaaaggaaaaaccctttatacatgtaatgacaacatgaacaaagcataataacatgagtaacaaaaaatgccaaacttaaaaaattacatactatatgattccatttatatgaaatcataaaacaggcaaaactagtccatatgacacagaaagatcaatactagcttgagtttagggagggcagcagaatgactgcaaagtaacatgagagaacttttctggaaatatggagatggtctatgttctgaatgacagtggttgta

SEQ ID NO: 172650 - DNA, 657 bp, Homo sapiens
tgacacaaatctgcggtttaacctacattcagtaaagttctgagccacccacaagaaatgtctggggatttaactttgtggatgaaccagaatggcgttagacaaaatcaaccagatacactaagaaaaggcactgggaggccacaacacagtaaaagcagcacaaaactgggggtcagtccgggctccatcagttctcaatagtgggaccctgctttccaaatagtaaggcacaaatgataaggaatgctgcttattaaccaagaggactagcctgggagcaagtatgctaggttgtagccccagctctgccatcggacaagccaactcctcaatctataaaatggggaggagaggccaggcgcagtggcttacacctgtaatcccagcactctgggaggccgaggcaggcagatcatgaggtcaggagattgagaccatcctggccaacatggtgaaaccccacatctactaaaaacacacaaaaaattagctgggtgtggtggcacgcccgtagtcccaactacttaggaggctgaggcaggagaatcacctaagcccaggagtacagtgctgcgatgagctatgattgtgccactccacttcagcctggcagcaaagcaagagctttctcagaaacaaaacaaaccaaaaacc

SEQ ID NO: 172651 - DNA, 521 bp, Homo sapiens
ttgtgcgccctactgtcccccacacctgaggggcactcgggagacagagtactgggggcatgctgttgtcaccacggcctgctggggtcatgtcacagctcagagccttggtccccccagctgtaacgttagcatgagaatggggactctggcagtcgaggaacacccaccctcccgcagcctggctgggcaagtgctggatgggggttgcagtgggaccccaaatcttgatcagatctggggaggggaccctagcactaccttgcaggggggtgagggaccaggggtgggtctccacagaccctactgcagccacaggtgtggagggagtgggctacactggcctaaaactggcctgaagacagctggtgggagaacccggctgttcactggctggaaggacgaggacgtgctgggctgggggccacagaggctgcagctggtggggcagcttcctgcggtcacaacaggtcaacagcacctggagttagtgtttcctctaaagtaaagtatttgagaga

SEQ ID NO: 172652 - DNA, 385 bp, Homo sapiens
ttcagttatctggatttccaggccataaagactatggcttttctccagtaaccctgccacttagctggaccccagagtaaaagcagcacaaagagggaaatcatgccacatcactcccttcctgagtgtggattccccaccagagaatgactgcttctatttactcttcaatgcgttcaggtagttgctttttgttatgacccacattaatagctattatctgtgggaagattgaaccggtagggccttacttagccactcgtggaattgcaagtccgagtaaatgtatttaaacgaagtttggtgctcaatggcatataagcaggacctacaggtggctactcatttgaataaccaaaaaccagtgtagaacctcagtctataa

SEQ ID NO: 172653 - DNA, 180 bp, Homo sapiens
acttcattctaatattttgttactgaaaacagaaatgcaatgaaatgagcttattccttatttgctttacaaattcataataatttggcatttattataaccctgctgccttccccaaacatttgcaattaacccaaaagtaaatttccttggtttacgaaaaactgattttttatccag

SEQ ID NO: 172654 - DNA, 122 bp, Homo sapiens
ctggagtggcttcttcggcacctcttctccttctgggaggctctgacattagtttctcctgtatccttttacaaatccagtgttggggactgatcacctgctggaaaccatggtgagagctg

SEQ ID NO: 172655 - DNA, 177 bp, Homo sapiens
gactcgcaggaagcgagagccgcgcggctcggctcgggctccgactccgactccgattccgactgtcagccccggggcccgcgcaccccggcctgcgggcgcccctgctctcggagacgccctctgcgccgcggggcccgtgtgggcgccgggctccggggaccgctcgggcggccg

SEQ ID NO: 172656 - DNA, 260 bp, Homo sapiens
tagaggatcccccgatgttatccccaacacaagcatctaatcgtagaagaagctgcttcattggtctagctggttttctctcgtgacttataatatgcagaaatagtctggtgtggtttcaggtgtacatgtggaatgcctgcctgcctgcctgattaaagtgaggggtcgttttcagacttttgctgctagaacagctgggtaacacaggtggatcctgtgatcagtatttgaggtttcagtgttgggcgataatttct

SEQ ID NO: 172657 - DNA, 309 bp, Homo sapiens
atgtgggacagggagcaccaacacagacacaggcccagacttggaagatgtaacacccaccatccccagcacacacctgaggaaggcataggcctattttcctttcttttctttttgttttctctcctttttttttttttttttttttttgagacgcagtctcgctctgttgccctggctggagtgcagtggtgtgatctcggctgactgcaacctccgcctcccaggttcaagagattctcctgcctcagcctcccgagtagttgggactacaggcgcccgccaccacgccctgctaattttttattt

SEQ ID NO: 172658 - DNA, 512 bp, Homo sapiens
ggaagaggaatattaccaccctggggtagacataccctaaggtgacccacactgagtccacccttgtgtaatcccctccccttgagtgtgggtgggtttttaaccaatagaatatttcaagggtgatgagctattactctcatgaccaccttacattttcaggactatgtcttatcaggttgaaaacagtctcttgctggccttgaaaagcaaaccgtcatgtgctaactgcctatagatagggagacggccatgtggcaaatagctttgggtggcctctagcaccaggggcagtctctatctaatagccagtaaaaaaaaaaaaaaaaaaaaatggggccctcagtcatgcagctacaaggaaatgtattcttccaacaggctgaatgagctggaatgaacttggacgcttctcccattcaagcctccagatgagaacacagcctagtggacaccttgatggcaaccttgtgtgatcctgatcagaagacccagttaatacaatctcatta

SEQ ID NO: 172659 - DNA, 428 bp, Homo sapiens
gcatggctaattttattatttgtagagatgaggtctcaccatgattgccaggctagtcttgaactcctagactcacgcaatccacgcgagctttgcctcccaaagtgctgggattaccttcgtgggcttattgaccatttgtacatcttctttggagaaatgtctattcaaattatttgcccattttttaatctggttatttgttttgtttttgagttttagacattctttgcatattctgtatataaatcccttgttagatacatgatttgcaagtattttttcctgttctctgggtttcctttttctctcttgatagggccctttgatgtacaaaagttaaagtttgatgaagtttttcattttttgcctgtgcttttggtgtcatatccaagaaatcattgttaactcaggccttgtgaagcttt

SEQ ID NO: 172660 - DNA, 370 bp, Homo sapiens
gatattttcactgaatataaaactatggattgatggttgttattttattgttccattttctcctggtctccgtagttttgggtaggaagtcagtaattaattgaattgtagttcccccatatataaagtgtcatatttttctctttttgtcaagatttttctctttatacttggctttcaacagtttgactattatgcacttcattgtgttcttaatgtttattatcctgcttggtgtttttaaatactatataaatttaatcaaatttggaaaaaaacttgcatagaaaatatctgcagatattttctatgagatggatgaggtagaaggtgaaactttgccatcatcctctacaacattggataattt

SEQ ID NO: 172661 - DNA, 304 bp, Homo sapiens
tctgttcaggcagcccaccttgtccagagttattggccgttattctgaggcagctatggaaggagagccagattcctgctttattcctagtgttgagcattgcaaagctgctgctgctgcagccctaagaaccaacttcaggcttctgagcgcaagacaagaagatgtcatcctgcctttgagtttttcagagggacagtagtgcttattgtttgataagttaatatgtatttgaggtgtttaggcattaagttttcttattttgcttttttcgttgttgtttttgagacggtgtctcgctcta

SEQ ID NO: 172662 - DNA, 285 bp, Homo sapiens
ccatagctggtttctccctccttttctctcaactttgctgcccttggactgtaagtacatctttcttctcagtgcccacgcttgctggggatgtagcagcctcctctcacatcaggccaggcttgtcctgtccctggcacatccgtgcttgtttcctctgtcttcatcctccctcatcatctaagtcctctgcatcatacaccccagttcaaatcccacctccaacaccacgtcttcctcctctatgccagaattcacttctcatgagggggcttctgggtgctg

SEQ ID NO: 172663 - DNA, 426 bp, Homo sapiens
gttgagtgagaactgtctgccaagggagcgtaggaaagatctgccctggcttccgagtgcctagggtcaggtcctggctcttccacttactagcaacctctttacttccccatcctccacttcctcatctgtgaaatgggatggtcatagatccctacattgtaggattacatgagtaaataaaatgctatgtacttataaaacaataacttactgttcaggcactgacttctgaattttcttggaggacagttcccacattttgtgactctgcttttgtcactctgctggtcatgacagctgcctttctctgctcatttgatattttctaccagtataaaaacagatcacaccactgcactccagcctgggcgacagatcgagactctgtctccaaaaacaaaaggaaatcattccagataaagc

SEQ ID NO: 172664 - DNA, 328 bp, Homo sapiens
cagtctgtagagtgaaccaaaatggctatacctgagaaggtgacctttgtgttgggaaatgaaagctgagagagatgtcgtcagatggaagagaggaggtattccagatgaatggaaaagcatttggacacaccaaagaacgacaggggcaagttttataagtttgtactcttaatattcatggcacagagtaggtattttctcaatgaatgaataaaatgggatttcacattgcaaaaatgtcattgtcttcattatttaaagtcctgttagggtagcaatataattaatcattcatggttggccctaagctggaaatagaccttgt

SEQ ID NO: 172665 - DNA, 432 bp, Homo sapiens
tttgtggccctgagtgcccctccagtggttgttccctctgctcctgattgttccctctgctccttatgggtgtgctgtcttacccatcccccattgcctgggaatctaggcagtgagcaggggcagtcagggagctctcagggattgttgtcttgggcagcctgatgtccaggatctgaaaactgtcgttgcctacgtttcatcacatttgttagttgtttcaggcaggaagacaatgcttagttctcccatctcagccagaagtggaagtcctttccccatggggacatttctgacagtccatgtctgtgtcagagctcttctcaggcccagctggagtggatgggtgcatttcttagtagccccacagctgtttgtgggcacagtggaaatagagaaaacaatgtggatgggtaggacttctggttatta

SEQ ID NO: 172666 - DNA, 154 bp, Homo sapiens
agcactgggtctgaagtttgagccatgtcagccaagggttagagctggacacagaagccactatagggatctcaagtagaaagggatttaatacaggaaattctgtatttacaaaatccttgcaagaaaaaaatctggcagtctaaaaaaaaaa

SEQ ID NO: 172667 - DNA, 1577 bp, Homo sapiens
caaccctccaaatgactcccacctcctcccaggaacgtactgctaaaacgtgccttgatcttacatactttctaagtgtatttttgacttcccagtagccattgctctcactgtcatgtatcagatgtgccagtactttctctcagatggggccctctcctgatggtaaatcctcagtcatattacatgtaattcggttaccactaggactctgctatattgctcttctggacagttcccattgaagcttctggtcttcaatgtttatgctcttatacgtaaattggagtttttagtcatttcatctccttataatgctgtggggtcagctatggacgattttatttgctctttttcttggcctgtatggtttttatgaggtgggaggagaggaagtagaaattagaggatcgtgggccgggcgcggtggctgacgcctgtaatcccagcactttgggcggccgaggcgggtagatcacgaggtcaagagttcgagaccagcctggccaacatggtgaaacccgtctctactaagaatacaaaaattagctgggcatggtggcacatgcctgcaatcccagctactcggaaggctgaggcaggagaatctcttgaacccgggaggcggaggttagagtgagcccagatcatgccactgcactccagcctgggtgacagagcaagacactgtcttgaaaaaacaacaaaacaaacccaaattagaggatggccattaacctataggggacttaatctgtgttttttatgtgctatgcttgaaaatatttgtgtttgctttaaaataatttgcaattcaggttttgtataattggataattggttatacttctgttttaccccattgttctctcttcaaactctcttggaagtatttgtcatggaaataactatgaggttatattttatagctgtctgtcaatcatgtgtgtaatccttgttttgcagatttctactcttatcaagcaggaatctgaaatgccactttaatgttctttcttcaagtgacataatttcatgctacaaagtaaatgaaatataaaatctggcacattttatgatacatttacaagagtataatattcagaaagtggatggtgattgttgcactcaatttgcttgctagtaagaccatatatgtaattttcacttctgtgtccaaaacttccaaagataaagaccaatgacgccctaatgcttgtactccacaaaaatattggtgtaaaattccttacagatctttcttgtcttttttattctgagactgagtatttattacctttataatattaagatgctttttgtgtgtgtgtgtgaaatactaacgccaaaattttttttaatggcttatttggaaaaataaaaatttagcaattccatttcggttcccccgtttgtttttttgaaaccctattagttttttaaatatacggtgcttctttggcagcacatatactaaaattggaacaatacaaagaagattattagcatggcccttgcacaaggatgacatgtaaattcatgaaatattccatgttttcttaaatataaaaaaaata

SEQ ID NO: 172668 - DNA, 195 bp, Homo sapiens
ccccagggaggcacacaccagggcagggctaggagacactcagcctcagtagccactttccagtcaagggcctggggtcacagaaacctcagggctccttcctgtaagtcggggtggttctcagcagcaagctttcactttccatgcctggctgggacagctgggtattgagactgaagagacagcccacctctc

SEQ ID NO: 172669 - DNA, 179 bp, Homo sapiens
ggagacttgtgcaatcacagattactgggcctcacccagagtttctgattctgcaggtttggaagggcctgagaatttgccttttcaacaagttccaggtgatgctggtaatgctggcctgggaactacattttgggaactattgcattgtagcaatccaataaaattagaatagcaag

SEQ ID NO: 172670 - DNA, 520 bp, Homo sapiens
gagttaagaactaaaaaatgtcaccactgagttagaaactgttagaaggctagtgctggatatctggttaaactcgtccgatacactgcagcaagactaaaagacaaaaagaaaaaggtgtgtatctatgcaaatttcgctaatatggagatagaatttcactaatacggacatagggactgagagaatcatttgacttattataaactttaaaacataattgggttctaattcataaagaatgtcatttccattagacctgtattacaaaaaagaaaaaaaaagtcatcctaaatcttaacgtacacacgctttatcaaaagaatttccgtacccagaaatcaaaggcacttcaaaagtctcatttcgtatcttgagtttgttttaacatattcctcccgcaaaaacgctctggaaatcaaagaaaacttttttaaaatttaattcaataaaaatgacaccgactggctgaattatgatgggttctgagtggcggttgaaataacacatttttcctcta

SEQ ID NO: 172671 - DNA, 521 bp, Homo sapiens
atgagccaccgcgcccggacaacacagtgttttaaaccaatgctgggataaagcatccaggctcttaggtccctggaactcaatggctgacagtcttgctttcagtttttcctctgaaatgaggcaccatttattcatgcagtgtgttgtggcaccacaaggactggcctcaggggccagacactgagagggagtaggagggagaagtaggccaacacacccaggcactctctaaaatcaggcagagcaactgccagttataggcgagttgcattttatggtagaattaaaaaagttctctctctctctctcttactcccttcctcctccgtccacatctctgtcctttgtccaaaatttgccatctgactattatgcagactcttctcaaatttccactggaagacggtgcgttggcccaactgagccaacgcaccgtacggacaggattgacagattgatagctctttctcgattccgtgggtgacggtgcgttggcccaacacggtgcgttggcccaa

SEQ ID NO: 172672 - DNA, 639 bp, Homo sapiens
atagaataaaaaatagcatgcagaagaatgagtacttcataagacagttctagtgtccccaaatcatatgaaattatgaacacctacttaactcagtcatcaaagaaatgcatatttaaaacacagtgagaaactactgtacaatcagtggaaaaatgaaaattttaattccaagtgttggtaagaatgtagaataagtaaaaccctctaatactactgttggagcataaatctgtacaaccttgtgaccagcaaatccattcttgggtataagcccagcaggactgagtatgcatgttcaccaaaagacatgtgcaagaatgttgatagcatcagcattcataatagttccaagctaaaaacaacccaaatgtctgtcagcagtgcaatgtataaataaatggtggcatattcataaagtgaaatattgtactgcaaataaatgaaagaaccattgctttatacaataacatgaatgaatttcgcaaacacaatcttaagggagagaaaccagatgcaagagagtatgtattatatacatttatataaattatgtaagtttcagaaacaggcaaaactaatcaatgatattagaaatcagcatattatttacttgaaggaggatttgggtaatgatgg

SEQ ID NO: 172673 - DNA, 354 bp, Homo sapiens
ctctgggatccttttccagatggtttcttccttttagtggaaggttttccatttgaatgatcaaataagggaactgactacgtaagcagaggagggttagcctaagtggagaaatgaatggcttacaacaacgatttctagacttcaggcattctcctcagcattcataaattttaccatgatcaatgacttgatatttttaactgactccattttttttgctttaatgcattattcaaaagaaaatgcttacatcacttccataaatggaagttgaccttctttcgctatacaaagatgcaaacctgaaaattaactccatgaacatcatcctaaaattctagccagatatgg

SEQ ID NO: 172674 - DNA, 271 bp, Homo sapiens
gagctcggtaccgcttctgcttctgaccttcctcttcctccatagccaagtctgagagcttgaagccttggccccgccttgggcctcctcgcagccctctccctcacctaagaccctgcctcaccgagaccctgcctccaaaaagaaaaaaaaaaaatcctgaaagataagaaaatcttgaaagtagtaagagaaaaatggctcatcatgcccaaggatattccaataagattagtggctgactgctcatcaggaataatggaaggcagaa

SEQ ID NO: 172675 - DNA, 292 bp, Homo sapiens
tgactaagctttgcagagaaatatcatcttcccaacccaatgattagaaaacatctgaaaatctcaaatgcacatatggatgtatccgtgccggtgttaaagaaattgcagtgataaaatgagaaaacacggtttccttgatctgaagtattgatttttaattattttcggcccagagctgaaggtggcagaagagtagcccaggagccgagggctcggtgctggcgcggacgccttcccagcctgcggggtgtgcacagggcgcttacccactcagagtagaacctgggag

SEQ ID NO: 172676 - DNA, 165 bp, Homo sapiens
tctctacaaaaaatacaaaaattagctgggtgaggtggtgtgtgcctgtagtcccagctactcaggaggctgaggtgggaggactgcttgagcctaagaggttgaggttgtctgccactgcactccagggtttagggtagaagaagcaggagttcctgttgattg

SEQ ID NO: 172677 - DNA, 622 bp, Homo sapiens
agccaacaggacatgggctgaccctgcctgtggctactttacactcttacccgtaaatgtttgaaacgaccttgccgttcaaatatttcaaacttgaaacagactttgtatacttgggggttatcacctgtctgaaggtgaaaggtgggagctcaatctagtcttaatttgcatgtattttattatgaacaaggctcagcatctcttcacctgaagcacagacacctacattgatcagggagtgaaggggtcagagagaagaatgccaattatagttaattcacctcatctgccagggatggtccattcaggaccatcaatcagacaaatgcccaaacaggacacgaagacaatcccaatgagccaaactagccagctaccctccaattagctcaagaactgttctcgaaaaactgaaaggcaacaaagtcccataggaattaaaaacgacttaactacactctgcacacactgtaaggaacaatgtgttcttgtaatcttgtgccccccactcgctcctcttgtaactgccttccagccattcatgccaccatcctctctctccttatcttgcattgaaagaacaatacagtggacaaaaagctaaattaacttataaaaa

SEQ ID NO: 172678 - DNA, 271 bp, Homo sapiens
tgttggccattcgtatatcttctttagataattatctattcaagtcctttgcctatttaacaaattgaaccatttattattgttgagttgctggagttctttattctattatacatattatatccacatatactgatgtcatatcacatatgtgatttgcagacatcttctcccattctttgagttgttgttccactgtcttgagggtgactttttttttttgagatggagtctccctctgtcgcccaggctggagtgcagtggcacaatc

SEQ ID NO: 172679 - DNA, 460 bp, Homo sapiens
ccggatacctttgattgtggagcccagttactggaacacaagctttcgcctgggttaatgctgtctgagggctgagtttaaacattggcttctcagctctggaattattctgcctgattaaaaacaaaaataagtttgcattggcaatataagttagttagatagcccatgttagtgccacccatgatgataaactaggccagacattctagtagtatcgcgactgggagagaagatgtagaaaacaagttggtgggcaattttcccccgatgtcttctttgttcacctttatatttcaaagtgagttggaaggagatgccagaaacagaaagggaggtggattaggaacccttcggtaatatttctttataaaatgaggaattactgcatgctaagttgtgatgctaacaatagatgttaacaagaataatgcaagtaaaataactggcagtaaagtaa

SEQ ID NO: 172680 - DNA, 415 bp, Homo sapiens
caagccttctgcttaggagttgataaaccagaactagccatccactgtcctctggaaatttcttcacagctgagactctccaggacctttgtaaaacttcaccttgggcaggcgcggtagctcatgcctgtaatcccggcactttgggaggctgaggcaggcggatcatgaggtcaagagttggagaccagcctggccaacatggtgaaaccctgtctctactaaaaatacaaaaattagctgggcgttgcggcacgtgcaaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggt

SEQ ID NO: 172681 - DNA, 775 bp, Homo sapiens
ggccaacacagcagccattcaagcaatcctatacaaccgatatcgccgatacggggccgcgggaggtgggtgcttctcggcggcgagctgcgactcggagagactcctgtccgcaggtgcatggcttccgggcgggcctcgggcagcgagctccagccccactgagaggccgcggaccgcctggggacttgtgtttgtgtgtattttaagccaacagcccagaaagggaaggcgactggcccccggtcttcgccagtgtttcccggccgggttactggtggtcaggagggaagccaggaggctgccgggctccgaggccgattccttgcgaaccatctccgttaaagactccgcgccgggcagcccgggactccggcggtacccgcgcaaactttgtcccagcgccttggctcaccgtgaatgccctgccttgaaaatttggagttttttgtttcctgaaagtggtctgcttttccgattttatctgtgttttccatttttaccttcttattgtcaatttgttttcaggcattattaattcaacaaatctttgtactgccccttaccacgtgtcgatggttccgtggtttggtggaaatagatcgcgctttgaagtcaagacggatcggccatggaattttggctctgagatcctctgtgtaaccgtggatgagctacaaggcctgctgagcctccatttgtctggttttgtggttgttttaatttatctttttccatttgaagttgtgggttttgcataaaattgaactgttac

SEQ ID NO: 172682 - DNA, 205 bp, Homo sapiens
tggtgtatgtgtaccatatttgttccatattatgtttatgagatctacttatgtctttgtacatagttgtataacacaatgtggctataccatagtttattcattgtactcgttttctgttttgggctgttagaaatcgtgctgccatgaatcttcttagacatgtctttggtgaatgtatgcacatgtttctgttaggtgtata

SEQ ID NO: 172683 - DNA, 146 bp, Homo sapiens
gtattcaacattaaattcaatttatttcacattaatgtttgcaaatacatcatcaattcttacatatttcaaatcaacttcaagtacagaaggcttcctctcaaataagtctcctgaggtgacataaagactgaaagaagcctatg

SEQ ID NO: 172684 - DNA, 431 bp, Homo sapiens
actaagggaacagagatgaagaagacattggttcccccaggaagagaggcgggaaggtggaaggaagcaggaaaaggcagataggcctagaatcagactcactacttgagatgggatgaaggtgaagaccctccctgacaaaagagtagtaagcaatagcagacaattctacctttaccgttggtgaggaacacaacaaaaaacaaaaccaaaaatacatttgggccattgttttcattctcctgctcctatgccttcaactaggagcttgtcacagctgataataagcaaaggggacatggagggggttcatctcaccttactagatattctctgatgaaaatctttacaaggagctaggaaaagcaaaatatagttggtcctccatatccatgggttccatatccatggattcaaccaactgtggatca

SEQ ID NO: 172685 - DNA, 252 bp, Homo sapiens
ctgtattcttcgttgattgtgaacctttgtggtagagactggggaggacagtaccagctccaaaacaaattgttccccaggggaccgaccatccatgtaggtaggcaaaacaagatggtaaaataagatggttaagagacagtgcaccgcagtgtgtgttcagcgttaggtggaataaggaagaaatccctgtggatcgggaaaatttcacaaaagacgaatggaactgatgatcaaggaatcgacctttta

SEQ ID NO: 172686 - DNA, 289 bp, Homo sapiens
tgtgaagaactagtccatgagtctcatcatcctcaaattaaggaagctctgaatgtgatttgtgtttccttaaagtttactaataaaacagtagcccacgtagcttgtaacatgcttcacatgctggttcattatgtacctagacttcagatttaccagcctgattctcccttgaaaattattcaaatcctaatagctaccatcacccatcttttaccaagtacagaggcttcatcttatgaaatggacaagagggtaatttaaattttgtttgatgattagtatgtgg

SEQ ID NO: 172687 - DNA, 279 bp, Homo sapiens
tccatgccaggcactgtgctatgccttttacatactttatctcttttagtccgctgagtgtcgctaggagctggacatctgttattatctcatttccctgaggtgttgagtagttaagtaactttcccaaggccacaccatggtttcaaagcctgtagtggcattcaggtgttttggactcgcctgaggcctagcaagcttggggaagatggaaggcaaaagttggggaggggtggctttggtatccctcctgcgtttgctgttggtaaggccagtgac

SEQ ID NO: 172688 - DNA, 148 bp, Homo sapiens
aatcccgtcaagcaaattgtgtgtcatagaaagtcttaggacagccgtgtatattttctcccccaatgaatcaattgaaaatgagaagctcttaccgccatgttccgggcagaagctatcaaaagtataagccatgatattataattt

SEQ ID NO: 172689 - DNA, 700 bp, Homo sapiens
ctactaaaagtcatcttggtgcgccatgccaggtaccttgctccagtcaatagagattttcttttgaaggtaagcaatttagagaatgaatttgctctgccgtctggttggaggatgggtgccaaggttagatctttaaggaaataatcttattagtccctcttattaaggaagcctctgcagtgagtagactttgaacctgcctgataaaaagtaggtcttgtcaaacagctcacagctcctagtgaaaaggttgaactttgttggtttagatcatccaatccaaatgcaaacatgtttctaagcttctgtttgcatactctgggagaaaaagaagacttccttttttttccttgactctgacactaatagtattctgaggcgatggcagctcccatggaaattactaaatcacggtgttagtggcgcatacagaaaggcagaagtttccagtgtaacttgaaatgtaaagcttccaattgtcactgtttgggtccttttatttctttaaatcttcatttttttccccttaacggaacttggtctccccatttcgccaccattacatgtccatactaaccccatctggaagctgtaaggctgaaattttgacagctttgtcattttcatagctgtgaaggttgatgttgagcttacaggattattgctctccaggaatacttcactttaacttcaggaa

SEQ ID NO: 172690 - DNA, 525 bp, Homo sapiens
tacgcattcaagcctaacaccctgcctctttctctcacccctaccacccacacgtttatctaagaattctttgctgctaattcacaaacactaaaaaagactttttgaaaaggattaaaaaccatgttgtgttaagcagcaaactgatgttacatcctgggcacgaggaaaatctgtgtgttagactgtgcctagcatttaggtgccatctgcaattgttcggctgtttgcattttcatggttccttttgacagtagttccaaacagctcctaatttttgttcacagagataagtgctaaggattttagtacagtgctcctggctgtcatatttctaaaaaaatcaagtcagcagctggtggcaaataaaccagtgctctctctttcactacctgtaacttggtatgattgtaattgttaataactggtgaaaatacagggataagctggctgtgagccacccagcagaggtggactcagccttgcaaaggaagctctttgaagggagggatactgttctagtca

SEQ ID NO: 172691 - DNA, 478 bp, Homo sapiens
cacaacttagctttaaaaatatttacagtaactacctcaagttgcatatacttctgatccttttccacaaaagtagtttgtataacaacaaaatgagaagggacacagtccgtattccagaggagagaattaacctcttcttacctcaatgttccctgacatcaagggggataataatatctaactcagaattatggggaagactaaatgagataatccctggcacttagaatggtgctagacaaaaagtaagtgtttagtgaaagttattattaatataaaattagaaagattaaaatttgcatgggccacagtggctcacgcctgtaatccaacactttgggaggacgagatgggaggattgcttgagtccaggaatttgagaccagccttggcaacatggtgaaaccccatctctacaaaaattacaacaattagctggatgtggtggtgcacgtctatagtcctagttactcaa

SEQ ID NO: 172692 - DNA, 152 bp, Homo sapiens
tggagattaggtgctatatttagatacagaacatgcctctgacacttgggggttgaatgtatctagactggaagaaaacttccatcagcatattcaacgaacaaaatgtaagtacttatattatccaaaacacaagagaaatggataacagg

SEQ ID NO: 172693 - DNA, 671 bp, Homo sapiens
ctcaccctgccacccaggccagagtgcattggcatgatctcggctcactgcaacctcccgggttcaagcaatttgtgcctcagctcccaaccacttgggaggctgaggtggaaggattgattgagcccaggggtttgaggctacagtcagctatgattgcgccactgcattccagcctcgggaacagagtgagactttgtctctaaatatatacaagtcactaaacaaaccactacaacccacagcaagtaacaaaaaccctgaggagtgaagaatctggtttccagagttaatagtaaagtaatattcagctttcaacaaaaaactgtgaagcatgcaaagaaagtatagcccactcagaaaaaattagaataaactatctgaggaagcatagacattggactttaagacaaaatttgtaaatcaactgtctcaaaagtgctcaaagagctaagggaatacagggaaacaatgtctcatagagattgtcaaagaaattataaaaaggaaccataaaaattagctgaaaagtgcaataaaaaaaagggggaaaaaatggttctaatagcagatatggccagacagtagaaagaatcagtgaagctgaaggtagatcaattgaaattatccatctgaggagcagaagaacaaaggaaagaagcaatttaaga

SEQ ID NO: 172694 - DNA, 409 bp, Homo sapiens
aagagagtaacttatagttctacaataggaataagaccttgccttctcagtagtttctattggtgtttaataccttgaatgtgggcaccactgagccaaagaaactccttcagacaagggtgttgtctcactatgctgttcacagttgaagcaatgaaggcaaacatatctggccaattcaggtcaggcagtgatttgactcattgctggaagactgtgatcagtctttttcagccaatgcccctggtatctttgagatgctagggtggaagtggctgggagaaatcacaccacacccaggtggaggtgcaccaggtgcatcacttctgggcctcctccccaggacctgccgtgcacaagcgctttcctgctagagttataccaatcacaggcatatctcaatatgaga

SEQ ID NO: 172695 - DNA, 302 bp, Homo sapiens
cataaatcagacaggatctccctctgttgcacaggtgagtgcagatgagctatctcagctcatgcaacctctgcctcctggatcaagcaatcctcccacctcagctcctccaacagcaatacggtggggttaccactgatctagctaccctatggaatttattcaccctgttaatgagtggctaagatttaataatcttaactaaagttcccaatttcctaatggactcaacacaaaacatttgaaagctaatttcagtgaccctagtttttggtatgatgtagtattaaaatgcaggtcta

SEQ ID NO: 172696 - DNA, 891 bp, Homo sapiens
aacaggattggatggaaatctgcattccttgatcactcagtctatagggtgaacttacaatggccctcatgcttaatcttgaaatacagggatggtctgatggagtgtgctggagaccctgctgagatctttggacaactcctctccagtccactacctgaatcctttctcttctcctcaaaaaaatctgagactatccaaatgaagagtaaataaagggagaagtaagaaggaaacatgagacagagaggcagcaggagcagaatgaaacttggggagcagagggagaagccaagaaaacttactggacttggagccaataaattggccatggcatgaaggtttctgccagcaatatggcagcccattccagctctttccattttcttttcccagctgtgctgccaagcaccatgcttaggctggtttaacagagattatgctaggaggattttctaacattcatgtcctgattaccccttatctgattccttagcagtagccttcagtggcctcagagaattccaggttcagctgtctgaacagttcaatgactgtttgtaagttctgacttacgatcaaggcaggaaatgtgaaaagcatttttaaaaaggaaaaaaaccatccggcgttgttaacatttttgttattccagtattttcccatgcatataaatatgtgtacttcttttatttttcacaagagtactctcacaccataatattgttttataaccctcttttccactgtgctctagtgtaaacattttactgtaccaaatctttttccacaaaaggatttttaattactgcatagatttctattgaacggatgtactaaaatttacctaaacagctcttattattcaacatgattcaaccattgttacaa

SEQ ID NO: 172697 - DNA, 502 bp, Homo sapiens
agatggagtctctctctgttgcccaggttggagtgcagtggcatggtcccgggtcactgcaacctccacctcctgggttcaagtgattcccttgcctcagcctcctgagtagctgggactacaggtgcatgccaccacgcctggctaatttttgtatttttagtagagacggggttttaccatgttggccaggatggtctcgacctcctgaccttgtgatccacccaccttagcctcccaaagtgttgggattgcaggcatgagccaccatgcctggcccatttaacttctatattattttcctgttggtggatttaccagtgcaaactgagcagcttaaaacaccatccagttattatctgtttccatgagccaaggctctgggcagggtttaactgggtcttctattccgggtcacaatactgcaaccagagtgtcagctggggtctcatcagatgctcagtgtcctcttccaagcttattcagtttgtggactgaattc

SEQ ID NO: 172698 - DNA, 225 bp, Homo sapiens
gtagcagaatgttttctgtttttttctctcgattttcccttcttttatttattcatttatttgtttgtttttttgagacagtctgactcttgtcacccaggctggagtgtagtggcacagtctcagctcactgaaaccgctgccttgaggtagggattcaagtgattctcctgcttcagccacccgagtagctgggatcacaggcgtgccccaccacacccagct

SEQ ID NO: 172699 - DNA, 342 bp, Homo sapiens
cccatagaccatttcaagtaggatgaaacttgttcttattccttgctgttttcattctcagtgtaaactgtattctcaaagctgtagatttcacatagaattcacaatgtagagcagagtttctcagccttggcactgctagcatctgggccagataattctttgttgtggagggttgtcctttgttgtaggatgttaacggcatccccaactagatcccagtagatctacccactagatcccagtagtatccccagttgtgactaccaaaaatgtctttagatgttgccaaatgtcctgacagaatgcaaaatcacccccagttgagatggattttcacca

SEQ ID NO: 172700 - DNA, 538 bp, Homo sapiens
tcattctgtcttgcctgccaccatgtaagatgtgccttttgccttctgccatgattgtggaggccaccccagccacgtggaactaaacaggatctcactttgtcacccaggctggagtgcagtggcatgaacacagctcactgcagcctctacctcctgggctcaaacaatcctcccacctcagcctcccaagcagatgggaccacagggatggggttttgccatgcccaggatggtcccgaactcctgggctcaagcaatccacccacctcagcctctcaaagtactgagattacaggcatgaaccaccattcccagccccatctcaatcttaagaggcaccacagcaaagtgagaagacagactacctggctctgtcaggtctaattgtgtgaccttgaactctctgtgcctcagttttcttacctgtaaaatgaggatcagatgctttataattctgaaaatgtacagaggcaatgtattttagaaagcttggaagaatggttggtaaatgtttaataaatgttcatttttattg

SEQ ID NO: 172701 - DNA, 362 bp, Homo sapiens
ccccaggacatcagactctttttttccccagcagcttcaactctatgaggaaggtgagacagggctggggttgctgctcggccgcttgccttggccggtgccctccctcttattctgcagtctgtatagaagttgcatccatttgccagccactctaagaacaaagtatggccagaactaggaagtaaccttgacagagttcttgaactcctcagagggaaaaatgttctttattccattatcatgttaaaaatcagtaaacttgtatttaacaatgtacttctgcagttgtacagctgttgtacagtttttaaagatctttgaattctattccttgtttcaaaacagaggaaacagagaca

SEQ ID NO: 172702 - DNA, 362 bp, Homo sapiens
aagtcaatggacaagagataactaacataacagaccgaagcaaactaaatcccaggccagcagtggcgaagggcaaagacccaacctgatttatggtgcaaaatccctcaaagacacaggaaattggtggcaagaggtgcttcaggtgggggaatgaaggtggttaaaaacaggaagaatgggttggagatctgtttatagagcagccaaagctccaaacgttctctcttctgtgcacacccagaggacagtgagcagtggaggcatgagtgatgcagtgaaaacaagggaattaagtgaatttacatggtgagggctgaggtagtcactctccacccccaggcctcttctttttttttttt

SEQ ID NO: 172703 - DNA, 757 bp, Homo sapiens
taacaatctcagatgagactaagtgggtctcttacttttgtgtcgtctagtaaggagccataactgaaatatcctcctttttattaccataatgatataactataggaaaagaaaaaacatgagccatgattgacagaaattactctccttgtcagagatcatttcctctgttgcagtgagccaagattgcaccactgcactccatccagcctgggcaacagagcaagacttcgtctcaaaaaaaaaaaagaaaagaaaattcctttaacaaggttccaccgtgtggttataagatatatcgcgcctcggaggagaaattttaaccaccacccttgtggtttcaccccagcgcatattctactatccccgggaggaagcgcagtagtgtagtgtgcagagaaaaccccaagggaaaacccaggtgtctcctagaacactcacggagacttaccagggggtacccaaaattcccacgcggggcctatatttccccgtggaacaggaaaagcaaaaagcaggggccacaaaagcggggaacttttcctgtggcaccacgggatacgtagggaacatcacccggtggggctactctctcttgaacaaaagactatctctaaaagaaactttaaaaaagcagaaggtctctcctgtgttagcaaacgaaagaaaggccaaacacactaggggggaccccccgaagaagggggaagaaaccccccagtgggtggaaaacaccaacccacagaggggccacag

SEQ ID NO: 172704 - DNA, 577 bp, Homo sapiens
taacaatctcagatgagactaagtgggtctcttacttttgtgtcgtctagtaaggagccataactgaaatatcctcctttttattaccataatgatataactataggaaaagaaaaaacatgagccatgattgacagaaattactctccttgtcagagatcatttcctctgttgcagtgagccaagattgcaccactgcactccatccagcctgggcaacagagcaagacttcgtctcaaaaaaaaaaaaaacattaaaaagtacacatgtctaagtatacatgtcagtgaaattttacacacttatgtaaccagcatctacatccaggaagcagatgattgccgacaccccagcaaccagttctcacactccgttttcaggtaccatcccctgcctattcctgcaggagtaactgctctactgaattctgacagtattgattaattgtatcttaaaaaatcaaaacttaaagattttctgtcaacagagcaaccagggacccagaggcagaagccaggggagccaccacaggcagagggcacagccttgagtcagaggattgttctcagaccttga

SEQ ID NO: 172705 - DNA, 447 bp, Homo sapiens
tccagcctggttgacagagtgagataccatctcaaaaaaaaaaaaaaaaaaaaaagtgtggattcctgagtcctatcccggatttattagattacagcctctggtcgtggagcccaggaatcgttattctaatactttccaggagagtctggtatgaatcctgagccaagaagcactttttcagagcttagaacaatgcttggcacatttcagtgcttaataaatgtttgttacattgaaattaaagttgtacaaatggaaatctacttgcacaagaatatatagtagagtggtcgggcgcagtggctcatgcctgtaatcccagcactttgggaggctgaggcgggcggatcacgaggtcaggagatcgagaccatcctggctaacacggtgaaacctcatctctactaaaaatacaaaaaattagccgtgcatggtggcgggcac

SEQ ID NO: 172706 - DNA, 447 bp, Homo sapiens
tgagacggagtttcgctcttgttgaccaggttggtgtacagtggcgcagtctcggctcactgcaacctccacctcccgggttcaagcgattctcctgtctcagcctcctgagtagctgggattacaggctgcaccaccatgcccagctaattttttgtatttttagaagagatggggttttttcaccatgttggccaggctggtctcgaactcctgacctcaggtgatccacccacctcggcctcccaaagtgctgggattacaggcgtgagccaccatgcccagctcagtcatccttttaatacacttggttcttcttcacggcactggtcactttatgtttgcaaacctccttggtgggttagtttgtttaatgttgaaaggcctactcagcagtaaggtgcatgagggcaggattttgtctgccttctgtgctgtgatattgca

SEQ ID NO: 172707 - DNA, 462 bp, Homo sapiens
agcgaaattagaatatgtgcataatgcaatggggatataaaatgtcatagctgctatggaaaagagtatagaggttcttcaaaaaaactaaaaatacaactaccatatgatccagcagttctactcctgggtatatgttcagaaggattgaaagagtaatcttcaagagatatctacactccatgttcactgcagcattatacacaataaccaagaagtagaaataacccaaatgtccatcgacagatgactagataaagaaaatatggtggccgggcatggtggttcatgcttgtaatcccagcactttgggaggccgagactggcagatcatgaggtcaggagatcgagaccatctggccaacatggtgaaatcctgttactactaaaaatacaaaaattagctgtgtgtggtggtacacacctgtaatcccagctacttgggaggctgaggcaggagaa

SEQ ID NO: 172708 - DNA, 180 bp, Homo sapiens
gggaaaaagatactgagtgtaaaagatattgagtgacaattggggggggcatgtcctcatatctgaatatagcattcatataagccatctaagtgtcttaaatagtggataaaaatgatattggcaaggagtagagaactatttttatctatcaacattcagagggaaaagacgaaatct

SEQ ID NO: 172709 - DNA, 377 bp, Homo sapiens
tctctagaagctcgctgtaagtagttagaggtaacaatgcagcagcctgagcgctttcttgcttcaaaacttcttccaccagatgcactatttcattacccttaagttcagccttccacaaacccctagagcatagacaaaatgcagccaaattctttcccatagttaaaaaggatgaactttccttcagttcccaataagttttttattcatttccatgaagagacttcattaaaacagccttcaccatttatatttctttattattttttaaatatttaatttattttaatttctattttatcatctataattctagcagcattttggtcacaaccacttaaccaatttctaagaagttctaaacttttcctcac

SEQ ID NO: 172710 - DNA, 400 bp, Homo sapiens
agaattgggttaggaattaaagtttagtgacaaatttagaaacatccaaatccattactgagttgccaccatatgcacatactattgtatttgcttgagaaagttgaaaaaatattttgagacaatttctgtccttggagattttacagtctgataggagagataagataaatgaaaaaatcttaaacacacatgcacagatgcatataagcaggcacacacacatcctacatacagatacacatagtaatacgtgttaagtaaatataaaaaacagccagaaaagacatgatgtgttagaagtctagagactttgtatctattcgtattcctatcattattttatttgcttaaatattcttatcctgttttattctctctaaatatttgagatagtaaa

SEQ ID NO: 172711 - DNA, 309 bp, Homo sapiens
tgtgtgcctcatctggcctatgaattctcactgctgtgtgtttcatccttgctttggcactttgccctgtgtaccttctcgtccagttccactttcattggctaccatgaatatcatttctcctgggccccaggctcctatttcctgtccctgaaagtaggtctgggcttcttgggtcaaacaaaaatggtatctacaaattactttgtctcaaggagtgtttctagatatagttagtgatcaaaaatgtgcttccaaacaaggaggaaagcttgtgggtaaaagccttgatagtaaaaaagatgttta

SEQ ID NO: 172712 - DNA, 555 bp, Homo sapiens
tagttgtattccttcttgaaagttagattctaagtcaaaggtatatttttaaattttcatagctaccaccaagactacactccaaacaggttgcagtaatttaacttgtcactgtgtgacagtgtttgccaaagtctgttctttcagagtatgaggttcttttggtatgtggcagtatggaactctaggccttgactcttgcttcaaccagaacatctctgcatccagtcttaagattccttatatagttttctttgttcagaagataccacaactttaaaaaggctcagggtgaggagttggtgggggtgtaaaaatcattggtctcctggaacaagaggggaggacattggtgtcaaatatcaagtcctcaatttgcaaaacaaaaaggtaaaacagccttccaagtggagaacagaataacccatttcagcaaaccataaagagtatgatacttagagcctagggacaacagaaagaggtgtgagacaccaggctataaaaatggcaggctctgaattatgccaggcttcaggagtttgggtctttaggcct

SEQ ID NO: 172713 - DNA, 261 bp, Homo sapiens
gggaggggaggaagagcatttctggccaagagaaagcaacgtgtactaaggcatggaggtgtgaagtgccattacgtgtggttttggaagatccatacaaatggaaataaagaatgggtttaaaggtttggatggatgtgacactagagggatggtgaggggccagaacatgaaaagccttgtgtggtaagcaaatgccagtgtcacagaagcttcctatgtatgccccacaatctgtatagcctgcctcctcaggcaaac

SEQ ID NO: 172714 - DNA, 499 bp, Homo sapiens
aggactgtcacgacggcccccatccctcagaggacctggaggtgacaccccagcctgtggcaggcccaggagagagcgtcagccactgcccagaccaaggacggggccacccatacccccataactgcaccatgagcacaggctggaggcccacctctgaccccacatctgatggtctttctgcctctgggatcataagcccgttttaagaggccaagcttccctctgtgtggtttgtctgaattccagattcattgctttattcccctaacacatttatataatcagccactccccaaatcacaaggaaatttatttaaaacattttctccaatttaaatggcaattaaattagatcttgtggagacagctgggaatgaagataaatattttatttgctttttgttacgtaaaaaaatgatgcatcccaagaatgcaaacaatgtttatttcacagagtgagtaggattgtctgtggataacaggtgcatttacttac

SEQ ID NO: 172715 - DNA, 247 bp, Homo sapiens
agacaaattcgtattaaatgatattctacaaaacaccttgcctggattcttgaaaaatgtcagcggcatgcaaagattaaaaaagaacaaggaagccgggcacggtggctcacgcctgtaatcccagcactttgggaggcctaaatgggaggatcgcttgagcccaggagttcaagaccagccagggcaacataaatgaaatcttgtttctacaaaaaatgcaaaaattagccagacgtggtgtatt

SEQ ID NO: 172716 - DNA, 908 bp, Homo sapiens
agcgggtgcttggttggtgaaggttttcaaaccggagctgtgggcgcggcgctgctctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgggccatattggaccaggagccgaaggaaaacaggtactttacacacccctgggaaccagggagtccaacc

SEQ ID NO: 172717 - DNA, 868 bp, Homo sapiens
aaggctaggtagaggctggggtaatcggacgagggaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgggccatattggaccaggagccgaaggaaaacaggtactttacaaccttggaacagtgactccac

SEQ ID NO: 172718 - DNA, 902 bp, Homo sapiens
agcgggtgcttggttggtgaaggttttcaaaccggagctgtgggcgcggcgctgctctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgggccatattggaccaggagccgaaggaaaacaggtactttacaaccttggaacagtgactccac

SEQ ID NO: 172719 - DNA, 927 bp, Homo sapiens
agcgggtgcttggttggtgaaggttttcaaaccggagctgtgggcgcggcgctgctctgccgttgggtgaggcgcggagcgaagtgaagggtggcccaggtggggccaggctgactgaagtgagtagtgggggtgccagaccagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgggccatattggaccaggagccgaaggaaaacaggtactttacaaccttggaacagtgactccac

SEQ ID NO: 172720 - DNA, 976 bp, Homo sapiens
agcgggtgcttggttggtgaaggttttcaaaccggagctgtgggcgcggcgctgctctgccgttgggtgaggcgcggagcgaagtgaagggtggcccaggtggggccaggctgactgaagagagccaaaggaaatcaacatttgaattgactacccaatgtcctgcccctgtttctgtcctgtagcacttaggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgggccatattggaccaggagccgaaggaaaacaggtactttacaaccttggaacagtgactccac

SEQ ID NO: 172721 - DNA, 1074 bp, Homo sapiens
agcgggtgcttggttggtgaaggttttcaaaccggagctgtgggcgcggcgctgctctgccgttgggtgaggcgcggagcgaagtgaagggtggcccaggtggggccaggctgactgaagtgagtagtgggggtgccagaccagcaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggatgggactcttcttggtgaagaattccagactgaagcacgagagcacgaggcgctcctactagccgacagtagatgatggacaccctggaccgtaagaaaaggcgtccacggatcggaggagacaaggggaatgactcatagtagcaacaactacaggactggacccatgaagggggcaacgaagctggggcaacttaggaacgggactctggccaggagcgaggaacagatgacaacggaaacgacgcaccggaagacagaaggggccagaagcgagacggtggcaccagaaagaggagccgaacagacagcggacccacgggtcggggggcacgcgaagtcaggagccgggcccagaggacacagacgacacgaagcagg

SEQ ID NO: 172722 - DNA, 114 bp, Homo sapiens
tggctcggcactctgtgcccttgtgcaaagacacagaaactcgcttgtttccataaggaaagcccagtggcagtgccaggaaggggtgccctcagcccctcctgccaccccaac

SEQ ID NO: 172723 - DNA, 504 bp, Homo sapiens
gtaatgggagtcattattcaagatgggaggaaagaaacaggaattagatcagaaacaaatgaccagaaagagagatgaaatacaaaagctacatgaagtcggcagtgtgaagcctgactcgcaggagagtggattttgttactgtttgctttttcttgtccaggataatccaagactggcagaaagtgagaataccgattgagatccaaggacatcctcatgggagtctgtgcagacacgttttcatcaagaacccctctccaagcagctggtccagcccagctaaactgggggctgctgtttgtaagaaaattaatgctctgggccaagcacggtggctcatgcctgtaatctcagcactttaggaggccaaggcaggcggatcacttgaggccaggagttcaagaccagcctggccaacgtggtgaaatcccgtctccaccaaaaatgcaaaacttagctgggcatggtggcgcatgcctgtaatcccagctactcaggagg

SEQ ID NO: 172724 - DNA, 309 bp, Homo sapiens
tgattgagcatgcctgaagactgttatttgaaatccttctgatgtgtcactgttaggacgacagtgatcactacatgctaatatttgttaaatgccaggaattccttcagacactattagagaagggcaaggaagattctcgagggctaatcaagctcttagagaattcagttagtagtgaccatttgcaatactgcaattgcaatactgtgctctccagtgagctgacaaggccagccaaggcaaagtggagaggaagtggtgctttgtggcagaggacctagaatcagtacctggtgtctctacctc

SEQ ID NO: 172725 - DNA, 481 bp, Homo sapiens
agagcatacaggtttttgtttgaacagttgttttcaggtctttggggtatatacctaggaatggaatcattaactcatatggtaaatctatttgtaactttatgaggaaacatcaaattattttacacgtaggctgcaccatttcatattgtcacaagcagtgtttaagagttcaagtttctgcacatctttgtcaacacttgttattttttagtataactattcttgtgtgagttaagggttatctctttatggttttaattatggtaatgatgttaagcatcttttcatgtgcttgttggtgaagttgtgtcttttgtcaatttttagattgggttgtctttgctatggagttgtaaaagttctttatacattctggataacagacactgatgaagtatctaatgtgcagacattttcttccattttataggttgttggaacgtaataagagttaatgtgtggtctctgctgcagtgtc

SEQ ID NO: 172726 - DNA, 125 bp, Homo sapiens
agttagagtgagaccctgtatcaaaaaaataaaataaaaataattgattccctttcttttagctccaagaaatacagagttgaacaaagaatatattatattggcagttgtgggtggaaggagag

SEQ ID NO: 172727 - DNA, 420 bp, Homo sapiens
tggacttttggactacctgggcgttcctttatttgtctctttctgatttcctatgtcaaagataaacaaggtggaaggacagattttaatcagtaatatactattgcaaagtgaaaacgagtctagcatgagctgaactcaacttctgaacccagtcagaggtgactaggcattttaaagggaggatgagggaagagggaagggtaagtgagggctcaggagagtcagggaaatgaaaaattacaaaaagtagaaggggggtggtaaattagtccattctgtgttgctataaaggaatacctgagaccaggtaatttatcaagaaaagaggtttatttgactcatggttgatgaggacctcgggaagtttaccctcatggtagaaggtgaagagggggcaggcatgtcacagtggcggta

SEQ ID NO: 172728 - DNA, 285 bp, Homo sapiens
acggtcagtgttaggagctacaagagatgtagaggatacaccaagagcaagggccttactctctcagagcttccaatctgcctgtaaagacgatatagttgtaggtggtgttgtctgagtgttcactcagttgccaggtcagaaagcttggccaagcttcagcttcactggttcctcacttcccatattcaattggttgccaagtcatcttgatcctatttccaaaatgcttctcaaatttacttggtttccctcctcctactgctgctgcaactctatcaggct

SEQ ID NO: 172729 - DNA, 648 bp, Homo sapiens
cagccccctggtaagagctgcttcttggaacacaaagagccgttgcgtcctccagccggccttgaggaaggtgtgacttctctgctcccagcaatgtcttgggcacccttctctgccctgcacaccagctctgcctgcagggtgcctggacactctgggtgtctactgtgtccccatatggtgcttgcaagtcttcctcccagactgccccctgcttctgtgtcccctccctggtgcacagcaccacatccagcccccctcccacccagcccacccaggtcctgcccacgtgacccccagtctttctccagtcgcacctcctctgcacgctgaccgccatgtcttgtcctctttttctttttttttgagacagagtcttgctctgtcatcccagctgctggagtgcaatggcgcaatcttggctcactgcaacctccgcctcccgtgttcaagtgattctcctgcctcagtcctccctgggactacaggggtacaccaccatgcctggctaatttttatattttcagtagagtcagggtttcaccatgttggccaggctggtctcgaactcctaacctcaggtgatccacccgcctcggcctcccaaagtgctgggattacaggcgtgagccaccgtgcccaggctgt

SEQ ID NO: 172730 - DNA, 696 bp, Homo sapiens
tgggtgtggcctagctcccaagaaactgctgtgggtggggcatctttccttataggactcagtgggcctgacctagcgcccaagaaactgttgtgggcggggcatctttccttagaaggctcagtgggtgtggcctagctcccaagaacgtgctatgggcggggcatctttctttagaaggttcagtgggtgtgtcccaatccctaagaaatggctgtgggtggggcatattttcttataacgcttagtgggcgtggcctaggtactaagaaactgctattcaagggatggtccctgagacctgccttccagggtccgtgcaggacctttccccctccctagtgctgagctacaggccccttccgccctgcagaaggatcccgcaaacgtggattacgaggatctcttcctctactccaacgcagtggccgaggaagctgcctgcccggtgtctgcccctgaggaggtatgtatatgacaggaggctggcacctcccacctggctgaggggcaggagtggaggtggtcaacagcttccagaggaggctccttctagaatgagaatgcgatcctacagcttggtgctttaaacctttccagtgcttttgcaacaccgagattaaaattcaaactacaatctgaggtcctctttctgcctatcacctacccagcgccagccctgctgccataccgtct

SEQ ID NO: 172731 - DNA, 701 bp, Homo sapiens
cactctcttacgctctgaccaaacaatatgaattctataatttttaattctatatcacttctccaggtacatatcatattttccaagacccatgattattttcatggtggaggtacaagattcagcaaatagtcatatagaatatacttaagttcaagattctgaaaaaaataatacttttctattatgatatctgcatacttgcatgcaatatgtatatgcaatactttataaatacactaacttttatctattatttatctgaagttcaaatttaactgtgtcttttgttatctctcaactccaatgcatgggaaccttggtgttcttctgtccaagcttagctccaactacctccggagacccattggagaaagacaccagtttttgagccaactactacaattcttataatgtagataccattgtgtcttaaagtcagtttttttcttattattcttgtgtccaaaatgacagtaaaacacaaacaatatgactgtgctgatacgtgttggtggcacctattaattttttggttctggcactgaagataaatatgtgtatttatgagattaatcttttagctcgagaataacaaccacttaataaaatatacaattttgcttttataaactcaaatttagattaaattttttttcaagatgatggattagagactttaagcatgcttcagccacatg

SEQ ID NO: 172732 - DNA, 432 bp, Homo sapiens
aaattctttgtactatttttggaagacttactaagtctgacataattccaaattagaagattttttaaatgcttaattattagagatcaaaaactgcaaccaaaagtactcagaactataaaaactaaagacatctcatttttaaaagtatgagtttattgaaatacacgaaacacaattaattcttccatcaaacaaactttcatttcatctgtttctgagattacagtggcttagtctccatcaattcacctattacaactaatataaatttctcactgtttcattttcaataactttcatatttctgtttctattacctggctttacatttcagaaatattccctattctacaatgttttcaaatccattaaagtttcctgtcaaaaccactccaggcagggttcaatggctcacacttataatcccag

SEQ ID NO: 172733 - DNA, 1391 bp, Homo sapiens
tcaacaagcgcctggcacactcagccaggcccgcgggcatctgctgcgtgtcccgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcccactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggaacctgctacgcgagtggtacctgcaggatccataccctaaccccagcaaaaaacgtgagctcgcccaggcaaccggactgacccctacgcaggtgggcaactggttcaaaaaccgccgacaaagggaccgagcggctgcagccaagaacagactccagcagcaggtcctgtcacagggttccgggcgggcactacgggcggagggcgacggcacgccagaggtgctgggcgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccagagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattctcccatgggtatttcacgtcgaaaggacgctgttacatatgtataactttcgctttaaagtttttttttaacaaaacatatatatgctgtttatttacttatttaagagaccgccatggtaggtttctctgtagcttggggaacttgctgtttctaaacatgcaggctggtggtgatgggttctgtgtggagaagccaaacaataaaacaacctagtgggcaaccttcttaattaa

SEQ ID NO: 172734 - DNA, 496 bp, Homo sapiens
ctcatccagcttagttgttgctgaatattggagacacttttggttacagtttaagtgaaacttgccagcttcatcctaaaatgcatgtactgaatggatttaacatttattagctttttccatgtttatttttctgcctaacagaatataatagggatggagggaagccataagtaaagtgttgcccttgctgtgtacttgccaggaggttggaagtaaatttcagattatcagcagttaaagtggggtctcctcccctgaagaatgaaatatcctgttgtagttctttgaaagtgccatagtagctggtgtttattttatgagggaaaaagaaaattttgaaaaaaattttttttcttaacagggcagatcaagcataagctgccctgctgagcaatcattttatgattaggagtccctaaaaggttccatagagccaactataagtcatttgtttgaaactggagtaacaggtttccataggagctgattgtag

SEQ ID NO: 172735 - DNA, 370 bp, Homo sapiens
agggggaggagaaggaggagaagggggcggggaaggagcgaggggaggacggagcaggcggatcccgaggactctgcccgcccctcctgcggtagggttgggggctcagagggagaggcgagagcgggcttttcctcctcgcggctcaccttgtcgctggagcaatctcaggagatgctccagtgtttgggaagaggggtcgctccaggacagaggggctgttgtgcacaccccgtctgttgtgacctcggacaggtgggcacctggaacccccggaattcccccaaatcttttaagatttggaaaaaagcccgctgccattcccccacccccaaaatcttgattatctcgagaaggggaaggaaaagaa

SEQ ID NO: 172736 - DNA, 556 bp, Homo sapiens
cttggggttcatggagtttcttgaagctataggctttgtgtttcactaaatttgggaggttttcaatcattaagtttttgaaatcttcactcagttttgcattctttatcctcattctgagactctgatgacatcagtgttagaccttttggtattgtcctacaagtacctgaggctctgttctttttttttttctttttaattttccttcttcttttaacgtttttctctcttgttcaaattggataatttctattgatttatcttcaagttcagtgactctttcctctgtcatttccattctgctatggagctcagccaatgaccttggggtgggtttttttattccagttattcagatgaaattacttattaaatttccatttggttgttcttcatctcttgtattagttcaccaatactttctatctttccatacatttcaagaatgcttgctcttatttgagtagtgttataatagttgcttgaaagcccttgtcacataactccaacatctttattatcccaacataggcatctgtcgattgtattttcc

SEQ ID NO: 172737 - DNA, 322 bp, Homo sapiens
aactcggtctgaatactggaataaaaaaccacccaagttcagtgactctttcctctgtcatttccattctgctatggagctcagccaatgaccttggggtgggtttttttattccagttattcagatgaaattacttattaaatttccatttggttgttcttcatctcttgtattagttcaccaatactttctatctttccatacatttcaagaatgcttgctcttatttgagtagtgttataatagttgcttgaaagcccttgtcacataactccaacatctttattatcccaacataggcatctgtcgattgtattttcc

SEQ ID NO: 172738 - DNA, 476 bp, Homo sapiens
catctgctgggtccagctcacctcataaccaagagtctaatgctgatggctcccgggaaccaccactttcttggcaagaaggatccatgcagtgtttctcatcaaggagtaaggggcgtgcttctgcatttctgttcacatcgtctttcttcctacctttctattgctttttcttgtttttgcctgcattccttttatttgcctatcatattttcttcttattttttgtttactttaatattagctcaaactccagtttcattatgaggctttccttggttactgtagtgtaccatgagttctcagttctctatttctattttattgcatgcattcgtgttctgcttgtctggtgcagaccataaacttcctggcactgtgtcagctttcctgagtatgcactatgtgcctaacactgtgataagagccttacacttgccatgaggtttaatcatgtgagttgatcttgttgtctt

SEQ ID NO: 172739 - DNA, 192 bp, Homo sapiens
ttcactttgttcccatcattccactgaatcactgcttgtcactaccaatgagttccatactggtaaatccaaagggtaattatcagtcttcatcttatgttacttatcgacagcactggacactgttgatcattttcctcttcttgaaacactcctggttgccttctaaaacatcatttccggctgggcacg

SEQ ID NO: 172740 - DNA, 558 bp, Homo sapiens
ttagaaaatataggtagcacttgctgaatcacagtccttccagaactcctgtcccagggcaaacaaagatttggtttatatcctgcaaacctctgtgtttgcaaattacagagcacttctgagagctggaatggcgatttctagattactatggagactgcaacccaactgcctctcccaccccgccagcaaatccccccaaatgattttgttttccaggggagacattttttcccttccttattgcaaaatagatggagcatgttcatgttgaagagagacagtgaggaaatctgggacaagagaaataagattagatgtcatccacagcagcaactcattttctccatttggatgtctggccccttgaactctgagacacaaaaccctgcacctgaccagcatctgaactgttccgtttgacagcagtttatgtgtataattttctccctaatgtattctgcaaatggtagagtagaaatagcaaatgaaagacattgcaaggcctagctctctcccaccccttctttccctggcctggtgtcatttgagctcagt

SEQ ID NO: 172741 - DNA, 281 bp, Homo sapiens
atcgcgcccctgcactccagcctgggcaacagggcaagactccatcaagatgaaaagaaatgaaatgacatgacatgacatgacatgaaatgaaatgcaaaaaaatctgtatataacaccattaatacaaagctccaaacttggcataagtaataatctattgtgtagaaaaacatatacatgggataagactatatattttttaaaaaccaaagaaatagttaatagaaaattcaagatagtctgggcacggtggctcatgcctgtaatcccagcacttt

SEQ ID NO: 172742 - DNA, 290 bp, Homo sapiens
gcacataagtagatgtaaagaataaggaaagtcctagctagagcagtcaggcaagagaaggaagtaaaaggcatccaaataagaaaagaagaggtcaaattatctttcttcactgagatatgatacctagaaacccctaaagactccaccaaaaggctcttagacctgataaacatcttcagtaaagtttcaggatacaaaataaatgtgtaaaaatcagtagcggttctatacaccaataatattcaagctgagagccaaatcaagaacacaatcctatttacaatagc

SEQ ID NO: 172743 - DNA, 205 bp, Homo sapiens
ggccaaagctggaacaatttgagcaacaaaatataaaacaaatatacatgaatccacactaatacaaacaaatgataaaataaatgagagagaagaaacaaatccaagattgagaaaccgtaacagattgttagacagtaaggaaatatgatgactaaatgcagtctggtatgctgaactagatcctggaacagaaaaatgacat

SEQ ID NO: 172744 - DNA, 270 bp, Homo sapiens
gcacagcctgagctgcaatgtacatttgcagtattacttttcttaatctcaccttcattactgaaggatatttttggtagatacaaaattctggattcacaactctttttttcagcacaataaattattgttccaatttttttctggcctccagagtttatgaagagcaatccagtcattcaaatcattgttcacccagaagtaatatatatttttttacagttctttcactatttattttgtctttgattttcagcagtttgattatga

SEQ ID NO: 172745 - DNA, 143 bp, Homo sapiens
aataaaaatacagcagagaaatgaccactgctttcaacttagcagcaccggtttaagtgatcacatgattgtagttggcactgtttgaagaagttccaccaaaggaagcatgaaagcccaagtcttgacttggtttttgagca

SEQ ID NO: 172746 - DNA, 338 bp, Homo sapiens
gtcatcttgggtgatctctgctattttgagaaaacatcttcctgaacttggttttcaaaatttcactcatctgcttcaaatcctaagcctcaaagggcaggcatgggggtgaaaccacatccaatttcagccctattttcacaccatgccacacacagctggcaggccaggaagggtgatgtcaccacaccaagtggcacatcatattctcaactggaggagatggtccttgctaacgtgtgtggctgctcctagctgaagaggctcagtcatcgttcacgggtcctgtcgtttctgagggctgcttttggtaattatttcatatgggggcactgcac

SEQ ID NO: 172747 - DNA, 434 bp, Homo sapiens
gagagttcagcatttctctctcaaaaattcatagaacacttagaaaatcagcaacaacctcatcaaccagtaggttccagttgaaatttatagaacactgtacccaacaaaagcagaatgcatattgttttcagatgccatgaaacatataccaggatagagcaaatccataatggactaaaactagaaatcagtaagaggaagataacaaaaatctccaaacacttggaatctaaacagtacagctataaataatctataggttaaagaagaagtttcaagggatttaaaaatacattgaactgaatgaaaatgaaaatacaacatatcaaaatttgtgggacatagctaagcagaatttctagcactaaatgttttcaatagaaaagagaaagtctcaaattaattatttaagctcccacctaagaaccccc

SEQ ID NO: 172748 - DNA, 490 bp, Homo sapiens
cagagcagaccaggatgtcccagagtgggtccagaccataataatagactttaaaatgctggcaagtcttaggagcaagggagatgatgtaaaaagaaaatggcaggctgggtacagtggctcacgcatatagtcccaatgtgtctggaactggttccttccggtgggttcttggtctcgctgacttcaagcatgaagccatggaccctcgtggtgagtgttacagttcttaaagatggtgtgtctggagtttgttccttctgatgttctgatgttcagatgtgtccagagtttcttccttccagtgggttcatggtctcgctgacttcaggagtgaagctgcagaccttcgcagtgagtgttacagcttatcaaggtagtgtggatccaaagagtgagcagcagcaagatttattgtgaagagggaaagaacaaaacttccacaacgtggaagaggactccagcaggttgccactgctggcttgggtgg

SEQ ID NO: 172749 - DNA, 263 bp, Homo sapiens
agctgcagcaattagcatgacttaattatccaggtcagacagaagtgaacgcctgcctgctcacgggctgacaatgatcagggctgcaaacacagctcagcatgatgggacatagattccagcttactggcagcactgccggcacctgagctccacatacaccgccgcagcccaccctcattacacataaaggaaccactgtcccaggcagaagttctggaaaaggactcactcaaaccataaccacagacaccaacagccca

SEQ ID NO: 172750 - DNA, 476 bp, Homo sapiens
aagaaatgtggtggggcctggacagaatgaacaaggcggggagatgaggtctgcacagtgagctaaagctggatcacataataccttctaagccatcataaggagctgggattcgattaacctccatgttccacctccagcagagtgaggatgggggaggaagaggactccttgtgctgttaatgtccgtagcaaacaaaccagaatgaaatggcagggtgttggagctaaaccgaaccctgtcagtaattacattaaatatacataagctaaacagtctaattaaaaggttgcgactgtcagaatggatttagaaaagcaagacccaactatatgatgcctgtaggagatgcacttggaatataaagacacagaggcagaaacgaaaaaaatggaaaacagtaagcagaagaaaggcaacatggctatagcaatatcagacaaaataggcttcaagacaaggagcattatcagag

SEQ ID NO: 172751 - DNA, 324 bp, Homo sapiens
tgggtgagctcagagcccagaaatccatgtcagccccagccccagctatttgcattacgccatcctgcttctgctgagagtctatgctttacaagagagcacatcatgtctacattttatgtggtttaccattcatggggaggcaataattacacttctaaacaaagatgaagggggtgagtgtcatctgaagtcagcctgtgacttcctttatttcataccctttcttaatcccctgtatttttgtataaaatatatgccagtgtccaaatactctcatattcaggatctcatgtggccctcaaagcaataggtggggaatta

SEQ ID NO: 172752 - DNA, 464 bp, Homo sapiens
ttctgagacctcttatagagaaaggaactgagccctggggtgctccaacatctaggcatcaagagggatcaggagaagtctgtacaagaggaacagccaaaaaggtaggaggaagaccagtatcggtggtagtggaagccaagggaagatggtgtttcaggagggactaatcagctacgttagggtgcggctgagagattaagtcagatgagaaatgactgtaggcattagcaatgtggtggtggtggtggtggtgcaggtctttgaaagtcatgaatcgtgtttcactgcagttgtggtaacagtatgatcatgggatggattcagagagaatgggagacagcaagtataggctacttgctaaggagctctgctccaaaaatcctccccgttcctatatcaaaattttttccttgctgctgcactttaccatcagtatacaaacatgtttcctcttccattta

SEQ ID NO: 172753 - DNA, 453 bp, Homo sapiens
actctaaggatccccggattgaagtgcttactcacatgtcataaattaaccacagcttcatgggggtgtagggctatcccttctccctgcgccttcccatctcgtccatgcctagttttagaagtttcaatagcaacaacaacaacgaatagccagactttgtgctgcatgcctgtcgttccagctacttgggactacacatgcacgccaccacatctgactaattttttaaaaaattttttgtagagacaaggtctcactatgttgtccaggctggtctcaaactcctggcctcaggtgatcctcccaccttggcctcccaaagcactgggattacaggcatgaggcaggtggaactcctgatctcaggtgatccacctgcctcggcctcccaaagtatggagattacaggcatgagccacggcgcccagcctaggggtgtattccaatcgg

SEQ ID NO: 172754 - DNA, 148 bp, Homo sapiens
tgtcatattcccaacactaataaccaaaatgcctttgaagatttttctgtcaccagtgtatgaaccaacagtttatcacagtataatttgatttttctgttacatatgtatgtgtatgtgtgtgtgggggtgttgggcgaggacatgt

SEQ ID NO: 172755 - DNA, 240 bp, Homo sapiens
catcctccgccacaagggatggaaagttccccgggggctccggactctgctccccaccaggaaggatggaggagtgggagtgagagggagcggggggcgccgagctctactcacacggggatctcattggccagttcgcttggaaacaaagagacagacagtgagaggcgggaggaccgggaggtgagagagaggcgggaggacagaggtggcagcaccgggccgtccctcctgggccct

SEQ ID NO: 172756 - DNA, 289 bp, Homo sapiens
catttaaatggttgaaaaaaaacaaaggaagagcaatatatcatgacctgtgaaagttacatgaaattcacgtttcagtgtccataaagacttattggaacccaagcgtgctcattcctttagggcttgtcgaaggccgcttttgtgctacagtggcagagttgaatagtcaaggtggactatatggcttgcacagctgaaaagatatttattcatctaaaattttattttaaaaattgataatgaataatttacttaatcataaataaaagataaaattaatattcta

SEQ ID NO: 172757 - DNA, 342 bp, Homo sapiens
catactttcctgcctggccttacaaatgggtcaccttttaggaaaatgagacagtaaaaggaagtgatctgagaattcaagaggactcacagtgttctcacggaaacctgccaaggcatggccagtactttccagacaaatgagtgcttaccactgcttggtacagtggcaaaggattggtacgggacatggtcacacagatccatttcatgtattccagcagaaactatgattgttaatggggtttgaagatgccagtgaggggcagagatgcatcaaaacaaacactgaagagggactgtgaagaagctaatttcattaaggccccaatagcattaaaca

SEQ ID NO: 172758 - DNA, 466 bp, Homo sapiens
taatctactcctgaacggactaagagctattattctcccacattgtggagaggcagggcatgatctgggactttctgaccccttgaagactagcttttctcctgtaattctttagagcctgggccgccctttggtggactttggagtctggttcattccaggaccttcaaaggcctgacaacaatgtgcaaggggtcagcaggaacatggtgaagacagttgttgtcagcccgccaaagatggaaatgatttggattttttagtctttcgaggattgaaacaaaataaggagcatagctttatattggggaagcttggctgtcctcatgtaaactcaagaatgttgatgtgagttggcttacactactcatactcatcctgcctactccagtagatgactggtcactcctgctgtgagttttggctagttcagctttcagcagagataccaatgatccttcacgta

SEQ ID NO: 172759 - DNA, 465 bp, Homo sapiens
ggctggaatgcagtgacatcatcctgtgtcactgcagcctcaaactcctgagctgaagtgatcctcctgcctcagcctcccaagtagctgggactcctggggtgagacaccataccgcctaattttttgttgttattgctgttaagacgggtctcactatgtctcccaggctggcgtcaaacttctggcctcaagcaatcttcctacctctgcctgccaaaatgcccaggattacaggcatgagccattgggcctggcagattttttacaagcagttaaactacaacatcttgcttaaaataagccaaaagtacaaatgttttgtagtatacacaaattagagagatttaaaaattcaacttatcaaatagtgacttagtgttagagaataagcaataatcaagactaatacatggtcaggtgtggtggttcacacctgtaatcctactgaggcagaagaacagg

SEQ ID NO: 172760 - DNA, 403 bp, Homo sapiens
acaaacaggaacaatcacagttccccggggctgttgtggggctaaaaagagagttgcgtctgcggttcctggcatccctaagctagctctttccttctccattccctctccgtgtgtgtcaagaggaaggcactgcagctctgagaaggctgggagctgccccgacggggcagtgctcccccgccctgcacgggccccaggcctttccctcctcttcagtgggaagtcactgcctgctaagtgagaagcggacctgctgactagggaaatacttctccaggtctctgacacttccctctcctgtcccgagatgacacacaccggccagctgcatcatcacgtgatgatcaaagtcaacatgcctgagtgctcacttggtgccagcaactgtttaaacaatttc

SEQ ID NO: 172761 - DNA, 359 bp, Homo sapiens
tgaacaagtaggaggaggggaatcaagacatgttaaggctggacacaatttccaagtgggaatgttacacaggcagttacgtttgccagcctgaagcccagagaagatactggggcaccacagtaaagatatttaagtccatgagactcagcagcacttaaactaaacaggaacaatcaagttacagagagggaacaggactcaggaccaagggaattcaatgatttacagatctaatataggaggggccttgtgtacacagaagaaaatctgggtctttaaattttctgtgggcagaatatattacagacagaagtgtgtagataaatctataacctaccttgacaccatacttaaaa

SEQ ID NO: 172762 - DNA, 402 bp, Homo sapiens
gtgaaaaaggtgtacaaaaatatttatgaatgaactgaaaacaaaaataaaagtgcttttagatgtcattttttatgacagtgcttccctttctgatactacatataaaagtttttgtattaagttttggaggagatagaagtagtgaaggtaaaacttcttgttttttcctgttgtttaaaatgttaaataagcagaagctggtttattgtctaaatgacccacaccagtcctctgttggacacagaagtcttcctttagtggaagctatcagtcattttgtctcagcacattcaactgttgtttgttcagattttttgtaattcaaaatactttttgatacctaatgcatgattttttgtgagttgtcctcagtaatttgtaagtcttatatagggaaac

SEQ ID NO: 172763 - DNA, 424 bp, Homo sapiens
cccacgcagcccctgtccccaggccaggtcctggagaggggggaaactgaggctgctgagagggcggcccacccagagctccctgtgctgggagaggttggccgctgtccctcccagctgggctcagaggcgctaatgagagttaaatgtaggacgtgagtcacctctaggagggggctgggaccacccccagatgtgggtccagacgctcaggctttttcctactcccctgtgtgtcaccccctacccttggcagggtggggcatgagttctgaccttgctgaccaggctctgtcaccctggaccagcctcacttaaatggctggctgcctcaggagcgggtgctgtgggaccacaggagactctaaatcccgggataggcccagtggaccctgaggacttaggggatggaccaacacctggg

SEQ ID NO: 172764 - DNA, 360 bp, Homo sapiens
tttgaaggtggggaaatgggtcctgtgtcatggatgtgggcagctggagaagctggaaaagttcctgcacagatgccgctgaagagaggtgccagggaagggcagagaagaggcagtctgtcccttaacataaggctgattctctcgaactgtgcgaccggcagaagcagatgtgtgtgaactggacacagattgaagaatctgcccctgttgaggtggatgggcctgattgttgtcccccagcgtcctaaaacttgtatggacttggataatgaggaggcttgggctgagatgtgagtcctgttggagactccctctctacctctcaccgtggtccctctcaaatacccaacggaattc

SEQ ID NO: 172765 - DNA, 384 bp, Homo sapiens
tactcaggaggctggggcaggagaatcgcttgaaactgagaggtggcgatcactccagcctgggtgacagagtaagactccatctaaaacaaacaaacaaacaaacaggggaatactgtactttcctgaaacctgctgtaaatccaggcaaggtattatggcacttttaaagtcctgactagattggaatggatctattttagggtaaggcacggttcaccagcagattattctggccccagaataatctctccggaggcaaactggtagtcaattgtcctaaactcaaaccctgcctccaactcttgtcctgagttgaggtctgtcttcctctaaagccctcagctgcagcagggcccttaatcaagatctggaatcccctga

SEQ ID NO: 172766 - DNA, 591 bp, Homo sapiens
agcaggcttgttcctgcccagcatcttggaagatctcggactagtgctccctgcagatgattgggacctaagaaacagagccctgcagaaggactggcaagaccacatgtcccggggtggccagtgtttccagcagtgacacttgggattgaaaccaacctttgcagagcgagagaccccacagtaccagctgtgccactgactgggaagtgcccagccttggccctagagtgggaaaatggcctggacatgaaatgtgtggggacctgacacctgtgctggcccctgcagcagaggcagaggcccaggcaggcggggacctgcttttcccagggctctccagggagtccctgcacagccctcaagagcctgccctgcgttatcatcctcaaggtcaagaaacttccttgggggagtctccagagacaggcagcctggccatgccctggcggacccacccactctactccaggacctccggatttggtctgggagtctcggcacaggggagtctgccatcgaaccagccacctgcatcagagccgggtccacctcctccgtcccgctgtggctctttgagcctcagtttct

SEQ ID NO: 172767 - DNA, 433 bp, Homo sapiens
ccagagtgctgggattacaggcgtgagccaccgcgcccggccggaaatggaagtcttgagaatgaatgttggccctttctattcagaaaatagcctgtgctccagcatagcatcatcaccatctgggagctacctaggaatagagtctcaccctaccccagtggtaccgatatgcacattgaaaagaacgaatctagaacacttttcactccttttttattacttggcttgggaattacaaatttcggtggactttttggcaggagtggtttttgatgtttgtggagaatgttgaagactacagtgtagccacatttactttacattggaaataatacaatataaaacatgacattttatttgcaaaatttgaaataatgacttctaaattacaaacagaattaaaaatttcaaagctggcaggctggagata

SEQ ID NO: 172768 - DNA, 781 bp, Homo sapiens
gctgctttgatcatgtttgaaaggaagcatagaaaaaagattgaaaagctgggtctctaaggtaggaggtctgggatctgtttattctacttagttcaagttggaattgatgctgttaaacatgtgagatgaccctaaactactcttcagggttaaggcaggtctgaggcagatggatgaattacgcaaatggactaggttgagaaaagttaatgataaaagggctgggctggaagactgggtcgaggaagaagagtgatacttagggtttactcacatcttatctaggcaacttttctggtcttgatttgggctttaagggccatgaatacacaaatatacttaaattcctacatttccagtatatatgatgtaagaaatttcaaccaattggtctgaatcttctatattttgcacttctcatcaggcacctagccaacggttgagggctgatcttctgacttggctttcctggttgaccagtgctggttctataacccaattaactatcagaattccaagcaatgaactaagcttgctggtttcatcctggcagaaatgaacataatcttgagctaaaattgtacagttgtagtccaacaataatggcagatacaaaggctatagtcccaggacaaagacaagcatttcacctgcataaatctcatttagcacttaacaattctgtacaggagatattaccaataaacccattttacagacgagtaaacaaactcagctagattaccaagtgaagaaagcgatggaagccacatctaaa

SEQ ID NO: 172769 - DNA, 836 bp, Homo sapiens
gctgctttgatcatgtttgaaaggaagcatagaaaaaagattgaaaagctgggtctctaaggtaggaggtctgggatctgtttattctacttagttcaagttggaattgatgctgttaaacatgtgagatgaccctaaactactcttcagggttaaggcaggtctgaggcagatggatgaattacgcaaatggactataatgtgtaatctgtgcatgtgtgtaacaataaaatacagttctatcaagattttggttgagaaaagttaatgataaaagggctgggctggaagactgggtcgaggaagaagagtgatacttagggtttactcacatcttatctaggcaacttttctggtcttgatttgggctttaagggccatgaatacacaaatatacttaaattcctacatttccagtatatatgatgtaagaaatttcaaccaattggtctgaatcttctatattttgcacttctcatcaggcacctagccaacggttgagggctgatcttctgacttggctttcctggttgaccagtgctggttctataacccaattaactatcagaattccaagcaatgaactaagcttgctggtttcatcctggcagaaatgaacataatcttgagctaaaattgtacagttgtagtccaacaataatggcagatacaaaggctatagtcccaggacaaagacaagcatttcacctgcataaatctcatttagcacttaacaattctgtacaggagatattaccaataaacccattttacagacgagtaaacaaactcagctagattaccaagtgaagaaagcgatggaagccacatctaaa

SEQ ID NO: 172770 - DNA, 438 bp, Homo sapiens
actcatacaatgaaaaagatttgttaacaaaagcagatgtattccttctgtttttgacacaagacaaaagtgattcagagcagtagctgatgattgtgactaaattatggtacataaaatggaaatggctaatcaggaaatgtgccatggactgtcttcttgggcatgggacagagaactgagaagagtgtggctatcaagcctgcctctggcactcaccactcacttttgtggaatcctgttgaatccacctctggtgttttaagtcctagagagaaacctgggggaatctgtgggagaggtactcttcttaactctatttccatttaagggttataacaaaatggctatgggacttgaatacctgttgatgtgatgatgttgaagaatagattttggacatttctgtcaaagaataaaataatttttataatttca

SEQ ID NO: 172771 - DNA, 382 bp, Homo sapiens
accttagtgattatctggtcaaacctccttgtacaacaatgggggaaacggaggcccaaagaggaaaagaccagacttcccacaaccaagcaaggggaagatcggggccaatgcctgggtttcttgactcccaatctagtgcactctctgccacacacccaggagccttaaacaaggaggcctctagggtccactcagctggtggcccccgtatcgttctctgtccttggcccaacaccagccctagctccgtctctcagagttcgctgctgctgcttaggcctgacatccctaagcggggggaaggtgtccatgagctaacactcaggtcccctccaaccctatgactccaggtccatagtgtatgaggccctgagccctg

SEQ ID NO: 172772 - DNA, 480 bp, Homo sapiens
aatactctacacacacattcacacatacacacacatgtacatacacatacacacatatgtatgcacaccacacacatactctacacacacatattcacacatacatacacacatgtacatacacataaacatatgtatgcacaacacacacacatactctacacacacacatattcacacatacatacacacacgtacgcacaccacacatacatatatatagatacacacatacatacacataaacacatacatatatgtactaacaccacacacacacacataccttgcacatgagatgtgcaaatgtagggactctgtctttaagttttgaacttgaagttgctggtctaggatgttacatgaaaagcttaaaacttctgggatagtttttcagcctttgggactgggtttgagaagtggttcagcagaggagcggagcctgcagggcttagtgtgcatgaatgcgtccgtctgcgg

SEQ ID NO: 172773 - DNA, 368 bp, Homo sapiens
taaaaataatgtacatgaaacaatgaaaatacttgcatagattttttaaagtcactatgaatcatagtgatttgtttgttactataccaaaaattcacagtcaagccatttaataaacatgactgttatatgtgaaagcatctcaatatcctaagattaagcaatttcatgcaaaggaaatatttctgtgtattttttaggtagtatttagatctgcagctaaaaccctttaaacattttgttagttgccattcatttaaaactccagagctcatgtatcatacaaaaatatcagaaatttcttttttaaatggaaatatagtcctagggtcaaagaaccttttcagaacaactagaccttcatgata

SEQ ID NO: 172774 - DNA, 409 bp, Homo sapiens
gattgttttcatcattgtggattattttttctggcttctttgtgtgcctggcaaggcattgtgaattttatctgttggctgctggatagtcttctgttcctctaaatgttcctgagttttgtcctgggatgcagttaagttacttgggaaagtttgattctttgggtcttattcttgtgatttgtcaaggagtgctcagtctatagctcattacataaggaataataatgcaatatagctaaataatatacttcaaggcaatctttaagtttacacttaagtctaatcttaaaagactgcaaaagacttactaaatgatcttagcaacaaatttaatcctctaataaaaaacatgaaaataataatttctgaaaaaaatattcactttcattaaaaactgcaaagcact

SEQ ID NO: 172775 - DNA, 771 bp, Homo sapiens
gagaggatttaagggttttgttcccagcgggaaggtgagaggcaaaaggatgctctgaaatgactgtccccctcatggcagcaggtgggcagatcaaagctgctcagtgcctgccccgtggaggcttcggttggctgcctgggaggagctgggtcaccagggccatcagctgagcttggtggtttgaggaggagaggcctgggcacattcaacggccagaatggcggcccacaggctgggcacacaaggcccctgagcagactgaggggagctgccacggctcctggcttgtgcccggcacatgctggctcgaggacagccagccccagaggcccagaattactgagtccaatccaagcccagccccggcactagaaccttgctccagcttctttttctggcccagttagtgcctacccccttccagttccagctgcaaacaggagccatgactccctttcagggaaggctgggcctctttccctgccccctgtgccccctccctccagcctccctaactggaaacactgggacttaaccatggaaaccctagggaggccccggggctccagacagccgcctttgctgcccagaggtgaggccttgcctaaagctccaggcctctgaccccatgggcagtggggcaccctgtagacatccctgcctgtagctcttcttagtgcctagaagtggcccccactccgaccctgaaaactccggaatgctaaggctggtgggcgatcagagctctcaccctctgcttgaactttt

SEQ ID NO: 172776 - DNA, 349 bp, Homo sapiens
ctgtaatcccagctactcgggaggccaaggcaagagaattgcgtgaacccaggaggcagaggttgcagtgagccgagatcgcaacattgcactccagcacgggcgacagtgagagactccatcttagtaaaaaaaagaaaaagaaattcacttctccatccccagtaagtcagaggtggaatccaagaacatgctttttttttttttttctttttcttttcttgagacagtgtcttactctgtcacctagtctggagtgcagtgatgcaatcatggctcactgcagccttggccttcaggggtcaagtggtcctcccacctcggcctccagattagatgggactacagg

SEQ ID NO: 172777 - DNA, 886 bp, Homo sapiens
attaagttcggagcagcccaaggctgcggatctagcctttctccctccggtctccagacccacgcaggttaaggcagccaagcagagacagcggagccccggtgcgtggttcaggcctggtcaacaggtaggagggccagactgggggccaggcacagaggagggcaggcccgcccgcaccggcgtccagggtcccgggttccgggtcccgggactggaggaggtcgccggcagcccgcccttccagaggcttgagattgggtggacgagacctgaagatcctctcggtctggaccccgactttcgatctgcttagagacctaagccgcgagcctttgcccacacggagaaacgtactatctaatatctaacaaccctgtactgcagtgtctggaggttgcgggaaggagacagtgtctccctttgggaaaactactgaggacttctgtatatcctacttcttctggactccataagttacaggaccgaaggaaactgagaaatagagaaaaggtgccgcttgcccctttaactccagaaaagggtggctgcagatggagcagcttggactttattttttacgttgcgggaagcccgccggcagcggcttatgccaattgattttcccagctcccagccctggatgtctagctatctccaggacagtttgttttttctttttctgtctttctttctttccttcaatgtatcagaagaactgaagctcgctgcccgcgagttcctccgagtcccaggatggaagaagattatttcactaagtctcagaggtattatgcatatgaaagaaaaaagtcctcattcaggactgaagtgtgggtatgaagttttggaccctttgcggtggaagaggcgaaaataacgggag

SEQ ID NO: 172778 - DNA, 263 bp, Homo sapiens
tgtttcattacactaggagcatattgcttgttcatatctaattcattcttagatcttccaacactgcttcccaactcatcccaagcacagtgctttattcaagtagaggtagaaacaaatttgttgagctgaatcatgttaaaaccgtagagtatatatgttagcatgaagaaattgggaagtgacttcaagtcagatgtccaggtttatcatatatatatatatatatatatatatagagagagagagagagagagagagag

SEQ ID NO: 172779 - DNA, 294 bp, Homo sapiens
ttttgtgaagattataagcagtgtgcattttaacaaaaattaataaccttcaatcagcacctttaaagaaaagtgttcggattattcccttaataaacatcgtaatatccaagaacaaggtctgaataaaaatgaggtgaagaagtacccattcattaaagtcctcaagaattgtttagtgctttcctttatagctaaaagctgtaggagaaacaaatatatgagatctgaataatcaaaatattttagaagggaacaatatcttaacaagagcactggtattagaaaagggct

SEQ ID NO: 172780 - DNA, 282 bp, Homo sapiens
ctccctccctcgccctctccactcctgcctcctggagactcagcgagctcgtccctcattgactctacatcacccctcacccaccggtcccaggtgcacacacgagaccaggcccagaggtacagggctgtggccttcgagctgccagcccaatccatttttctaccataccaaaaaccccttctttttcagccctcatgaccgcgtcttcctccaacatcccagccccggtcgtaggctcggcaagcccgctccagggcccacttcccatctcggcggccg

SEQ ID NO: 172781 - DNA, 574 bp, Homo sapiens
gggcacagaaagggcatctcacggcagggcccgttcccgtctttacctctagctgggttagctctctcagcctgccctgccgggctacattcaggggagcaaaactttgcccaacatttggcaagtgattatccaccctgaaatgtgctggtgatattattaactcatttccttatcaacaggtaagacactagcatgagcttccattcattctgcagaaatgttggcatttattcctttaaaatcagtttcatattaacctacattatgttctgtgtttaacatttttcatgagaaacattacacaaccttcgcctctagcttacaaatcccacacagaaggtatagacaagaagcccacatggggccgggtgcggtggctcatgcttgtaatcccagcactttgggaggccaaggcgggcggatcacctgcggtcaggagtttgagaccagcctggccaacatggtgaaaccccatctctactaaaaatacaaaaaactagccaggcgtggtggcaggcgcctgtaatcccagctacttgggagcctgaggcaggagaatcacttgaacctg

SEQ ID NO: 172782 - DNA, 647 bp, Homo sapiens
gacatagtgggtcctgctctatagaaaatgagcatatgacccttaataaaaaacaggtagtttttttatatacagaaaattaccctaaatgtgattatgtttctttattttttgaccgtagaacaggaatcttaatcttttttgtgttatggactcctttggcagtgtggtgaaagcttttagagttcctttttggaatatgtttttatatgcaaaaataaaatacatagaactataaagaaaaccagttatattgaattatattgatatatagttatcaaaatttaagaagtatgatatggtatgaaaatatccatgatttctactggtaacaaatccatttgtctaataagtctgctattactgctgtagcttatgttcatcactgaagtgaaaataaagatacagtctttttcatccaaattcacagacttcctgaattctatcatagaccctgcctcagagatatgagttccataacccactctaggaagatcacattctaaacacaagagtttactcaccaaatattctggtagaatagtggcagagtaaaattgttcaactgtaagaactattacatgtgtccctcatggttttttctttcctgaaatattctactacatgtccaggccgaagaagtataa

SEQ ID NO: 172783 - DNA, 547 bp, Homo sapiens
caatggagtgttaaagtctcccactattactgtgtgggagtctaagtctctttgtaggtctctaagaacttactttatgaatctgggtcctctgctattgggtgcgtatatatgtttagaatagttagctcttcttgttgaaccctttgctgttatgtaatgccttgctttgtctttttttttttttttatctttgttggtttaaagtctgttttgtcaaaaactaggattgtgactcctgcttttttctgatttccattttcttggtagattttcctccatccctttattttgagcctatgtgtgtctttgcacgtgtgatgggtctcttaaacacggcgtatcaatcggtcttggctctttatccagcttgcacttctctgtctttcaattggggcatttagcctatttacatttgatattagtattgttatgtgtgaatttgatcctgccatcatgatgctagctggttattttgcagacttgtttatgtggttgctttatagtgtcattggtctatgtacttcagtgtgtttttgtagtggct

SEQ ID NO: 172784 - DNA, 523 bp, Homo sapiens
aaacagagctctttgaagaaatggtaatttcaaagctagagcacagaaagtataagatgagcccagaatatctttttgtacaagaaagtaaggcaatgctcaaagaatgatggagacatgcccaaaaaaagcagagaagccaacttgaaaagattccaacaggccaaatatgggacaatttgaacatcagaataaaatggtgacagtcacagaattataacccattgaagaaaggaattcatgacatcatattaatataaataataattgaatattgaaattcgttaaaggaaatgagatatttatgtagtcttaaggtatcttctcacaaattatgtattacttacaaaggggaaaagtgcaccttgacatgagaatcttggcagaaccactttaatcaagaggtttagttgagcattatcagtaacagagtaaatcaaaatcatgagccacttgatagatacaatgagaaaataaagcatcacttctgtgacaccctataaaaaatgaatctaataatgag

SEQ ID NO: 172785 - DNA, 576 bp, Homo sapiens
actagaaagccaattagaactttatggacagggcttggagggcttccaaagaatagttccatggagcattggagggcttccaaggagcagtaacctgacagtcttgatggggcaccccaaatgtcattgacagatattacagggagattttcttttctctagaggagaaattcatacctcttaccttgagaagcaaatataaacctggttgctagcattctgtgaaatcagtgaagagactggagttctctcagtgcacacactgatttttcacttagtccctaggtttctgtatggctccacctcccacctgacattgtgtttattctgagtgcagagccagagaataagctttttcctgtttgtgttgaaacatggaagtcccctggctgtgcaggcaggaggaaggatcttgaatctaagagttaatctgataggctttcaaccaatactccagatttcagcctctatcctcaccctgccttccaaatcacctggtgcctccaattctggaaacttgcatgggttcttcagtgtgaatggcttccttctttgtctatggcatccttctctgca

SEQ ID NO: 172786 - DNA, 557 bp, Homo sapiens
ctttcacaacattattccgggacccagtctccttccatctagtggctctgtcatcctcctagggccttggagtggtctgcttttgaccagctaatgggaggggagaggcagaataggatcctgtgaagacttctagggtcaggtctggaaatatcttttgctcacactccattggccagaacaagactgcctcagtgcagaggaagctgggaaatgtagtttagtagggtacccagaaggaaaagggaaacagtctctgccacactgaagcaacaccaaaatctgagggttggatgtaggaagaagcacctgcaaaagatagaaaagagcctttaagaggatcacctgaagccaggagtttgagaccagcctgggcagcatagcaagatcctatctgtacaaaaaataaaaataaaaaattagcctagggtggaggcatgcacatacagtcccagcaactcaggaggcttggggccaggagtttgaggctgcagtgagctttgattgggccactgcactccacttaagcctgagtgacagagcaaaaccctgtatcc

SEQ ID NO: 172787 - DNA, 333 bp, Homo sapiens
agcttgttagaaatttagaatatcagactttattccatatcttcagaaaaaataatctgcattaaccagatctcgagtttattgtacacattaaaacttgagaggtaccttttaactcaacgtgccttttccatctgaaaaatacacacaacttattctgtatgatgcacatatagcactcagaaatggacatgtttgtgtttatgcccttaattttatactttatcatccagaagagtaccatgtgtagtctgaatgtaaccataaaaaaaatcatttggccaggcggggtgactcacgcccataaaataatttttaacagaaatattttct

SEQ ID NO: 172788 - DNA, 391 bp, Homo sapiens
agcttgttagaaatttagaatatcagactttattccatatcttcagaaaaaataatctgcattaaccagatctcgagtttattgtacacattaaaacttgagaggtaccttttaactcaacgtgccttttccatctgaaaaatacacacaacttattctgtatgatgcacatatagcactcagaaatggacatgtttgtgtttatgcccttaattttatactttatcatccagaagagtaccatgtgtatgctgattctgtggatcttatgccactttcttttctcagggcaagaagtacattagaaaatatttctgttaaaaattattttatgggcgtgagtcaccccgcctggccaaatgatttttttttatggttacattcagactac

SEQ ID NO: 172789 - DNA, 2067 bp, Homo sapiens
ttaagttgcaaaacctgaaactttaaaggaacaaacataacacatttgattgtagaaatgagggaaaaagagtgtgtgtgggtatgtgtgtttatgtacatatgtgtatatgtacagtggaagatgccataaacagatttgtaaaagttaaaggacaggctccccagagaaatagccagtgtgctccatccacatcaagcctgagtgtgagagagttctggataatcctgttacctggctgtgactttggaagtggagaccatgatctctgccttctccctcatatcatctgtcttaaggtcacagataccgcagccactgccaggtttccacaagccagtcacctttcaggtggagaagtagcttgctatagcagccagtttctcgagtttgcgcgacagtgccactggaacaatggctcattcatgtcagatttccagagagttgggcagcacacttgtgagaatccagctgtgaacaagccattgctgtctttaggagcttatgtgccaggtggtaaagtgtacatatgcaaataaaatggtaagatgattgcaagttgtcatgaagataagacagcattgtaggggtgaggtgaccctagattagacaggttggctgcagaaggcttctctgagggtgtaacacttgttttgagagctaaaggatgaacgggaggagcatcatgagtaggagggaggcaggagctttctggatagaggcagcagcgtgtgtaaagagcttggggcactagaagaactggaagataaatggtgtgactgcagaatgatgagtgagactcaggaggcacgacatgaggctggagaggtgggcagggctgtgcaggtctcagtaaggagtttgattttattcaaagtgccagggaccattggatataaattcttcataaactgcatgcagaagagagattaaaaggttggcagaaaggaataaaaatgaaactggaggaccaagctggtaaaaattgcccccaagggtctatcagaatcctaactcacttagaccaataagatcagtggttacttatgaacaatacgtttgaaaagacctatgaaaaaacacgtgaaatttggagtttctctgtctctcatgtttcctgtaagtaattcgctagatatagagactcgattagattttgattcagtattttaggcaaaaatattttttgggtggtactgtgtacttcctattttgtcacaatgataggcatataattatatgtttagttccccactttaatgatgctaaaattaattagtgagttcaggtgttatgcctgattccttcatcataaacttctccatcaagtttcaccaaatcattttaacagtgattaataatcattggctagatacactatttcattagagttgcaaaataatagttttcctagcatttcttctttatttattggctaattttctttgattaagcactttcctaaatggagtattcaaaaaaaactatataaacaggaaaagcaggataaatgcttgatttcaccccccccccccacccccagcagttttcagaacaatagcttggtgccttaacacctccacagagagatgaccaatggaatttttcttaatatcattattgactcactttttttattgtggtagaatatgcataacacaaaatttacagttttaaccatttttattatacatttcagtggcataagtacattaacaatgttgtgcagccatcaccaccatccatctccagaactttttcaacatcccaaactgaaagtcttggccaggcatggtggctcatgcctgtaaacccagcactttgggaggctgaagcgggtggatcacctgaggtcagaagtttgagaccagcctggccaacatggtgagaccctgtctctgctaaaaatacaaaaattagccagatgtggtggcataagcctgcagtcccagctacttgggaggccgaggcacgagaattgcttgaacccaggaggcagaggttacagtaaaccgaaattgtgccactagtactccagcctgggtgacagagcaagactccatctct

SEQ ID NO: 172790 - DNA, 745 bp, Homo sapiens
gaggtgggtgcttcttaattttggctttcctcctttctaacatgtgcctttaaagctatgaattttcctttaatcatggccttgacttcctctcataagttttaatgtctgcagaatctgtagtgatgtcctgtttcagtcttgatattggtaatttgggccttctctttccttttgttcaccttactagaggttcattacttttatgattttttttttcaaagaaccagctttttgtttcacttacttttctccagttttcctgttttccatgtcattgatttctactattatctttagtatttcctgccttctgtttgctttgagtttaatttgctcttctattttctagttttgaagcagtgtcgttgtctgggtaaatacctgaggtttgttgtctcacaacaaggaaaattgagtatgtggacacacaggaagtgggtttaggagctgaggtttaataggcaaaagaaagagaaaggagactagaatagcactctctcctgccagagagaggggctcctgagtgggacttccagcctgcagcaaagtgctctggattttataggctggcttgaggaggcgctgtctgatttataggggtcaaagattggttggaccaggtttgacgtctacatagcatgcgaggaagctggcgaccccatcctaatcttctattatgcaaatggagttgttacttggccggtgccatgttgtcttctcctcactgtacacgtggttggca

SEQ ID NO: 172791 - DNA, 516 bp, Homo sapiens
gaatgaagatagggacaggctggagtttggggaaactacactgaaaattattgtagtaattcaagtctgaggcaatcaaggctcaaatttagaaagctgagttattaatggaagaaaagaagaaatagattttaaaaagactagtagaatgaatccccagggcttaggtccagtttgtagtgagcatggggtgatgaaagatgagagagaaaaatgtaaaagatgaaagaaagagattagaggacaaaaggcttgggacaaaaggtaattatagacacactgagtttgaaacaatggctgcaagcccaggatatggtacaactttgacgcctccttaaacttgaggggattaattttgcagaaaaataaaatgtgaagaatcaagactgaacagagtagcatggcaataagagattcactgacatgtaaaagtatcctaagactttgttgacacctgactgatcaaatgatcacagggcctattggatttacttaaaagaaaacttcaaacttcat

SEQ ID NO: 172792 - DNA, 511 bp, Homo sapiens
aggaagaaaataacatccctgtagacattgaaagcacaccagaaaggcatgcccataaatggatagaagctatagagtagtacttaaaattgagttttaagacatttagaaaatgatacaagatatgaaagaacaacaaaaataaaattgaagaacttgggaaaatgttagtaatagaggaaaatcactcataaattaagactagaataaacaacagctgatgaacaacagatatgccctaaaagaaatgaaagataaaaatggaggacttttagaaatcagaaagaaaagagataaaaaggattagtaggggtatgacaaactctagagacagaaaaaatgcaacatacagaacaaaatcaaatgactactttgatgaaaaaaatttggaactacacattggaagagtaacctgcctacctgagattattatactgggacaaccaatggcaatatacaaactttgggtttgactagacaaaaacagcaaatgacttacaagagcaagagt

SEQ ID NO: 172793 - DNA, 456 bp, Homo sapiens
agtgtccctgtagacaaataagcgaaatgcactccttatctccttctctacaaacacactcccgatttcaaaaagttgttcctcgtatagcttcttctaaaggggggaaaaatacattcatatttccagagctgttgaaagtgagctcggccttggaactggaggcgcgccgggggtcgcaatgcaggcacaggcacgtacagacctttgcaacaatccggtacctgagggccctagtgcttcctgccaaggagggttttccaggagttaggggtctgcgatggtggtgtggtaggctgatggatggagcgggaaacagtgtgtaggagagggattgtaaaagaaacatgccttttaaaataaaaaatcagactggtctagggattgtcgtggttgaaaatctacagttgttatttcttggaaaaggggcctggctgggagagacattcaaagctg

SEQ ID NO: 172794 - DNA, 661 bp, Homo sapiens
ccaaattattttccaaatcaaaaattataatagtgaatacgctttttaaaactatatatgccctttaagtattaagcaatattctgtttttagatgtctgctgaagatagcttggaggccagagtaaagaaatggcctccaaagcccacccttctgttatctttccccaccctcccccacaacccagccaccagcacttatcatctctagcctcgtttcatgtactctttccaggataaattggccagacaatgaatagaagccctgggtcatccaaaaaaacaaaaaaggcatgctatgcaagactcctttgaataataacttccagtaatgttggcaagaagacactttgaaggaagcatgcaatgaccttggggacaatttggcaatatgaattaaaaggctttaaaatgctcatatcctgtgaaccatcaattccgcaaccaagaatttatccagaatacttcattgtggatgagcacaaagatttatccgcaaggatgttcatctcatcatttttataagagcaagtaattggaaatgatctaattgtacgacaggaaattggttaataaactgtggtacatgcttacgatggaatacatacaacttttaaaatgatattttaaatacttactgttgaataaaacaaaatgttaca

SEQ ID NO: 172795 - DNA, 618 bp, Homo sapiens
catgatgtatatatacatccatatacacacatactcatagaaaaaagtctttcatcttttaaaagttatacagctctggaatttaactagcatactagaaggcaataattaatatagaagaaaaagagaccaaggaatagggaacaccagagggttttggataaggtcagaaaaatgtgtgctactgtagcaataacgcttgaacaaagaagtgaggaagtgggctgggtgcaatggctcacacctgtaatctcagcactgtgggaggccgaggcgggcggatcacgaggtcaggagatcgagaccatcctggccaacatggtgaaatcctgtctctactaaaaatacaaaaattagctgggcatggtggcacacacttgtagtcccagctattagggaggctgaggcaggcgaatcgcttgaacccaggaggcagagtttgcagtaagctgagattgagccactgcactccagcctgggcgacagagcaacactctgtcacgaaaaaaaaaaaaaaaaatgaagtgaggaagtgaaagaggaagtcgtgttccctacctgagggaagaacattacaggtacaaggaacagccagtgcaaaaatcttgaggcaagagc

SEQ ID NO: 172796 - DNA, 109 bp, Homo sapiens
tcttcaaaccctacacattcaagcaaaacagacaacaaacactagtgcaagagaaggcatgactttgaattaaaaatgacagtcatttataaaaagatgcattggagat

SEQ ID NO: 172797 - DNA, 321 bp, Homo sapiens
tagtaggctcggtacctcatttgctcatctgcttaccacaaattacaaattccagagaaaagaacaggctttcctcaacaaagtgtctcttagcactttccaagactcactataatatagtaagggaagacaatgcagtactggagtaaagacagacataagaggtcagtggaacacaacggagtcaaaaaatacacacgcattggatatattcactgatttttttggggggagggggtaaaatccaaggtaattcaaaggaataagaatactcttttcaacaaatggtgttgaaacaacaggctatctgcatttggggtg

SEQ ID NO: 172798 - DNA, 385 bp, Homo sapiens
ctccaatggctttttcaatgcaacagtctataatactaattaggggtcaggtactctccctattgaagaacagttttaagaggattaacaacatcaaaacattcttaatttagtcaactgggagatgctttcttcctgttatccctgatgttaacatttcctatcacatcaggttgcattagagcctatctttggttagacaacaccaaggatttctaattagaactcaagaatgaagataaacttactcatcttgatagtggatcttacacattcaactttccagttaacttccagcggcatttgtgaggcttaattaacatttgtaaagctccatgatgcccttgtatgacagcactgcagtaaagcaaaggactgtgattat

SEQ ID NO: 172799 - DNA, 282 bp, Homo sapiens
tatcaccagtccagagcaacaacaaaaaattcactcaatatgaataacaaacagtggacaagatgtaaaacagtgtcaaacctagctgttatcaaaagaaatgatcaagtaaaacaaagacctaaatttttacttaatttactaaaatattaaatgataatgtacttgtatacccttacaagatgaaataattatttttgaaagtagttttataatgtattctaagcaataaaatgtatgtgttacttaagccagctaattaattcctggaattttattcta

SEQ ID NO: 172800 - DNA, 407 bp, Homo sapiens
ggtgtggtggcaaatacctgtagctctagctattcgagaggctgaggcaggaggatcgcctgagcccaggagttcaaggttacagtgagctgtgatcatgccactcgactccagcctgggtgacagagcaagatcttgtctcaaaaaaagtgggaaccaatacaatgactcttggcaagcattcaactcaactagtggaagcagactgaccacgtctacaggagaaaaaccttcaagcttcaagcatttagagaggaaataagagtatgtcagttaacataaggagctaaatggaaatcagttaagagagcttctatacaagtcttaaggattttctaggccaagtgctgtgactcacgcctgtaatcccagcactttgggaggccaaggcagatggatcacttgag

SEQ ID NO: 172801 - DNA, 375 bp, Homo sapiens
tggcagcagaatacatattcttttcaagtacacatggaacactctccaggatagaccatgtgctgggtcacaaaacaagtctcagatttgaaaggattgaaatcaaacagatatgtttattgaccacaacataattaaattagaaataaacaaaagaaaggtatttggaaaagcttctaatatttggaaattaagcagcatacttttaataggtcataaggaaaatttaaagacagtttgaactaaatgaaaatataaatacagcatatcaaaatttgtgagatgcggctcaagtggtgcttacaggaaaatttataactttaaatcctacattagaataaaagaaaacatcagataatctaagcttctacctta

SEQ ID NO: 172802 - DNA, 299 bp, Homo sapiens
cggggattcgctatgttggccaggctggtcttgagcttctgatttcaagtgatccgcccacctcatccttccaaaatgctgggattacaggcatgagccactggcctaaaaactcttcactattgttctcactcccaaatcaagtgcctatgtcagcaggactattactattcaggctgctgtgaccctgctcttgctctgtttcacttacatttggctcaaaaggactaggtatcgtctttttttttttttttggtagagacagggtcttgccctgtcactcaggctacattacaatg

SEQ ID NO: 172803 - DNA, 256 bp, Homo sapiens
ttggtgtcctcagccaagctgagcatccctgacctctaggtagagtccacattcctgggggcctggccttgtgctgtgggcatacgattgtgtttgaaggagggagcccacgggactttctccaaggcttggatacagtgtgttgctggggctaccctaacagtgtggccctttccccctcatctacctggcactcttctccctatggaggtggactgtgctgggccatgtctacctactccacgggctccacggg

SEQ ID NO: 172804 - DNA, 402 bp, Homo sapiens
tacagataaacactgtcaactttttattgagctacctacagtatttttgctatgcatatctgtatatctcttttgcaaaattaagattgcattttcataattttataaactatttttcttacttaacaatatattgtgaaatttcacaaggcttttccccaatattgtaaagtgttttcatgaatattattttaatgtactagattgaaacatatagaattagtaatatttaatgttttttaacctatagtgtacttttttttttttttactagagaaggtttgtgtaaattagcagtacatttatttcttcctcatttcagaaaatagcaaaattgtatgcaggaaaatgggggaagccagaagaccttgcgacctggcacccagaggtcagatgccattt

SEQ ID NO: 172805 - DNA, 346 bp, Homo sapiens
aagtactaaaatatcaccatgtacaaagtgccttagggacacaaaatagggagcaattaactgaggaattaagagttgtgttatatggaaactagtctttgaaagtgagtggggatttccagatggagcagagcaaaggccagccagtgctggaggaagaacaacagcggcatcatgttgtcatagaagaaacgcagggagcaaacaatggagccagaggatgaattaaatatgtcagtttggagctagtgccttacttcatgctaaggtgtttcatgcttatcaactagccattaggaagccatcaagtagcagaatcatttctttggtcatttctgatttcaaa

SEQ ID NO: 172806 - DNA, 129 bp, Homo sapiens
atgaggctgcagtgagccatcatcgtgccacagcactccaacctgggcgacagagtgacctgtctaaaaaaaaaaaaattttaagtaatgtgataatatatggtaaatatcaatgaataggccaagtgt

SEQ ID NO: 172807 - DNA, 404 bp, Homo sapiens
cggcacgaggttttgttgccagatagcaagtcgtttgagacctgtttcatgccatgagggacaaaccacatcttgaagtggcgtggttgacagttgtgtcaaaaaaataaaacaaggcattatcaaataatcttctgaaatttctgcctatatcatgaaaggaggatgtttgatgagcagaagttggtgtgggattcataactaaactgtccatctgtgggagaattctgcaggcttccatcactagtgtgtgacacagcaaagagatgacagtcctattcagctcccaaatctgtggttccagggcactgctattggaacgaggctcagtcttgggtgccactcaaaagggaaagtacagatggattaaagagtgatcaagcaaaaaaaaacatttgcggccg

SEQ ID NO: 172808 - DNA, 386 bp, Homo sapiens
ccaatcattaagctctcaaaatacaaatatttcgatgttactatgatgcactcatctggaatttagtaaaaaaaaaaaaagggatttcagccaggcgtggtggctcacacctgtaataccaaggcaggaggatcccttgagcccaggagttgaagaccagcctggggaacatagggagatcctgtctctacacatttttttttttaattagccgggagtagtggtacatgcctgtggtctcagctactcagtaggctgaggtgagaggatagcttgagcctggggggttgaggctgtagtgagccatcatcataccactgatctccagcctggatgacagagtgaggtcgtctcaaaaaaaaaaaggggggtgggggggtttcata

SEQ ID NO: 172809 - DNA, 205 bp, Homo sapiens
tccagccatgtgacagtgctgcagttcaggtgacctgctgacaggcacaagaggcaattagtgctggcctactaggagcatctgctctgggtacactcctgaggtggggtcaccgcacagtgtagcacgtaagggagcccacagtagcagcctagctgctaacatctccgtgcattttttttttttttagacggagtctcagtct

SEQ ID NO: 172810 - DNA, 220 bp, Homo sapiens
ctataggaaatagacacgttcaaaccctggggctcacatcatttccctgttcatatggcctgtcctggagctggttaagatattaagttaagggaaagtataaacgttaatgggtttttaccagattcttcccccttacttccgtaaacccatgtgctaacaggcctttcaacaaagtatactgagatgaaaattaacgcttaatacactctggaaagtg

SEQ ID NO: 172811 - DNA, 169 bp, Homo sapiens
agccacatctatgagacagatttttaaggagatttcagagccctccacccagccctgactccagtcccttcagctacaagtatgaccccaagtgcctgacttggtttttctcattcatcactgtgcactttgatttctaaccttagcctcgcggatgatgccagtttgt

SEQ ID NO: 172812 - DNA, 465 bp, Homo sapiens
cctccgtggctcaagggagagaggactggcccagggttcccctggaagatagtggcagagataagcctccagtgtgggtctgataaccagacgggagccagtaaaggcggggtgatttcctctgtccccaccccccaaatcattcaggggtagggccaaagaaccctctatcatctccctttttagcgcccccccgtcattcctttctgcttagcgggaaggccaggtggcaagggtggggatgggatggagatagttttcagcagggagtgtgggctggcccaactcagccatgagccagcttgtcctagtctgaagagagcagggagagtcttgggggaagagccctccaggctccacattcctgaggaattatgagaagaccccctgaaactcaggccagagcccttagttggttccagccctagtccaatcctggctgggtgatcaagagcatatccctta

SEQ ID NO: 172813 - DNA, 902 bp, Homo sapiens
gggctcagtgcgccatgttgctctgtggtatcgcagtgccttgcaaatgccctgtagcagatgaggacacaaattagacactgagggcactggaagtattttgggcatttcacctgcccagcacttcttctggccactgcaccatcattttcccttggagaaatctctggtcttggtggaattgccaatcaaaatgcctgcctacaatggatacccccatgcccccaggccagcctatcagactctctttctcttgagcagacatgggaacagctggcatgaatttgtcccaataggaccatccatgtgattgtgctcctcagatcccagctggccgtgattcctgtccctccaagcctggttattcagttctttctgctactctgggaactacttgtatctgtctcatacgttcattttcttgcctagattaagttgttttctgttgctggcaacctgagaaccctaagtgataggaaagccaatctgcagcttgcccttggacctcatcctgcacagggagaggttgaaataggtccaaccagggtcacagggtccccggagccctgctttccccagtgatggtgaagccctggcaggaggaaggccagcaggcagagccgcttctgtcctgtgatgtcgtggaagagctggcctgcctaatctgggtgggggccagtgcatagaaatcctgatagctggccccgggtcagagtccttactatccgtcgatgaggggggccctcagaggcagcggggggccagccgacgaaggcggccaggggggccctggacaaacgagagcgggcacgacgggagagacatcctgaaaacagcgggggggaggcaacacgcgggggggaggggccaacacgccccctcacgggacactggcatatagg

SEQ ID NO: 172814 - DNA, 790 bp, Homo sapiens
gccctgtgcgccgttgtctccgacggcgctgcctccctcgacccgtggctcccccttcgcaagttggcgtggcctcctcccttttgtccggccctggtccggtctgccgcagacccctcagctgcctgtgcgccgagcatccctggagtcacccgggccaggcgtgtcggtgccgagcagggcgcgtagtggggcagggtggcacgtggctcgtccctccagcgggatgaggctgccaggggacggggcgctggtgcaatggagcgatggaacgtccacatcctggaagcaccgtgctgcaagttgccatgcgtcgtcaatggagagtatcccgctgttcaactaacgggcctgatcaaacttgccttcctgattctccaagaccatggtgcaagttctacagatctgactgagacagcagatggattacactagtcattgtcgactgaggaccggattgcctagagctgccctcctcggagcacctgagtgtggcggatgccacctggctggccctgaacgtggtgtccggcggtggcagcttctccagctcccagcctattggcatgaccaagatcgccaagtcagtcatcgccccactggctgaccagaacatatccgtgttcatgctgtccacgtatcagacagacttcatcctggtgctcaagcgggacctgccctttgtcacccacacgttgtcatcagagttcaccatcctgtggtcagtggctagactgtagcagccgagaacctcggcatcaccagtggcttcgtgaagcccaagctgggt

SEQ ID NO: 172815 - DNA, 266 bp, Homo sapiens
cagcatgtgctgctttgtgtttctgtgtcacattttggtaaatctcacaatatctccaactttttcattattattatatttgttatgatgatctggaatcagtgatctttgatgttactactgtaactgttctggggtatcataaaccatgtccatataagatagtgaacttaataaatgtggtatgtgttctatagctctaccaagagactattcccccatctctcttcctctttttgggccaccctattatctgagacataaca

SEQ ID NO: 172816 - DNA, 484 bp, Homo sapiens
tacaagtgtgttccttggactggaaggcattgataatccaaacaatatataaacacatatggaaaatccttgctcagctctaatctccttacatagcgtttcccaccctatactcaattctttttactaatttcttgtgaattctttttttgtttttatagcaaatgcaagaaagttaaggtatattcttttatccccttgcctttctcttacaaaatacaattgtggtaaaacacatgtaacaaaatttagcattctaaccattattaagggtacagttcagtctattcgcattgttgtgtagctaatcccctgaactcatttcatcttgtaaaactgaagctctatactcattatttttaagtaaaatatgtgtctaataaaattaaccctttgttagtattgagttttatgagttttgacagatacagtcatgtaactactaccacaatcgagatatataacaataccattgcctcccacc

SEQ ID NO: 172817 - DNA, 318 bp, Homo sapiens
  misc_feature (50)..(51): n is a, c, g, or t
ctgattatgggactgtttaatagattaatgtgactgcaaaagctaaaatnnttcctaggttattgaaaagtcatattctcatctaaatctactacactgtcattttatattcaatttaaattccctcttcccccccgcagcaggaattaaaaggagtttcctttctttgctcgttcgccctctggttagctgctgcttctgacttttccagagctggggcaaagggaagcaatgtaaagaaaattgaagggtcttacttaactgtaggtgctgttgtaatcttgctgtatgtctccatggcagctgcccaaatgatga

SEQ ID NO: 172818 - DNA, 330 bp, Homo sapiens
caacacagttaatttctaatcaataaaaaggaaatcaaagaaaatcatctgggacaaaagacattttctggagatagcaagagcccagctctcctcctgacaggtttgctttgaactccttctctatggtcctttcgctctctctcacctagcaaagggtttcaaatgtgcgcacacaaattttagtgaagcccaaacacagctgctctgcgcccccttatgcctttgctctcaccggttggataaagtctattgtctcttaatctgctgcacaaacaacattaaaatagaaatggattttttaaaaagcaaactccaaccgcaatgcca

SEQ ID NO: 172819 - DNA, 486 bp, Homo sapiens
acatttaatggcattttattatagtttacagaaaattgttacatcaatttccattacactagtagtttttaaattttgtggagacaaataactacaccgtttcttcatatcatcaaaccaactatcaccaagccccttttttttttcttttttttgagatggagtcttgcgtcttcgcccaggctggagtgcaatggcgcgatatcggctcactgcagcctctgccacccgggttcaagcaattctcctgcctcagtctctccagtagccgggcagggtggctcatgcctataatggtacaggcacgcgccaccacccccggctagtttttgtagttttagtagagatggggtttcaccgtgttggccagttggccaggctttattaaaaatacaaaaaaaattagctgggcatgggggtgcacaccttggatccccagttcttttgggggtgggggcggagaattatttgaggaaggagaattgc

SEQ ID NO: 172820 - DNA, 839 bp, Homo sapiens
gaaattttaattttttttgaggtatcctctgtagtgataaatgaagcacacaatagattcttatcacggctttcaactgtcacattgaagaacttagttgtttgcatgttctgaaaacttatttctctgtccccatgatacccttttttacaggaatattctatatcagtaaaatctcggtcatttaaattatagacaaatatcaatttttatttctacattacatctcctaaaatattttcttatatacttatctacttttttttaaggaaatgaaagctgatttgaccagatgagaggctaattacataattaacatacagatacacttttcaaaataatagtgaataaaaggcaatcttgaaagtttatccttttattaaatttctgttttaacactcactagttagcagaatgctatcatttgcccttcttgaaatgaattgttcacctttcagatttgccatgatgatagcactgcagaaactcttttttttctttggagacggagtcttgctctgtcgtccagtctggagtgcaatggtgcagtctcagctcactgcaacctccatctcccgctgtaatcccagaactttggggaggcaaggctggcagatcactttagatcaagagtttgagaacgacctggcaacatggtgaaacccgtctaaccgaaaaaaaaaaaagacaaaaaaaatttgggggcctggccgaaagttttaccactcgtgggcgggccaagggtagaccggctacggtgcaaagaccgggcagcaggtggtcccaaaaaaacgggacacgggtgacaccaaggtgggtcggtacaggcggcaaaaccg

SEQ ID NO: 172821 - DNA, 262 bp, Homo sapiens
tttgcacttatttcactgtggtaacacttggtgccttctcccactggctgtcctctcacagcctttgtgatctttgatcttggaatgcttgttttctagcagttgaaagctgaattgaatttttaaaagttcctctagtgcatgctgaagattttattagcttgctgcggcagttccattttagttcctctcatagcatcctctcattgagagctgttatccattttgtgctcttgagaagctccgtgaaattatattgcag

SEQ ID NO: 172822 - DNA, 274 bp, Homo sapiens
aacgcaatggctcgtagtttggtttactcgatcttggctggcactgtaaagcgtatgtaccttttttgagtattttctaattccctctaattcccagggtttagaaaggatgtgcaaatttgtgcgttgaattaaaggacttatgcagatgagtttttggttttaggggagagttgattacaatttttcttggtttcaaagcagttttaaactaagtttcaaaaatagatctcttctttttcaacagtattccaaactgtaatgttaatcctag

SEQ ID NO: 172823 - DNA, 287 bp, Homo sapiens
ccaggaaagatgagaggagagaaaggggctaagaggactcacggagccacgagagcactgatgttcagctctcctggtggaaggcaatggattctgccctgagctgaaagactgagaagcagccagcacagtttttagagctacgggcgcaaattccaagagtccactgagttgaaagtgattgtccctagggtggatgctggttggggcaaagggccgctgtttttcctcacaagccctatggatacacaggctcactaaagattaaaacaggaaaaaaacaaaca

SEQ ID NO: 172824 - DNA, 416 bp, Homo sapiens
ttttgactattgagttggagcactgagatttgcaatatccccatattcaaacactgattcatgagtaaaagaatgaaaccagagaatccacatggttttggataaattgaaacaagtaaagaaaggtccctaaacaccacaggtatccactaaaatgaaggagcaataatgtataaatgtctctggctagcttagagacctgtgtgttaggaaatgatgtcagtgatgagttaccatagaaagctctgggaactgccttgatggcttgggctgaatgttataggtatgaaagaaaagcatttgaatagtccttttaagatctttctagccctgagcagtcatatttttggaggccctactcctcatcctatcaagcactaaatagacccacatgccacattagatacaattttgct

SEQ ID NO: 172825 - DNA, 498 bp, Homo sapiens
tactgtttgaaaatttacaagcagaatgtattaatttctgaagaaaagctcattttttaaagaataaaaaagccaaattagatttaagttagaatattcttcctataccaggcaatctttttagatgatgtaacaaaagcagccacacaatggaagggccagtatgcataggttaaagcaacaggcctttcaaatgcaactaggtggggccatgcttctctgtctaagagcttccctaggcagaatttggtctactttgtctccatttatcctaactctagtatttggaacaaaaaggggggtcaaccaaaaataactaacagagaatggaaacataatggagaaagaaccatgtgagttcatcctagtttttttcatctggcatttctcccagagacactcttgacaagctaaaaagaaggatggatgggtcttctgtttagcctcatcttttattttttttaaaaaagtcagcatttctaactccaggatctatta

SEQ ID NO: 172826 - DNA, 458 bp, Homo sapiens
ccattaacttgtttaatcctcacaacaactctattagttatgttcttctattattcccattttatggataaagaaacaaagacacatagaggttaagagtttctgcccatggaatatagccaggaagaactggatgcacaatgagaggataaaatttgaacccaggcaaatccccaattaacaaccactacactatatgtggctggtcaaggaaaatatgatgttttattgaagactttaacagtagataaaggaatagagtttttctaatcatctaaaggctgttaatagtgttgacaataacaagttttaaattctgatttttcactactactaaagatagatacaccagattctcatttattaaattcatgaccaaatccagaatttgtaggctttccctaatctggatccatctttccaattctatgtcatctcccactagtttctagcacacg

SEQ ID NO: 172827 - DNA, 520 bp, Homo sapiens
gccccggagcacatggtgacatgctggagaagctgggcagtgcccaggagttggcacgtggggactcggttcgctgagttcgctgaaagcaaatccgtgttttgcatgagcggcctgtgtgtctgctggctctaaacctgccttgttttgtccagctgtggctgggatctgtgactccttggaaggcatttcacctcactcagagtcacaaaattcaagcaatgacaagaacagtgcctggagtagaataccatttaaattttatttatattcatttattcactgtcaaatatcctttttatttaaccaaatttcaaactgttagaaacagtggaggttatggaacccagagtcaggcagatcctcagagtttgtctttatttgcagctgtgagcacagaactcacgtatgttcatctcagaaagatcacagaagcacaggtgcttagaagagctgacaccaagcatgtggaaggaatttaacttcttcatgtattggtacaactgaaacaaattatgcc

SEQ ID NO: 172828 - DNA, 340 bp, Homo sapiens
caaatcacctctcccttagaatctactcactccagtactcctcaccaaccacagaggaaaccaattcgccaccctcactcacaccagagcattgtgttattttctagttggatccacgcttctattgcatggttttccggttgaatccaggcttctcatttctgctccattcttaccacatctctccccagctcatgaacctgctctgacacccacttgtctgatagatggtggatacagtacgctgtctggatgtcaataacttctatcatttgcccactgtgggggagttttctacatttcccaaccttaggacataccttctattctacttgggctg

SEQ ID NO: 172829 - DNA, 398 bp, Homo sapiens
gtttcttctgctgtggtgcacctaagctcaagccttccttctctccctccccttctggccggtatggtatctgagctcacagacagacaaggcatgttagaatcatcagatcatgagcaccgtgctgggatttagccctctccaaagtcaattcttacagtccatactttgcttaaatcctcagttgttgaggtctgctctgctgtcagtaatcccaggctataaatttcccccaaatgtgggcctagataagtagaggttgatggactcagcttattttcatggatgacaggaactggaaagagaaagggcattgaaaataaaagttatgcagaatagtcataacctcttactgttcaggattaagaaagcctagctagaatgaagccatgagaatg

SEQ ID NO: 172830 - DNA, 920 bp, Homo sapiens
ggggtttcaccgtgttagccaggatggtctcgatctcctgacctcgtgatccgcccgcctcggcttcccaaagtgctgggattacaggtgtgagccactgcgcccggccttttttaagaaatattcaagctgttacctaaaggggctgtacccttttcactcccaccatggtgtgtgagaattccaggtgctctgtatcctcagcaacacttgctgtggtcagtcttaatagtggtcattctaactggtgtaaggtgttttgaaggaaaaaatcacattaaacttgtgctctcccaattttatctggggaaagaaataagaaagccagaatccgcaacattgggcgaatgttttcttgcatgacagcagctggctagagcagaggagtctcagcattgctgcagaccctgtttcaaagccacatagagatgcctgcctacttctcctggagctccaacacactatagtccccaaacattaaggcccagtgccagttgtcatttatcattgtgcttgtattattgtttttctgagactagtgggatatttctctatattcatgtcttttaagaaactttttcactaaaaggctagttttttgttttagtattactttatatataacatgtacaaaaacagatacaaatcacaagttgtacaactctttgaattaccacaaagtggacacttctttgtaactacaactcaggtcaagaaatgaaacataatgaaactcccatcatgccccttcctaatcagtaatgtaccctcccacctcctacagttaactactatcctgatctccattgccacattagtttggaccatatgatgttgctgtttttgtgatcggaaatgataaaatagtggcagtttcagatggttcagcctttttttcatttatatgaaaattcaatatc

SEQ ID NO: 172831 - DNA, 278 bp, Homo sapiens
gttaaggctgcctaagtttaaatagtgttacttattctcaaaatatgtagcagccccacttaatttctcctaattaaaggtacccgactttagaggctggagtccgcggccgggtcgcggcgccattgcacaggttggtacccttttcacaatcagaaactagtgggtgtcaaacggaaatgcatttccctagatcttaatcttaaacatagacgtttaggccagttccaagaaacacaatgatcctctttgttttaacacctgacaaggagcaccaa

SEQ ID NO: 172832 - DNA, 474 bp, Homo sapiens
tcgtacctggagcatgggatagtatagggcttgtgtttgatttgtgtttgttattagggggttttttgggttttgttttcacttgatcttagccaaaaggccgagaatcgatggggttttggtcttcttaagagacagagtcttgctatgatgcccaggctggagtatggtggctattcacaggcatgatcatatcacactgtggcctcaaactcctgggctcaagggatcctcctgccctttccaagtagctgggaggattgcttgagccccggaaatcaaagctgcagtgagctgtgattgtgccactgcactccagcctgggcaacagagcaagaccctgtctcaaagggaaaaataaaggaaataaactaaatacccagccacgagcagattggttaaataaacccatttaatgccaaatatgtcataaaatggcactctctggggaccagtcttttttcctccaataat

SEQ ID NO: 172833 - DNA, 699 bp, Homo sapiens
cgcgcgggctgcagggcaagctgcaagggcgagtgtgcggctgccttcagcttttcagccgcgagtggggtggtgtggagcggcggggtcagctcagggcaggcggatggggcgcatgtgcccagggcagagccctccggccttggctgggagagtggccttcggtcccagggcagagctcagcccccagggccgggcctcccgagggccgcggaccgtggggacatggggcaggcgtggagccggacccgaagccaagccttagatctgtgcgggcagatgcgtggccgaggctgttaaaccggtgctgtaaaggcctcgttttctctccctgagcggctccccacatccccatgctgagaagaggccgcttctcctctcccgtcagctgtgcccccgggtgcagcagctacgggtccagccctttaaaggttgaagacgatcacccaccccatgctttcccagcaaggaacaggtcttgcttttatgagggtagagaggacattcaagtggtcggtcttggaaaactgccatccgaaggattgcaaacattcttggggggagagaagaatttgtccccgggtggaggaggactgctgggggctcgaggccgctgatgaagggaattcatttcctctcccgggtgcccaggattcagactgatccagacatctgttgggcgggcagccagtatgcccc

SEQ ID NO: 172834 - DNA, 480 bp, Homo sapiens
catggatttcagagacctgaaaagccctgccggcctccaggtgctcaacaattacctggcggacaagagctacatcgaggggtatgtgccatcacaagcagatgtggcagtatttgaagcagcatctggcccaccgcctgctgacttgtgttatgcccttcgttggtataatcacatcaagtcttacgaaaaagaaaaggccagccttccaggagtgaagaaggctttggtcaagtatggtcctgtggatatggaagacactataggaagaggagctaaagatagtaaagatgatgatgacattgatctctttggagctgatgggaggagaaaagtgaagaaacgaagaggctaagggaagaacaccttccacaatatgaatcgaagaaagccaaaaaacctgcactcgttgccaagtcttccatcttatagatgtgaaaccttgggatgataagacagatatggcaaaattagaggagt

SEQ ID NO: 172835 - DNA, 472 bp, Homo sapiens
acatctttggggacgttattctgcctaggacaggctctctttctgtgtttccttagaaccctcatctatatcagattatattagaagttgtctgtttatatatattttattgctgctactactactactgctactactactgtagtctactacattttacagacttctcaaggtcaggcactgttcgtttcatctttgaatcctggcattaccacagcccctggtgtacatatatggtgcttagtaagtgtttgctgagctaaagggaactctttcaactccctgattttacttatgaacaaactaagaaatagaaaactgtgctttttttttttttttttttgagacggagtctagctctgttgccaggctggagtgcagtggtatgatctcggcttgctgcaacctctgcctcccgggttcaagcagttcttttgcctcagcctcccaagtagctgggattacaggcgcc

SEQ ID NO: 172836 - DNA, 262 bp, Homo sapiens
aaggcatcggcgtaagatgctaatccaagacggttgagataagattttctgtccttttaggagttagagacctgagtttgtgtgtaagataagaagtaggaactaataaagaaagaacaatttgaacagaaaaagaatgttgacaaaagcactttaaagatatcaaggttctggattagaattgtctttggttgtaaaaataagaaagtcagtcagagaatttaacataccagttaccaccaggcataacaaataagtatag

SEQ ID NO: 172837 - DNA, 223 bp, Homo sapiens
gtccttactcctagaaccaggctcagtatcatacatagggcaagtgcttaaaagtgtcataatttgaatcacacaccccataagacatctattcatctctcagatgtaataactcagagatgatttcataataccaccacattttaatttttatttattcatttatttttttgagacagggtcttgctctgctgcccaggctggagtgcagtgatgtaatctc

SEQ ID NO: 172838 - DNA, 556 bp, Homo sapiens
agactgagtctcgctctgttgcctaggctggagtgcagtggcaggatctcagctcactgcaacctccacctcctgggttcaagcaattctcctgcctcagcctccggagtagctgggactacaggcgcatgctgccattcctggctaattttctgtattttagtagagacgaggtttcaccatgttgcccaggctggtctcgaactcctgagctcaggcaatctgcccgtcttggcctcccaaagtgctaggattacaggcataagccaccgagcctggcctctccctctttctttctctgtctccccgatccccaatcctgccacaaataccttcttgttaatcaagtgttagctaataatttccctgattcttccagacagagttagtctttctcctagcctcatgtccctgaaaacaatgatctttttgtgttatattaacttaaaggtctggttcttatttgattaactccttgaggtaagagcagagttaagctttttgtcactgctgctgtttttgtcttgaaatgtatgaatatccaggacttagtcca

SEQ ID NO: 172839 - DNA, 324 bp, Homo sapiens
cctttaaaaatctaagaaaaccttttgcttaaatttccatagtggttttatcagcacctcctatggcatgagtcattttctacctcatatgcaatcatctgtgtacttgttttatttccttttctacaatgtattgttcctggggacagtttttgccttcttagtcactgtatccctctaaatatttgcatatagtgttaaataatatatatgtttgaaaaaagtgagtatcacagaattggactctctttgaaactaggaacactgacatgctaatttctcctttacaacaaaaggctttcctaagaatgatgggagaggcca

SEQ ID NO: 172840 - DNA, 119 bp, Homo sapiens
ctaatgaagttgagcacccattcctaaagtttttggattagtgcttttgttctagttttattctaaatagtttataattcccattttacttatactttagccaagagttatttttttct

SEQ ID NO: 172841 - DNA, 272 bp, Homo sapiens
atttcagaatacttatttaaaaatatttctaccatgctttctgccaaaaatgaaatgtaattcaaaagcatccattggaaaaattaaacctctttctgccagaataatctagtgttagcatttcatgccttcttaaaaacagattttatttttcaaatcagtttgaagtttacagtgaaattgagaaggtatagagatttcccatatcctcttccccctagacatacataggccccctcactatcaacatcccacactgacgtggtacattt

SEQ ID NO: 172842 - DNA, 366 bp, Homo sapiens
tggtgatggaatttcactcttgttgcccaggctggagagtacaatggcgcaatctcagctcaccacaacctccatctcccaggttcaagtgattctcctgccttagcctcccaaatagctgggattacaggcacctgccaccacgcccggcaaattttttgtatttttagtagagacagggtttcaccgtgttggccaggctggtctcgaactcctggcctcaagtgatccgcctgcctcggcctcccaaagtgctgggattacaagcatgagccaccgcgcccggccgtaaaacttattttgatgcagccaaattctaatctctgagcatcttttggtaaatatgcataaggcagtgtgtcaaac

SEQ ID NO: 172843 - DNA, 227 bp, Homo sapiens
acaggttccagccaaccctgactcggttttcagtttaaatgttagcagtgcatcttgaatggcttcttggaaatagctggtgaggttacactaggtgctatagatgtttgacacccagagagctcctggtcactcctggctgccctgcaggtatcaagtggccaagtgagagctgtgccggaagcacaggttccatagatgaccttggctggggtttccagggacac

SEQ ID NO: 172844 - DNA, 923 bp, Homo sapiens
cagagccctacacctctaatttttaaatctttgttttatgtaccaatgttttactttaactgaactcattcaccctgcattgtgagactggttctatgctatgcattgcacagattaggactgtgatatgtcatggctataagtcctcactctatgtttttaaaaaatcatttctaactagttgttagagttttacttattaactttggtgcttagtggctgactcaacagttacatggttacatctccacttggcttaatgctttattttgattttttatccctctacttctgtcaggagatcatttttagtggttgatacttactttttttccctagtcttgagtttgggatctttattttaatgtttgtttgctcagaataactgctgctactttttatgataaaatagctttgtttgcctgtacgtgctttgtgtattcttgggccaaaagattaatttctctgatggagaatattaaaactcaaagttgtgtaaaggaccagaatttatttgggtacttacatagaattcctcagataaaatttccaagtggaatttccctccgccccactgccacccctttttaattctccctccaattttaaatgtcactgccttgtctttccccctttgggcctctagaactgtttcaaaagtgcccatgggtgggaagcaaaaacaattaccttatgagaataagaagaaagttttttgggagcagtatagttcattttccttgctcatatttaattggaaaatcagagaagcggcattatatattcgcattggagttacagaactttctgttttgacagattgggttattcataggtatatcgtaaagcatttcttgatggtataatacaggccagtgtggtcttgtactaccccttagtgaagccttaaacgatggtcagta

SEQ ID NO: 172845 - DNA, 173 bp, Homo sapiens
atgacctggaggggcaaattccctggtcctccccaaacccctcctttgtgggtgagtgtgaatggggaagagggaggggagagtggcttcctggaggaggtaggctttagggagccccagagcgggctcaaatagacacccacacctctccaaccccctctaggtaggaagtg

SEQ ID NO: 172846 - DNA, 902 bp, Homo sapiens
cgggtaattcagtgtccgtgtcatcagtggtacatgcctacagccgtgttgaaattgtgtctggagaagcacatgaaccagactctccctgatttacaaggctcttcgtcatcgggtccctacttaactctaatttcatctcttgtcttatctataatttagtctgatatcatacattaattatatacactgtacattgatacacagcatttatttgaaagacagacctcttggatgtgactatggagacaagaccagcagctcgagaccattcaatccaaggtataaaatggaggaaaatcagctccatcatggtctgaattgaggatgaggcagaagagcagagaatagctgatgcccaggtggcagcaacttcactctttccctgtggagttgcagggtctccccacctccactgcgttgggacatgccgtgtgccatctctttatccatagctgcctccggcatcagcagagaaagtcatgggcagatggagctttggattagttcttttttccagtcttcctttactttatctggataagattgggcagattgaatttgatcttctatactggggccagggagcagagtggatctagaccatgcagcttttccctactgtcaccagattgggagcagggattggctgccattgtcctctccagcctctgtgttcctgggacaccgctgactggaggctgctcctcttctaagggggtccggcacagagcgccacccagagcacatggcaccttctctctcctcctgcaccagtctccttgccctctgtattgtcatcatactgaagcaaaccatccaactcaccagcctctctctggaatccagtctcattgattcctctccctgagactcttcctcagtctccttttagcccctca

SEQ ID NO: 172847 - DNA, 438 bp, Homo sapiens
ttcccccacacacacttctaccttctctaagatgtatcacttgcctcttataagaataaggaaagaaggtacagaatattcgcagccttagagttaactcctgcccacaattgccatctctacaggcaggcaacatggccccttgtcacctatgatgctaagaataggctccaagatcaatggacaggtctacatagaaccacgtgcacatagttggtgaaacctggcactctccaaaaggccccaccctcaaaatttggggtctttccaggtcctgataggctaggaaataactgagagtaatcatttctcccaaagaacttatttccctacaacaaagaccccaaaccatgtccgagggagtcctgaccttgcccaattatgctgggtaaaaagaaagtttgtgtctatcagatggtgttggtgtattaatgggga

SEQ ID NO: 172848 - DNA, 398 bp, Homo sapiens
atgatcctcccaagtggctcccaaagcactgggattacaaccatgaaccaccacacccagccttactttttcttcttcatcttaatttcctgcagtttttacatggaccaagtaataaagaatataaatatggtgttttatggagtcttagagcgtgctttacagttagaagattccaaagagacagaattcaaacaactttagtcaaaatcacattaggaagtagatataactggcctcagtggttttgctggaaagagaagaatgaacactgagtgttaccaatgggacttaatattgcataaagcacacaaaacttccccgccagtgggcatcgtaagtgacaggaaggctgtttatcactgaaatcaattaattccaaataacacattgaatcc

SEQ ID NO: 172849 - DNA, 516 bp, Homo sapiens
accagggactggattagaatctttgactcctaatcctgtgtgttttgggccgcaagagcacaacagagctgaggttagatactagagtcccttctggcctctcaggcctcacagtccttgatgggaggcaggtaggtgatgatggtggttcctggaagccctggaggctggctgtgtgagaagctggccagaggaaagagaaatttaaattcattgtatgcgtgtcttgtggttacaaaactatgaatggaagggagtccatcagggtggctaatgcagtgtggtcaggaaggcttcatttcctgccccagggagaataaatctttattggagtccatgggatgctctcagtctttgtgagttcttgcttattgggggttatccagctgagaagggcagacctagtgtctcacatataggaagaatgttagtgctgggaagtcttccagttaacatatccaacaattatttttcaagtgtgtttttagagagaatgtgtacaatagaaagaacaga

SEQ ID NO: 172850 - DNA, 411 bp, Homo sapiens
tttggaaaagtattatatactagtatctatctgttacaatgaaataaataataattaataaaaattaacacatgccaggcactgtgctcaggagtttacacatttcatttaatcatcctaacactttgaggcagatgatattattgtccttattttgtagatcacaagaaagagacaaaaataatttgcttaagcgcatgaatgcagaaccaggacttgaatctgggctatctgatccctagcccctgcattaactaaaagttagaagttccagtctcctgtcttatatatattctctgggttaccttgagcatgtcacatccttctctgatgcagtttcctcatctacataacaaggcaatttgattagaacagtatttttcaaattatggctcaataatgcattagtgg

SEQ ID NO: 172851 - DNA, 405 bp, Homo sapiens
accgtgggaccacacagcgtcaaactggtctatgaacatcagggtgggacatcccgagcgctggctgctgcctcctctgtgaaaagtgaagtaaaagaaagtaaagatttcatcaaacccaagttagtgactgtgattcgaagtggagtgaagcctagaaaagccgtgcggatccttctgaataaaaagactgctcattcctttgaacaagtcttaacagatatcaccgaagccattaaactagactcaggagtcgtcaagaggctctgcaccctggatggaaagcaggttacttgtctgcaagacttttttggtgatgacgatgtttttattgcatgtggaccagaaaaatttcgttatgcccaagatgactttgtcctggatcatagtggtaaggcaattctt

SEQ ID NO: 172852 - DNA, 448 bp, Homo sapiens
cgctaaactgtcgcatgtttgataattaattcaccaccctattaggtaggggctgccagggaataagcgaggactccaaattttctgtaggagggcttgttgggagttggcaattcggtctgggagagaaggttttaatccgagtgaagagccctttgcactagcctgggaggaggctggactgtcatcctgccttgactcaacacagccattcccctagaagttacagcacttctagggtcacctgtgttcggagatctaccctgtgtgcacacatggggaagaggcttaggttgttaaagtcagcatgttaaatcatttcctgaaatgcgactgtaactagaacccagctgacttcccccacagccgttcttacccattttattactgtctggcataattaccagcatgtaaactccaagaaggtgcttcatcttattttagtgcc

SEQ ID NO: 172853 - DNA, 286 bp, Homo sapiens
taagatggtaatgattccaaagcgcagctcaagctcagtggataaacaacagacctcaaaccctggggggctcatgttctcatcatagctctgggcaagtcacttaatctcatggttccttctcaattttctcagctctgaaacggggatggcagcacttcacgaggtgtttatgaggcatactaagatggttgtaaaacattttacaaatgtttaataactgatgcccttttcataatttggctttataacatctttcattattcattcagtggtgtggaaataa

SEQ ID NO: 172854 - DNA, 589 bp, Homo sapiens
gaagcctttggcctgttgctcctcacagatagtttcaactccacgcaaaacctgccgaatgaacacttgcacatgagtgtcctgcggagatttgcggaagagaaggttgagctgctggagaaggccatcgcacagtgcttcgcctgcatggagcagcctctgcaagaaggggtcaggaccgccaggacttcttaccgctgcatcctcagagcatgcttggtgaggagtaaaggaaaccaaggttttcatcagaccctgaaagctgtttgcctgaaaaatggcatctatgcctccaggactctggcgagaattgatctaaatgaagccctcactcagcccgtctatgaccagatcgaccctgtttttggaagcatttttaggacggggaagcccactggttcagctctgatgcctcacatagatgcttttaagcagtccctgcaggagaatcgcttgaacccaggaggcataggttgcagtgagccaaggtcgcgccagcctggacgacggagtgagactatgtctcaaaaaaaataaatgttcatggaaaaggaatatattttttttttctccctcacccccttcctta

SEQ ID NO: 172855 - DNA, 264 bp, Homo sapiens
ttggtattctttgcccaacatctgtttcaaagagcagaactaggtagaaacttgaggaagaaagagagctttggagcaatggagaataaataccattggcttcaaggcttgggactgtctctattcaaaagcaaagttcaggctcgcttcacgatgacgtctatggctcgaaggacacaagagagaaaacaaacaaacaaaaactgtggccgttgaattcagtgagtatttatggagcctaatgcggtaaagactcagccgatt

SEQ ID NO: 172856 - DNA, 354 bp, Homo sapiens
ctgggcagagaaggggacagtgtccttgcttagctcagcactcactaccctgtgctgaagaagccccatttgtcctgagggcgcctgtggcttccagaaccagctgtagcaatcacagagctaaggaaggagctgtccagctggggttctacccactgccaccccaccctagctctttacctccagggaagccccagctcatgggatgggcacagcctcgggcattcatgggaacctggtcacctgccatgtcacatacccaggctgtccccaggaatgtggtcctcccatacatgcctatcagttatgccaggtatgatgccaaaactaggggacctggcttctcttctttgg

SEQ ID NO: 172857 - DNA, 465 bp, Homo sapiens
attcaattaacacttttaatgttaacaggtgtggaccatcaagagattgtctctccctggctgccgaattctcattcttagagaggcaatttgttaattgctgaaccatcacctgacatttctagtgggtcgggagagagccctctgctgccctgttgatgcctaactacctgtaacaatctgattattgtaagttttcctgtatccagtatcacctccaatatttatcaaggagttgtgtgaaataccacctcacaaccagatgaagaattttatcaccacctcctccaattcctcatgagggagaagtaggaattgctctgagcctaaggtagaaaccgttcctgaaatgttgaaaaccgtcattgtgagtaggtgagtggagtggtggagtagtgaatcacctgtacaatggcactgtcaaaagacaaaattacaacacatttagtttaaaaataaaaaaaa

SEQ ID NO: 172858 - DNA, 200 bp, Homo sapiens
tatctttggagtcctattttagcaattgtaaagcatcgttatttgaatttagaaattcatttctgatattacatttctcaggtatttgctagatgaaatgtggattaaatgggtaaaaatattaatgtatttttctaagctattataccatgttgctataattgcatatgtactatctgtaccgaccgttatgggtaaac

SEQ ID NO: 172859 - DNA, 475 bp, Homo sapiens
gggaggaaatctgctttattttctatgaggtcattatccaatattatttattaatatattcacatacatattcaaaatatgacctttgaaagataagcattgtgagataccatgctttttatctacaattgatcatgagctaattcattgatttatgttataaaatgtgtatcactggctttcacaggtttaagattaaaacccaatttaattaaaacccaagatacattaaattttatctttgttatatctatgaaaaaataatgcatagaaaatatctgcagatattttctatgaaaaacactctatttatgtctcactatttaattatctaatgttatataaatagtcacatacagaatgaagaatcagagccaggcacattatagaaaagaatctgtgacttcctaatcttgccatgagtagcaagttattctaacagtttaatcatggaattattcaaatttgcttctgt

SEQ ID NO: 172860 - DNA, 389 bp, Homo sapiens
tcccctaatattgtttagacttccatcagcaactctcactttctcctatcatctttttacttgtctttccattaaattgtgagctctttgagtcagaaattacatatttcagaactcccttcccacccctcagaatgtttactcattgactgcaaaagaagtttaccattaggtagggaagacagatatgtatgtaaataacaataaagaatacaactgttcttctcaaggtaatcactgacttgtcactagccaaatccaatgagcatgtttgcaacaagtgtttcataccattggctaatactgtcttctttaatgtctttctccacctttagaagacacgagctcccttgatttctattatgctgctgtttatgtctttgttcttc

SEQ ID NO: 172861 - DNA, 254 bp, Homo sapiens
agttggtaaatgatgaccttaaaataattttgataattgtatatgagaaaatatgacaacagcatgaaaaagatggccaatgtcaacagaaaattgaaatctataaaactaatctagagtgcattctagacatgcaaattaaaatttctaaaactaattatcggggaacctgcccccgataatcacgtaggttcttttctattttccctaagcattggccggtttgagaaataaagggacagagtacaaaagag

SEQ ID NO: 172862 - DNA, 653 bp, Homo sapiens
tgccttcctgctgctttccatcttgccagagtcagcttccctccctttgcagactcctatgttcaagaaatcattgcttctcaatgttacttcccactggaattacctgagaaagttttcacagttccagtgcctgggttccatgcccagaatttctttttttttctttttctttctttctttctttttttttttttggagatggagtctcgctctgtctcccaggcgtggagtgcagtggcgtgatcttggcccactgcaagctccacctcccgggttccatgccattctccgtgcctcagcctcctgagtagctgggactacaggcgcccgccaccacgcccgggtaatttttaatatttttagtagagacggggtttcaccatgccggccaggctggtttccaactcctgacctcaagtgatctgcccacctcggcctcccaaagtctggggattacaggcttgagccaccgaacccggcccagaatttctgatttaatggtccggggattttggaggctcccggggggatgctcaggtacacccagggctgagaaccagagttcagagagctgcagaggttttctctgcccggtttgccctgaccaggattcccaagtgtggagtgccttgcacctgcccaattcccta

SEQ ID NO: 172863 - DNA, 348 bp, Homo sapiens
aaaattgcatcatagcacagaaatgaagaaagagttatacagccaagattcacaggggaaaaagaaatcattcccactgccactccaatacaatgcaacttaaagtcatgccataaagttatacaccaaaaggtttatagttttttggctttggttttttgttttttgttttttttcagcaggaggagattatagaggacctttattttctacattatatgtttttataaggtttgaaatttttataatcatccagtattacttttatcatctaaagagacaataaagattttttaaaacatgtcataatgggtatcagaaattttcctgcttggaattttatttttt

SEQ ID NO: 172864 - DNA, 573 bp, Homo sapiens
caatttgggtttttctgatgtatcctcataatttgatttgggttattcactttccacagaaataccacgtaagtgatgttgtgaccttttcaggtgcattctatcaggaagcacatgaaaacctgtttgtcccatttactggtgacattaacttttatcacttacctaaggtagtatctaccagctttttctactataaagctgttattaccccctttataatgaatacatttcttgtgagagaaacattgagactatgtaaatatcttatttcctcatcaaactttcacccattattttagcatctactggtatttcttgcctgaaacaatttttactgtgatggctgccaaatggtgatatctaactttcatcattctttcaacatgtattagtttatattctgccttaggggggtttaatctcacttctttccttcctttccttgtttgtttatctgcatgggctcatggattcttatgtcgttctatgggttataatctgtttctatcattatttattttaatgccaaaaaattataatcttgagattatgtcagtaaatacttttttt

SEQ ID NO: 172865 - DNA, 572 bp, Homo sapiens
ctccttcctcagccccccaagtagctgggattacaggcatgcgcccacacgcctggcctttgaagtttattgaatcattatttcaattaagattcagattctaaaacttatctatgtacattttgcttatcttaaggaatagcaacatgtaatggttgaggttttttctctctaaaataagtaaaacaatttacatggactttaaaatggatttacaaactatagatttgcctaaagaactttttttacaattctgatcaaagaacagaaattttgatggaatagacaggcttaaaaaaaagttggtcactccacatgtaatacataacctgtgacagcatcatagattgtgattataaaaaatgtgtatcacttacaattataaatgtagacatgacaataagttacttaacaaggaaaacagtatcagcctgggcaacaagagtaaatttccgtctcaccaaaaccaaaaataagaaaaaaaaatgtgcaaagaatatttataaaaacaaaccctggtcaattgggggaaatatttccagcaagtattatagaattaacgtatttcttca

SEQ ID NO: 172866 - DNA, 496 bp, Homo sapiens
ccaatatcctgccactgcactccagcctgggtgacagcacaagactctgtctcaaaaagaaaataaaaataataaaaaataaaaattcttctatctgtatgcctaagtgtatgcatactaacaaaataagtatagttactgcttattgagcagctactaaatgtgaggcagtgtgccaggtacattctgtaagtggtaagatggtgctcctctccacgttggctgagcacggggcgctggagatgatggcgtgagtgggtgccggctgggggccggcccacaggctgtctctttccttctgttcgtatatgaggtggtttgtccccaaaactattctgttttctttcagctgctgtaagccagtttcttgtgtttttttttttcaaataataacacttacatttgaatactgtaagctagatatgtattatgctgtaatatgataaactaagtctttattaagatataggttattcacacctgtaatccttattca

SEQ ID NO: 172867 - DNA, 403 bp, Homo sapiens
gggcaagagattagactagtatcagatttttcaaaagcaacctacagatcaaggcaaccatggaacaaaattttcaagacacttcagaaagtatagaccaagggttttatgtcttgccaaattgtacctcaagtgtcaaggctatcaaaaataattttgaacatagaaaaactaagttaatactgtatgtgtgtgcccttacctgagaaatttatatactagggtagaggtttgcagatgttttttggtaagggttcagatagtaaatagtttaggctttgtatcctactaaattctgttgactctgttgtcactactcagttcttccattgaaactgtatacaaacagtataaattgcataaaagggtgaatgtggctatgtccaataaaacctgatttaca

SEQ ID NO: 172868 - DNA, 124 bp, Homo sapiens
aaaaaaaaaaacaaaaaacaacaaacaaaaaaagaaaatgaaacgggacttgtactcagcgactcctgctctcttctgcttatttcctgtgtggtccccaagccctgctgagccctcctcttcc

SEQ ID NO: 172869 - DNA, 394 bp, Homo sapiens
agaggaaggcgaggcccctccctggaaagtcagagggggccccaggccattctcagctggggcttaaagggaagcaaagaggggatgagaagatgtgactgcagccaggatttggttgaggaatggtgggagaaagaactggaaaggtagattaggttggtggtggggagggctgcactgggaataaaatccaggggcctcaccatccagcaggctccccatggtcccaccctactgtgtgtcccagcccctgcctgctggagactcttactggcttcttctcctccgcaggcgaagcccgttctcccctcagggcctttgcacttatcccttagcctggaagggtctttctctggctctgcctggcaggatccttctcgttctcatctcagcc

SEQ ID NO: 172870 - DNA, 398 bp, Homo sapiens
  misc_feature (13)..(14): n is a, c, g, or t
gactagaggatcnnatgtatcgcccaacactacttctttagttctgaagcactgtaaagtatattttagattaataatttccaaaccaagaaaatgaaagcctatattaattataagaccccaaacagaaaaaatcttgtaaaacgatcaagaccataaaattcacataccttctatttggtcaatgcagagacacagatctttgttccggagtttgaatttaaatgcaaagcttcagagcctgaaaatgtctaaaattagacccatgactgacaactggcctaggctcaatgtctttggaatgtgctctactaaatttgctaccatttgactgtgttccctccaaaattcaggtgttggggataacatcacgggatcctctaggtcagccctcgaca

SEQ ID NO: 172871 - DNA, 262 bp, Homo sapiens
cttctgaaagaatggtagctgttgtattttggtaacatgaccagtagaggtcatagatgagttctttaattatcttggagctacaactattgtgtctgtttatacaaggatctattcattctagatgtcttggtgatcagtgtggattaccgcacaaacaatttggcggtagtgattagcgtcgatcatgaaaactgcacattaatgatgcctcagattggcttccccttcatatatgacctagtcttgggagccaagctga

SEQ ID NO: 172872 - DNA, 427 bp, Homo sapiens
ccagctgagcaaggatttggggcaggatatggattcaagagattttatgtgcccatgaaggaaggcttgaagggctcatggtcatttctggtaggctgataggcactcaatgtggttatcgttgaccctatcttcaactctcttagtaaaccagtaatttaaaaagaaaaaggaaggtttaatttcccatttcaatttaaaataaatttacccagtttccttatttttatttacatctgacatgaaaatctttattgttatttctgattagaaaatcaatagtttagctgggtgcagtggcacgcacctgtagtcgcagctagttgggaggccagagggtcacttgtgcccaagaagtcgaagctgtagtaagccgtgatcatgccattgcactccaacctaggtgacagcatgagaccctgtctca

SEQ ID NO: 172873 - DNA, 242 bp, Homo sapiens
agagacctcactttgtatcttgacacaaattctccaccaaaaataagttaaaatttgaggcttctttgaacttgggtcagaattaaaggaactgggcacactatatatatcttgtttccatggagaacgttattggtaaagaaaagttcacatctctcagatctttagaaatgttttcatgaaagagcaaagttacaatgtgtattttaacaggtgaggccaatacagtgtgcactggatta

SEQ ID NO: 172874 - DNA, 307 bp, Homo sapiens
agggctctcagtctagctagtaaaactgtgctattaatgaaggattataatagaatataataattgttatcacaggagtctatgaaaagatctaacagggcaaaatgcaaaagtagggagatgtaggttagggcaagctgtctaggggtgaaatttgaagactgaagaagaggactggggagtgctgtctaggcagaaggaatagcctccgctaatcatgggtataacaaggaaaaagataataacaaaagtcatgggcatgtgacgagtgaacgtggtaaatgtggtcgttatctagacggtagcc

SEQ ID NO: 172875 - DNA, 813 bp, Homo sapiens
agtgtctctactaaaaatacaaaaattagccgggtgtggtggggcagcacctgtaatctcagctactcaggaggctggggcaggagaatcgcctgaacccgggaggtggaggttgcggtgagccaagattgcgccactgcactccagcctgggtgacagagtgacactctgtctcaaaaaaaaaaaaaaagttaataggatcacaggttatctatgaaagacatgtcctttgatttctacctcatgctgtacacaaaaagttagaggcaaaccatggataaaaatgtcagcactataactacaaaatttctagaagaaaacagaaaatatcttaccatcttggcatagccaatgattcattagacgagagtcataaggaattaaccataaaagaaaaaattgataaaatagaaactcatcaaaagacaacattaacaggctagaagaaaatattcactatatatatatatggcaaagaacttgtattcagaacataaataactcctacatgcacagatgtatgtaagttttgtctcaaaaaaaccctagaaacactgagcttgagttaatgatgtgcatgctgcaatatttcagaaagaaatatactgatgtctgcaacttactgcatcaaaaatacaataaactgatggctggatgggggatgaacaaatatgtgatataaaatatttaaaaaaacaaaacaaaaacaaaactttctcaatttttaaaatggccaaaatatttgaaaaggcacttcacaaaggtagatatggaaatggccaaaaaggaagaagttcttcaacattatgtcat

SEQ ID NO: 172876 - DNA, 420 bp, Homo sapiens
gctatggtttattgagcttcactgtagaatgcatgggcggaaacctggtcatttcattgtgcaactcctaaatgtccgatttgtagggacttcctctgaggctatttcagtttctccagaaaatattccagaatcccacctggggtatattcatttggaagccagcattctgacagctaagcaagggaggggagctgaaaataagaggatatattgaaaatcattatgaggagcaattagatccccagatccctcccccaacttcaagcatcaaggtcactacccttcattccatagaagactggagatattaaactagaggagctcttgactcaggagcaccagacacagagcgtaggtgagatgccctagtgaaaaaagattgtcaatgtctatctgctaaatgttgacatttatttt

SEQ ID NO: 172877 - DNA, 469 bp, Homo sapiens
gggccaccttctctctcacaatcgcacctagtaaatgcgggcatatttagctctcacatcgacaacccccgtcaaattagatgctattacgaaggttccaatttttcttaggaaaacacgaaacagattgtctctgaaagaaggaaaaaatgaaaagtgtccatccagttataatggaatggcctcgatttacatccttgggtcgatttctcttagctgcccgcccaccctttgcagcttctgccaagcttctcaaagcaagggctctcaggctgacacgcaaggagcagggtgtggggaagggggatctgcggttgagaaaatgtgtctggtggcctctcagtggcgtacataaaaaccaggatgcccctcggtcccaacgcccttcctttcgcctgttagcctagaacccctgaaggacacgaagcctgactgggttgcgcccgaggtcagcgctgagtcgcggccg

SEQ ID NO: 172878 - DNA, 304 bp, Homo sapiens
cagacggttcttaccaaggaactgtctgtccccaccacatggatggttttcctggcagaggtgtgccctgtgagggggtcactgctcctggggttggcatcgtgaggctgagcctgcaggctgcacaagtatgttccactgagaggctgccctggtgactccattactcacgcatccctgccacacagtgcagctgggccgtggccccagcacagggttcatttacatagctgcacaacaggaagcagtctagtgtttagagctgccctggcccactgagagcaaattgtttcaggtgctgtgg

SEQ ID NO: 172879 - DNA, 498 bp, Homo sapiens
tgctgttcttgctctccttttccactgggctaacttctctccatttttcaaatctcagctcccacattacctgcagaaagctttccctgccacccccaggcttcctggtcatccccatgtctccctctgggctcctgcagcacctggctattttctgggtggcagttatcaccacaggcattgtgtctgccatggtgcccaatgtgcccacagtactcagcccagggcctggcataagctggaaagcacttgctggatgaaagagtgaagaacatgggcctatttccaactgtcacagaaaacacctgccccgcaggtgctggcagggccagaaaatcaactgtgactcctctgctgttgcacaaattcagcagccagtccagggggtcatgtcccagaagggtaagctcggggtggcactcctctctcatccctgtatgtcagggccacccccacagcaagtccctctgagctactctcatgtcacacagccctggc

SEQ ID NO: 172880 - DNA, 244 bp, Homo sapiens
gagaatatgagtagccaataatgctgtcacagcctgggaaagagacggcaaaggggaagaggcagccgcttgagaccacggagccacagccgcccattcccagcagagctcggagaccacagtgacacacctgcccattcccagcagagcttggtgccattctcaggtctcccaagctgaccccaggtgtccgtgcttttatgggttaataccaccagggtattgaagtagattttgacaatca

SEQ ID NO: 172881 - DNA, 673 bp, Homo sapiens
gagaagattagcatggcccctgcgcaaaggatgacacgcaaattcgtgaagcgatccatattgttttgctttccacacatcttcggtgcggtgcccgttcacgctttcctccacaatggtcccacgcagctccagttttgtgaaccactcggctccgtgtaactggtcaaacagttccggaatcatctgtatgtagtcctgtctgttggtcagcatgtcctgcaggtcccagtattcctcctgtagcctggctctttcttgcatcctggcacccacaggttcccaaggcgcggtggagggacactcgtaaaaggtctcgctgtgatcactgtctccagcctgctgaagctcagagggctctgattcagaaagatcatcggatccgtctgagcttggctggtcggaagtctcatcatctgcttccttcgggttaaacacgtcggccaggtctgagtatgggtgtggcagtccgggtagcaggctcatgccgtgcctctctagggcaatgcatggcgggggcgggcggaagcagttcttcaggcagtagggagagtggaaggtgcagcggcctttgatccagtcgacttcgggggcgtggactcggagccagcggatgcctaggaccacagagaagttcggtgaaggtacgatgtcaaattcgatggactcctgg

SEQ ID NO: 172882 - DNA, 500 bp, Homo sapiens
gctacatgatcatcgtcatgactttatcagctgatagatatccagctgttggcagtgtgccaaattctgggccaagtttgctataaaaacgatgccactgaaccctaacaatgccctaagagataaacattattaccatcctgttttataaatgaggagctggggctcacagctgtccagcgactcccagcacccaaggctagcaagctacagctctgggctgccagacactaaagccaagcccacatcactgcactgggttgcagtgttctattccacacgccagaattctagattgtttgagtttgttacaaacacacgtatctttgtaactagaaaataaagatttaaggccggacgcagtggctcaagcctgtaatcccagcactttgggaggctgagtcaggagaatcgcttgaacccacgaggcggaggttgcagtgagccgagatcgcaccattgcagtctagcctgggcaaaaagagtgaaagtgtgtctcc

SEQ ID NO: 172883 - DNA, 499 bp, Homo sapiens
gctacatgatcatcagcagcagtagcatcattatcgggattatcagtattgcagatcccacagccagaggtgcccaagacgtctacaccaggggctacaaacaccaatgccaacagaagccatgcaaggaaagtgactgagtgaagctggccaggagtagtacaaaagggaagggtggggactgtggcaaactggagagcagacatccatctaaagggtaagctgtgactgtgttccaatcaaatgtcgccaggcaaaagtacagccggatttctgtttccctacagaaattggaaagccatatttttgcaaaaaaaagtcctacttttaaaaccctgtgctacttaattctaatatgttcatggtaaggcaaagaaactagaatagccaaaacaattctgtaaaagaacagtgttggaggattcacattatccagttttaagaattattatggccaggcacagtggctcatgcctgtaatcccagcactttgggagga

SEQ ID NO: 172884 - DNA, 459 bp, Homo sapiens
cgtttctgacagtgataagtactgtgaaaagtataaacgcagttacatgaattagagaatgacagggttttacagccgactcacttttcttagattttgaatggctaaaattttggacaatgctatggaggttaagcaaactccgtcaagctagtttacagtcttctgcaaggcgaactttagcggggattttgtactggagtgaattccttttcacagattttctcttagcaccttgtgttattgcagtaacagaaatgtcttcctctgatgttgttggtagagcgcaccagacggtgaggaatgcttttcaaagctcagccgctgtgtcctagtcagaaatatgttgtgttgctgttatttttgtggtgtatgagaatttatttctagtttccatagataacggaaagcaatgacaagtcaggaagtaaacaaaaaattaaaagcattataaaagta

SEQ ID NO: 172885 - DNA, 223 bp, Homo sapiens
aaggattgcaggtgatttttattttattctttttgcttacgtcaattttctaattttatttcagataagcacatattatttgtgtaatagtaaagccgtgttattaaagagaagaattacccaaagagactcagttatgggagtcctggcctccgccgctctggtctctgcagctgctccaatgagcgggacataggaaagatacagcctcggccatactgaa

SEQ ID NO: 172886 - DNA, 528 bp, Homo sapiens
agaaaaagacagtaaggaaaataaattatacatatttattttgcagaatctaagatgtcactgattattagatatatctatttcagaaatgctaaaatgtgaaaaatatatatgccaagagtcaataaacatggcaataagttagaccagtggtaggatctgaggggaaaataaagtagtaaggaaggaggacaggcagagttgggcgggtttgagtaaaagcctgaggggagtgacagaatgaattaagtagatctctaggagaagaacagagggaaaaggcaaagactagatggagagcagccactgctttaacacacagaatgctttcataaagacaacatggattccactcagagaaacctccttcaaccactacatttacagctacccttcgtctcctttcaaatatgaggaaaataatttactgagaaataatgtatcttgattttctaatcagaaggtaggccaaggatgattcaactatatagaaggaaaaaactcaagaaaacacactgctatatctaa

SEQ ID NO: 172887 - DNA, 674 bp, Homo sapiens
tacttctgcctgaacctgcccctcctggaccttcctactcccaatcaggcaaaaggtacccctgagtcatatttaactcctcccttccactaccctctcactatctaggacatgtctctccagttggccccatagtcatagccctagcccaggcctctacgttgctcttctgaacaactgtatcagcctcttccacggtctttctgcttccagtgtctcccctcattccaggacatcttctacaatgcagaaactgtaagttttgcaagttcccaccactgctaaccacttgagtcctggatcaatgtgtcccttccaccagcccttccaccagcctcccttcaccgctggtgtcttccatgatcatgctgctgagcctggtgggcagcgacccctgaggcacagaagaacaagagcaaagaccatgaagccagagtctccaggactcctcactcaaactcggacatggacgcaggttgggtgtgaggggggtcccagcctttcggtcttctatttccctatttccagtgctttccagccgggtttctgacccagagggttggaacggcctggaatcctcttcccaacttcctccaggtcatttcccagtgtgagcaacatgccaaccttagtgtttctccagccagacagatgcctcagaatgaagggcttgg

SEQ ID NO: 172888 - DNA, 226 bp, Homo sapiens
ttgtgaacattcacctctggctaacaggagtccaaaagtcagtaatttgttatgggatggaaattgcattaggctaaaagaactggtcaagaaaacatttttaactatagatatacgtacatacagagccctctgctggtgattacaattattaccatttgggactacaatttcccataaaccataatttcacttatcctgttacacttattaattatcctaaaag

SEQ ID NO: 172889 - DNA, 688 bp, Homo sapiens
atgtcattgttctggtcctgttataggtgcaaaataaatacttattaaagaaataaatgaatgtcttttctgaatgattccaagtgtgtgcatggcgatactggtatattttattatgtttataaagtgatatgtagttttacagaattctgtgctataaaagtaataatgttttgcacagcctatgcactgttgatattcttgatgttcataattagggtatatcctttgcttttataatagtgctgatgaatcagtttagatgagttctggtatttttgaataattcctcttgtaaccagtggcttgcatttgcaagatagtaaccatggttaggttatttggtctacccatggaaaagagaaaaggaaattgtttccagatattgtggaaataggggagtccttaatgatcattttcttcaatcttctcattttacagaagactatccgagggaggttctgttcaaggttatgcaggaaagcttagaggacagattttattaccgtaaacgtagcaacagagttaaaatacatcaaggatcctgggaaataaaacctttatgatagctaagtttcttttatttatggcaatgccagacatagagagcatgaatggtatagcttaaaaagtctggtatcatctagctacaatgaacccagccaattgtgtagcactcacacctcgg

SEQ ID NO: 172890 - DNA, 232 bp, Homo sapiens
gtttaaacctaggcaatctactaatagaaattgtgagttaatgttcaactttaaaaacattttcctaaatgccaatgctgatatcttatttgaggtgaggacataggagaggtgaacaacagacttaaaatttctacttttctttttcattctttctttttaaataaaaatactgcaatccctacttttgattgttttatagctcaattgataaggtgtgttcctctttttt

SEQ ID NO: 172891 - DNA, 255 bp, Homo sapiens
ggaatgatactaaatgcagcctgctgcagccgcacccacactaaacatggaggagggctacgaagagtagcagggccctgcatgaagggtgacacgtaaatttaaaaaacaatttcggccgggcgcggtggctcacgcctgttatcccagcactttgggaggcagaggtgggcggattatttgaggtcaggagttcaaaaccagcctggccaacatggtgaaacctcgtgtctactaaaaagaaaaatccaaaaa

SEQ ID NO: 172892 - DNA, 272 bp, Homo sapiens
atatgggaccctgaaggacacagatgaagtttagtttggattccaagtgcgataggagagccagggaggcagtttaattagggtggtgaccgattcagtttatatggtaaaacatctcactctctctctctctctctgagcatggattaggggtgggtgtgtaaacttagaagttgggagcagttgagaagctaatggtcctggtgacagataatggcagtttaaggttgggtaccagaatggatatgggagggaagtggatggactctgga

SEQ ID NO: 172893 - DNA, 770 bp, Homo sapiens
taaaccatttcaagagagtctctggatttcttgatccttgatttgtggttttcatgttgtctgtgagctccagcagggcctcatcagccctgtccgtggtgctgctccagctctgtgctccccgataggtggccctgcgctctatgcacatccttcttaacataggaaagatgtatgcctttcaaagaaaggcattcaagacagatcagcaccaagtggaggctctacccacagatgttaatgtgcattaagaaacagcgttactgagaaatctgagccatcattccagagtctctctcctggggagaagtttgtttttactgctgggtttttttgtttggttttaattcagaatttggaactagaattatttgtaataaacctatcaaagcctagcctaagggctgccatctctgtctaaattctagttgtttatacagtataaaaaagacatttctaaagctctcaaagctgatcctcctcaatagtaagggactgtgtgaaagtttgtttatgctggcttagcaaccttcttttttcccccagctacagtgaaaaagcaaacttttggccagacttttagactataaatagagttatcatgtctcagtcaatgagggttaaaatgttctttttaaaaaaagaaaactttggaaattccaagaaggggcagtcacttttaatcattttgtaatcttggagactgctgtctacgggatggaagagatgttagcagaagggagggggcaaactgtgcagaaacagcttca

SEQ ID NO: 172894 - DNA, 270 bp, Homo sapiens
aaggtcgttatcgtgcttgcactcgggactgagttcacattgccttctacctgccagagaagctctgagctcctggaggaatgttccttttcttctgatgaaaaatgacgaggtgaacccctcgtgcctcggcgtaatgtggtcatcagaggtcgtgagaagagcacagaaatgcgtgtttctcataatcgcctggatgctaatcactgcgtcaaaacctcccgtgagccgctttctccacagaatggaggtggccgggcgcggtggctc

SEQ ID NO: 172895 - DNA, 325 bp, Homo sapiens
tcaagggaggctcttggtgtctcaccctgactcagatttgtggaggacaggaggctgggccaatgacagaactctgaccaatgagggaactgctccattttgcccccaaactttcgggttgtaattatacccctacttaactcatgacaccaactcttccccaccaatatgtttggagagacatatttaattttaaaagatgccaggttaaaaggaggttggaaaattttttttctggaaattcaccaatgtccttttaaaaatcagagatatgatagaatgtcacaatactagggatgagaacgaatgttttaagaagaggtag

SEQ ID NO: 172896 - DNA, 511 bp, Homo sapiens
ataaataaagatggcatagccattaaagttgtagtttttagatactagagcaggagcatcattcattttatgaccccatctccacccatgggaagctgatgagttttgtgtattgaattcgaagagcagagaatgggggaaaaggagattcccccattgaaaacctagataatgagagaggcggaaccaaaagcagactcagaacttcactgagaataatgggggtgtagtagtcaggtgagagagactggactaccaaatcatcgttgctatccagttattccagatgaaagatactactttacatttcttagggcatcatttttaagtgttggctttcagattaaatactagttgagagtggtgggaagacccagaaggaatacttaaactataataaatatgtactttgtgtatccattataaatatgtctaacatccctgatagctttaccctaagctttcttgtttaatggttaattttagtgtcacaaataaagtttgtgttaat

SEQ ID NO: 172897 - DNA, 168 bp, Homo sapiens
ctggtgggagaattattcacctttacatcaagaaggttgggaaaacacctgaacctgcatgtggcatgtgcctagccagacttcgaggagttcgtgctatgagacctgaagttcttgtgaggttccctaaaacagaaacacatgtcagcagggcctgtggtggttccg

SEQ ID NO: 172898 - DNA, 117 bp, Homo sapiens
tgctgagattacaggtgtgagccaccacgcccagccgagaaccttaatttctttcaagatccctgactcaataatcctactcctggaaatcctaataaaatgccattattcaaactc

SEQ ID NO: 172899 - DNA, 482 bp, Homo sapiens
cctcatggcacagagccaccactgccttcctgatgccagaggttgatcacatgatgggggcaggaggccgtcgagcaggaaaggggtgctgtctaaagacaggtgtggccagtgcaggggagagccagcatttcttcttggcgtgtgtagggggaggttaaagtcttagtggttgatttaaaaaattttagaaatgaaagtaaatattgaagttagtcattttatgaggctaggcttactgggatatgtttctggataattctaatttgtaagaaactcttgtgtttaatattaatcactgtcattcagaggaatcgaaacagtaacatgtcttgtttccttatactgcctttgaacacaaagtgaagccttgtttcaaaacttgcagacaacaggccatttaaacaaagactacacattttaagttgaaatttaggggaggattatttaacattcttactaataactctttggttacaatg

SEQ ID NO: 172900 - DNA, 414 bp, Homo sapiens
ttcccttccaccgcatcatccaggtggaacgtcacatggtattcacataggatataagtctagtttgcccccaagaagtaacaggcttatttgcacttaatttatttttaagtgtgctgtctttggaagactcataggccttttctagtagaatcttacctagcatcagccctcataaatttgctgatgtaattttaagttatactttctagctgctggagcacgcatgagcgagtgtctatcctatttcctcaaagttgctcaacttgcttaagaaatacataactgcatattggacatcagaagtgcttggttctagctgggggaaaaggatggttaattcccccctaaagcatcattgttttgcaatcgagtgaatcggatggattctccttcccttggatacttggcctg

SEQ ID NO: 172901 - DNA, 374 bp, Homo sapiens
aggaaatgtttttagggaattgggctaattgatagcaatgcagtgataggatcttaaaataacagtgacaaggtcgtagtgtttaactgtcagataaatggcaaggtcaaagtggcagtcaggaggagttacttgaggagatcagtggagttggttaatagaaaataatattcttaagggcaagatagatgggcagctaacaaggctatatcttgaacaatataatggaaagaaattattaaaaaacggttgattaagaggcaaagtgcaactacacaaattaaaaaagcgttatcccttgactagtttctgatcctgagccagtgcttaggcctagaacccattgatcaaaaaaagaggttgaatgtacagga

SEQ ID NO: 172902 - DNA, 534 bp, Homo sapiens
gttaacaatggcattgacctcagcaacttacaattcagaataaatatataggaaatgtatatgccacagaatttaagaaatgatgatttttgaccttgagactgagttttgtctgtttctaaaatgttggtaagtcattatgcttttccttcctgcctacccaccccatggctcaccaccaatttaaaatatctattctcatacactgtcctcatgtcacatctgattgtctctggagaaaagacctctggttttagatgtgaggacactgtgttttataatctccagggacttatcagagataagagctttttaacctacatctaagaaatagatgtgctgcatattcaccaacatcagagcaaccgattcctcaagaggttcgagatctcagtagttggcactattgctgtttatagccgtctatttcaggtttaactagaccactcctgaaaatgttccaaggtccagtcatgaaattaatcactaacataatagtgattattttcactattaacaggattaacataatag

SEQ ID NO: 172903 - DNA, 546 bp, Homo sapiens
taccgcgtgaactgctctccacctctgcaattttaaaattcaatggcctactttttgaacataacctcctaacataccaactttcaactcatcaaggcctactatacccgagcacccactgactcagagtcaactcccttcgtggcttaattttctgtcaagcctcacaggaaaagctattacttcagtttttaatctttctacctgactctgtctcctttttcttccattacacttgctgaattccaaccctgtaccaatccaagtaataaaagtagaacactgaacacactaatgaaaatccacacaaccatacaagctgcaatcattgtcagtaatttacttcaagcacaaatagccttcaaagatgtcccaaaatctgtgcatcagtactccactccaatgcccacatgtcccattagcaacccagattttctcaacttctccttaagatccttaacccacctcctactccttctctactaatcggaatcctttcattaacttctgcatccatttttgtgagggaagaaggaattgtttttg

SEQ ID NO: 172904 - DNA, 172 bp, Homo sapiens
taccgcgtgaactgctctccacctctgcaattttaaaattcaatggcctactttttgaacataacctcctaacataccaactttcaactcatcaaggcctactatacccgagcacccactgactcagagtcaactcccacaccaaaacagtactttattttgcaaattttgg

SEQ ID NO: 172905 - DNA, 798 bp, Homo sapiens
acctggcttctactagaggaggtacagaaaagccaccgagggctacagctcgggaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcagcaaccccataccaaagagagatctgttgtatcatttacacggtggagacagccactcagtgctctacactctccatcaccttacaaaccttccagccctcagggaggaagatgttctcaagctcttacagaaagtgccagccaaggacccccagcaagagcctgatgcagttgatgctccagtccctgagcacctgagccagtgtcagaacctgacactctaccagggcttctgtgccatgaagtatgccatctatgccctctgtgtaaactcacaccagcactcccagtgccaggactgcaaagacagcctctctgaggacctggcctcagctacagagccagcgaatgactc

SEQ ID NO: 172906 - DNA, 797 bp, Homo sapiens
aagttgcataggaaagatgtgaccggaaaagcactgagggggacagcctcgtgaaaagtctcaccggatcatctagatcctgagcgggcaatgctagccctgttctccaatcccaacccagccgaggcttggaaagtggcctatttctactgcctgagcaacaacaaacacttcctcgagcagattctggtaacagcactaacattgttgaaagaagaagacttcccaaatcttggctgcctacttgatagagaattcaggcccctcagttgcctgcttgtactcctgggctggacacactgccagagcctagagtcagccaagaggctgctccagaccctgcacaggacccagggcccaggctgtgatgagctcctcagggatgcctgtgatgggttgtgggctcacctggaggtcctggagtggtgcatacagcagagcagcaaccccataccaaagagagatctgttgtatcatttacacggtggagacagccactcagtgctctacactctccatcaccttacaaaccttccagccctcagggaggaagatgttctcaagctcttacagaaagtgccagccaaggacccccagcaagagcctgatgcagttgatgctccagtccctgagcacctgagccagtgtcagaacctgacactctaccagggcttctgtgccatgaagtatgccatctatgccctctgtgtaaactcacaccagcactcccagtgccaggactgcaaagacagcctctctgaggacctggcctcagctacagagccagcgaatgactc

SEQ ID NO: 172907 - DNA, 2242 bp, Homo sapiens
  misc_feature (1481)..(1481): n is a, c, g, or t
tttaaatgaaaaatcaagacacgcctaattaaacacagatattaaaagttttatttgacctttggctggttcctttttatggtcttaagtgctttagagaatttttaaacagattgtttatttaagctgttggcaaaagcatagtttcattagtaagttccattctgcaagtttagctactggatcccaaccattttcaggttgcgtattgcatattgttgattttcacatcttactctctcactgttcccttgtggaggaataaaagattttagaatagagtactgggaaatatcaaaatgtacacaccttgtatgcatatcactgtagctggcaagtgcaaaaaaagaagtagcatgaagtgtaaaaggagaagggaggtaattgaagtgttagatggtttgattgactgcaaatgggacaggaaaaaaaaggtagtcatcacctatttggagctaaatatgttgggaccacagaagccccctaaaatgtttcctggaagggacttggtacaattggctatgaaattgtactcaaaaccacttagtcagtactgcccagggaaatggaacctgtagctggctgccaacacacatacaatgtggtcatggcggggcggtagggaaggattatttacatttttttagttctggggaaaaatacactaatggaggaaacctggtttgaggacagctctttgatctatcttattgtagtagccatcttatgacaagagtaagaagttctggatctcaaagtggtgatccctgactttaggcagtttctgaaaaacttaagatcagtgagagaaagatgcaattggtcttattcattcagacatgaaataaggcaaatgagtgttagagggagagtgcccctaagtataggtctttattaggcagtcaaatgaagcaaactgtaggaagaaaaaaatgtggattgtattgtatgatttttataaataccaaaaatgtatacagattggaactacttgtatcttccattttcttgaccatgtcatttttaagttagtttattaagaacatctccatagtagcttatcggtagttttagcatgattacatgcaaaaacattcagttatctatgataaaacttgaatctttaaaaccaattcaacatgaacagaattatgttttgaagttgagaggatagtggctccaggttttgcctataggtgttttcttggaccacctttcaatggaagtgtaatttattactttttttccaaaggagagtcttaggtgccctcgtcttaatatctaaattatgtgcatcctacactagcaagaataggagtgctctacgctcttgctaaaggtaaattgtttgccagttctttcagaatcgtggttgagaaaatattcatggagtatggacattcagtccatttgtagtctgaatattaaaattgtgtcttttcatcacgctaaaatacctgcacaagttttttggagacagngtttcgctcttgttgcccaggctggagtacaatggcgtgatctcggctcactgcaacctccgcctcccaggttcaaccgattctcctgcctcagcctcccaagaagctgggattacaggcgcccaccaccatgcccggctaatttttgtatttttggaagagatggggtttcactgttggccaggctggtcttgaactcctgacctcaagtgatccacctgcttcatcctcccaaaatgctgggattacaggcgtgagccactgtgcctcgccccacacattttttttttgagcgttgcagatgtatcgtgccacactgtccttagatgctggtgatacggtgatatgtggtccttgtttttaagacctttataggaaagtggagagaagattaaacttgtgattacagtgcagcatgctagcctgccactgaggtggtattataaaagtgctgtggtgtgggcacgtggcccatgcctgtaatctcaacactttgggagactgaggcgggacgatcacttgagtccaggaattcaagaccagcctggccagcatagggagaccttgtctctaaaaaaattaaaaaattagtctggcgtggtggcacgcacttacggtccaggctatttgggaggctgaggtgggaatgaggtgggaaggtcacttgaatccaggagactgaggctgcagtgagttgtgatcgtgccgctgcactccagactgggcgacagagggaggccctgtctccccggccccgccgc

SEQ ID NO: 172908 - DNA, 1992 bp, Homo sapiens
  misc_feature (1481)..(1481): n is a, c, g, or t
tttaaatgaaaaatcaagacacgcctaattaaacacagatattaaaagttttatttgacctttggctggttcctttttatggtcttaagtgctttagagaatttttaaacagattgtttatttaagctgttggcaaaagcatagtttcattagtaagttccattctgcaagtttagctactggatcccaaccattttcaggttgcgtattgcatattgttgattttcacatcttactctctcactgttcccttgtggaggaataaaagattttagaatagagtactgggaaatatcaaaatgtacacaccttgtatgcatatcactgtagctggcaagtgcaaaaaaagaagtagcatgaagtgtaaaaggagaagggaggtaattgaagtgttagatggtttgattgactgcaaatgggacaggaaaaaaaaggtagtcatcacctatttggagctaaatatgttgggaccacagaagccccctaaaatgtttcctggaagggacttggtacaattggctatgaaattgtactcaaaaccacttagtcagtactgcccagggaaatggaacctgtagctggctgccaacacacatacaatgtggtcatggcggggcggtagggaaggattatttacatttttttagttctggggaaaaatacactaatggaggaaacctggtttgaggacagctctttgatctatcttattgtagtagccatcttatgacaagagtaagaagttctggatctcaaagtggtgatccctgactttaggcagtttctgaaaaacttaagatcagtgagagaaagatgcaattggtcttattcattcagacatgaaataaggcaaatgagtgttagagggagagtgcccctaagtataggtctttattaggcagtcaaatgaagcaaactgtaggaagaaaaaaatgtggattgtattgtatgatttttataaataccaaaaatgtatacagattggaactacttgtatcttccattttcttgaccatgtcatttttaagttagtttattaagaacatctccatagtagcttatcggtagttttagcatgattacatgcaaaaacattcagttatctatgataaaacttgaatctttaaaaccaattcaacatgaacagaattatgttttgaagttgagaggatagtggctccaggttttgcctataggtgttttcttggaccacctttcaatggaagtgtaatttattactttttttccaaaggagagtcttaggtgccctcgtcttaatatctaaattatgtgcatcctacactagcaagaataggagtgctctacgctcttgctaaaggtaaattgtttgccagttctttcagaatcgtggttgagaaaatattcatggagtatggacattcagtccatttgtagtctgaatattaaaattgtgtcttttcatcacgctaaaatacctgcacaagttttttggagacagngtttcgctcttgttgcccaggctggagtacaatggcgtgatctcggctcactgcaacctccgcctcccaggttcaaccgattctcctgcctcagcctcccaagaagctgggattacaggcgcccaccaccatgcccggctaatttttgtatttttggaagagatggggtttcactgttggccaggctggtcttgaactcctgacctcaagtgatccacctgcttcatcctcccaaaatgctgggattacaggcgtgagccactgtgcctcgccccacacattttttttttgagcgttgcagatgtatcgtgccacactgtccttagatgctggtgatacggtgatatgtggtccttgtttttaagacctttataggaaagtggagagaagattaaacttgtgattacagtgcagcatgctagcctgccactgaggtggtattataaaagaccatgaggacgagcacggcgcatacctgactctctacccttcggacccatctgggatcctc

SEQ ID NO: 172909 - DNA, 195 bp, Homo sapiens
acaagcccatcccccaacaccccaccaagattgcagaaatgctggttagttgatttctaatgtcagctgttctttcagtgagagatttgcagggaagaaaatcagatgttgttttgaagaagtgcttttgtttttttgaaagcaaaaactgagaatttattgtttcatgtattggaagtgttggggataacctga

SEQ ID NO: 172910 - DNA, 177 bp, Homo sapiens
tccagatacggtggaatgggaagtgttgaaaatgcttccaatgctgtggactgggagggttggtggatgaagatacctgcttatctctggattttgcaaatataaggttagtctagcagtctttgccaaactgtggcaacaatcaatagtatcacaaccagtgactaagaaatataa

SEQ ID NO: 172911 - DNA, 121 bp, Homo sapiens
tggtgtagtacacagaataaactggagtcaagctggttttgaatgctggttctttttactgctttttgagtctacaaagccagtctatcaagtgaggctaaaattggctaccttggaaatg

SEQ ID NO: 172912 - DNA, 810 bp, Homo sapiens
ggttagaaaacttgctaaagtcatggagcatgtatgttcatagagctggggttgaaaacatctttaaaaatgaccatttatcttcttcctcttggccctatctgacaaggttgtgaaaaacacatgaggaaatatatgcataagcactttgagatcttgtcaagtgctgttcaaagtattaatagtagtagcattattttccttcctgacatcccaatgataactagagtgaaatagtgtctaatttcttcagtaagcttcgggtctcacaggacacaaatgaaagattgggcagaacctgactgtctttttggtcactgcttagaattctattcaggtgtgagccctgagtgtgcagtgtccacctgctggagtcctgcacacagagtgtgcaggcatcctggacagcctgcccaaagaggagcaacaggaggcttccaggaagggaggtgtcaagaaccagctgctgagacctagtggctgattcctgtgaattgcatggataagccagatgcccttgtggtgctggcaaggaaatcttaagatcttaagaaggagaatgggagttgctgaaataacaaaccgaaacaaagacataaccatgtaaggtcaaaagcacagattaaaaaaaggtgaccacgttttagctcttggaaacaaaatgtttagagagaggcaaattgttggcagacagatttgctacggaagtctttttaaatagtgaaagccctgcaaatacagcataatcccagcatctgtgtgtatttggaatttaggcaattatagcctcaagaattcagaatccatttt

SEQ ID NO: 172913 - DNA, 761 bp, Homo sapiens
aaatgggagtttccctgcacaagctctctctctttgcctgccaccatccatgtaagatgtgacttgcttctccttgccttctgccatgattgtgaggactccccagccacgtggaactgatcagcagatctgttttcactacctcaaggtacacagccccaaacactgcccatccccagctccccatgcacatctttcctgttggagaaaccaggagagagatgagcatttctgttccagttccgaactccccagagagattctgatgggcccagcttaggtcaggggatagtcttcactcaagagttcctgagataacagagactggagtagcaggcattgcagaactgattttataaaggaagaacgtgtaccataaatattgctagttaagagcatgtatactgttgagttctacctcctcagaagtctaaaaggtttccttcctttgagggtgaagaagcagtaacaggcgtcctccatcagacccctctctgtgggcacctagaacacttcccattgacgtctgcttcaaggggaggtcactaaaagtgccccacatgatgcagcagacatttcgctggtcccagtgccctccccaagaccttccagatggtgaagtgttaagagtctaaaatggagtaaatgatctgcagaaattcagtggtgtcagaggagccagtccaaagtcactcggctctaaacgctgcgattctattattttaatgatgcccaggaacacaaagaggcacgacagaccc

SEQ ID NO: 172914 - DNA, 518 bp, Homo sapiens
cggcacgaggaaaatacaaaaatcagctggttgtggtgttaccctcctgtggtgttaccctcagcctcccaaagtgctaggattgcaggtgtgagccacagcaccctgcctaaccatacagtttgaaataagtagggcagtgtattattagggaatgcaaaagacaggaaacccacatttgcctgtgccaaaggaaaaacgaagggatatttgtagtgcacatgactgaaaggagcagacgctagcttccagggcagcgggaccgggtgtgaacagccttccctgggcttccgctctgtctctggctcctgtgctggctctctacatttacattcttgagcactctaggtttacatcttacccttcagcagcaccgggaagagagagatgatctatcttttctttttctttttttttttttttctgacacagagtctcactctgtcacccaggctgattgcagtgagccaagattgcgccacttactccggcctgggtgacagcgagactccgtctca

SEQ ID NO: 172915 - DNA, 447 bp, Homo sapiens
agctaaggctgcagcttcatctcccatggaaacctgggctcactaggaggggcaaggcctccagaccactgtcttaccatagaagccgcctagcaaactgcaaaccaagcagaaaatgcaggctgggctgaggaggcctctaactgatcaccagccaagcagagaaggggtgagtggcatgtgaatgactgctagctctaggcctggaccatggattcaaaccctgctggctggccctccaccatctcctgctccagtgaagactgtggcatccattagtgaggctagagtacacgcttctgactgtggaatccttctcattttctggctctgccatccactagctgtgtaactttgggcaagtgtggcctgacagccgaaagcttacccccactccttgctagctatatagctgagggcaagccatagaacttctccgagcctctg

SEQ ID NO: 172916 - DNA, 310 bp, Homo sapiens
taataattccttttattgaatctgcatcttcaagctctgttagttataatgcactgttattattctagagcccttgtgatgtgatggtaaggcattttgtgatggaagggaaagtgctctataatcctgtaaattaaattttagtcttttaggggtctgcatttctgagctatggccttcatatgtgtttcttagcttttatctttcccctcataaggaagacaggaaaactagagcagaatttgactgattgccttttccccagatagattaggtttggttctggttgttgtttcccttggagagcagt

SEQ ID NO: 172917 - DNA, 347 bp, Homo sapiens
attgcgccactgcactccagtttggatgacagagcgagaccctgtcaaagcaaaaactacaaaaaattgagctctgtgttaatgtccaacactctgccctgcccacccctggttcctgatgtaaggcccatggggcctcccttccctcccctggactctggctgggtggttttgaagaattttctgttatcggaaaagcaatgactattaggatgctctttaactgttctgtaataagcaattctaaacttgaggaagctcctccctgcttccatctgtaacctaggtctttctacattgttttttatttttcgggagtgctggtgcacacaaggatggtttttgtt

SEQ ID NO: 172918 - DNA, 967 bp, Homo sapiens
aaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttgaataaaagcagtaagacattttattaccagaatgtcttaggtgtattttgtaaattttaagtctttaagtattcatatcataagtattattccatatagctaaacactttcttctatactttgagttgtcccacttggggatacacaaagatagtttactgataaaactatggtaaatgaacactgaagtgtaataatggccattctcttacaacatgagaatgtaaatgatgtattttctcaacccatctgtagggaagttcatagcatactgttattactatggactatacattttaacaatgtacaaccctaaaatacctgaagggttttgaggggcttaaaactcaacctcgaggttatgtctcagaacataatggggagactggtttttatttgacattacattttgttcagagaacttttttctcttcagtgaacaaaccgtatgccttcagcctgaatgtcagttcccaatttctgttgtgccctgtctgtacaatcattttaatttttagaagatgc

SEQ ID NO: 172919 - DNA, 961 bp, Homo sapiens
attttatattttccaaaatgatgaaatttcttcccatttcaaaatagtatttgttgtcgagatttacctgaatattcaaaagccacggttatgagtaaagatgaagtgtcattttcatttacctttaaaggaggtcttctagtcacatggctcattaacaaatagtaatgtacttttcttactcaatgtgatttatagttacaagaatgtttctcccttcttgtgacaggtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttgaataaaagcagtaagacattttattaccagaatgtcttaggtgtattttgtaaattttaagtctttaagtattcatatcataagtattattccatatagctaaacactttcttctatactttgagttgtcccacttggggatacacaaagatagtttactgataaaactatggtaaatgaacactgaagtgtaataatggccattctcttacaacatgagaatgtaaatgatgtattttctcaacccatctgtagggaagttcatagcatactgttattactatggactatacattttaacaatgtacaaccctaaaatacctgaagggttttgaggggcttaaaactcaacctcgaggttatgtctcagaacataatggggagactggtttttatttgacattacattttgttcagagaacttttttctcttcagtgaacaaaccgtatgccttcagcctgaatgtcagttcccaatttctgttgtgccctgtctgtacaatcattttaatttttagaagatgc

SEQ ID NO: 172920 - DNA, 1074 bp, Homo sapiens
aaatagcaacatagagtttcttttggagcaagaaaaaatgcttaaagctaactgtgtgagagaagaagagaaagcagcagaattgcaattaaagtccaagctctttagctttggagaatttaattcagatgctcaggaaatactgatagactcacttagtaaaaagattactcaagtatacaaagtctgcattggagatgctgaggatgacggcctcaacccaattcaaaagctggtaaaagtagaatctcgcctggtagaactgtgtgacctcatcgaatccattcccaaagaaaatgtggaggcaattgagaggatgaaacagaaagaatggcggcaaaagtttcgtgatgagaaaatgaaagaaaaacaaagacaccaacaggaaaggctaaaagctgctctggaaaaagcagtagcacaaccaaagaaaaagttgggaagacgacttgtctttcattcaaaacctccatctggtaacaaacagcagctacctttagtcaatgaaacaaaaacaaaatcacaagaggaagaatatttttttacttgaataaaagcagtaagacattttattaccagaatgtcttaggtgtattttgtaaattttaagtctttaagtattcatatcataagtattattccatatagctaaacactttcttctatactttgagttgtcccacttggggatacacaaagatagtttactgataaaactatggtaaatgaacactgaagtgtaataatggccattctcttacaacatgagaatgtaaatgatgtattttctcaacccatctgtagggaagttcatagcatactgttattactatggactatacattttaacaatgtacaaccctaaaatacctgaagggttttgaggggcttaaaactcaacctcgaggttatgtctcagaacataatggggagactggtttttatttgacattacattttgttcagagaacttttttctcttcagtgaacaaaccgtatgccttcagcctgaatgtcagttcccaatttctgttgtgccctgtctgtacaatcattttaatttttagaagatgc

SEQ ID NO: 172921 - DNA, 298 bp, Homo sapiens
ttatgaaataaaataatctgttatttttccttaggtattaaggactgcaagaagctaaatgacagctctcttctagaaacaactctaaagattaaagaaaaacctattttcagatacattgaaaataatttattattcaccatattttattatttgaaaaaatcctgtatggtattaaatctttttttttttttttgagacaaactcttgttgcccaggctggagtgcaatggcacgatctcggctcaccgcaacctccacctctcaggttcaagtgattctcctgcctcaggctcct

SEQ ID NO: 172922 - DNA, 228 bp, Homo sapiens
gaaagcctcctatcaagtcctcccaacagaacacccatgatgactcatgaggatgttgaaggtgttttcctgtggcaactgtgagtgtctttcttcaaagtctgttttgttcctgcacattaactgatttatataaaataagagaataaatgcctagactcccatgagtctatcttttactgataaactctagttctgaggacagaagcctgatggagtcagtatagg

SEQ ID NO: 172923 - DNA, 479 bp, Homo sapiens
tctacatcttggttttcttgaatgtatctcccggaaaattctgcaaaggggctgaaaaaactctagtttttattattattattattatttttcgtcctgagacagggtctttttctgtcccctaagctgatgtgcagtggcacaatcatggctcaccacagcctccaactcctgggctctagcgattctcctgcctcagcctcctgagtagctgggattactggcgaatgacaccatgctcagttattttcatttttggtagagatggggtctcaccatgttgcccaggctggtctcaaactcctggcctcaagtgatcctcccacctcagcctcccaaaacactgggattacaggcatgagccactgtccccagccaggaattacctttaaaattttaggtgtgataaatatgttgtggttaattttttaaagagtttgttttttttttaaacaggttcattctgaaatatttactgg

SEQ ID NO: 172924 - DNA, 1070 bp, Homo sapiens
ctcccagagttaacattcttttgattgagcagttttgaacctctctttttctagaaactgcaaatggacatttggagcgcttagaggtctaatgtggaaaaggaaatatcttcacataaaaactagacagaagaattctgagaaacttctttgtgatgtatgtgttcatctcacagatttgaaactttcttttgattgagcagtttggagacactctttttgtagaatctgcaagtggacatttcgagtgctttgtggcctgtggtagaaaacgaaatatcttcacataaaatctagacagaagcaatctgagaaacttctttgtgatgtgcgcattcatctcccagagttgaacctttcttttgttggaccagctttaaaatactctttttgtagaatctgcaagtggacatttcgagcgtcttgagtctatggtggaaaatgaaatatcttcacataaaaactagacagaagcattctgagaaacttgtttgtgatgtgtttgttcatctcacagatttgaacctttcctttgattgagcagtttagaaacactctatttgtagaatctgcaagtggatatttggagcacgttgtggcctacagtagaaagggaaatatcttcacataaaatctacacagaagcaatctgagaaacttctttgggatgtgtgcattcatctcacagagttaaaccttccttttgattgaggagttttgaaactctccttttttagaatctgcaagtggacatttggagcactttgaggcctaaggtggaaaggaaatatctgcacataaaaactagacagaagaattttgacaaaattctttgtgatgtgtgctttcatctcacagatttgaaaatttcttttgattcaacagtttggaaacactctttttgtagaatctgcaagttgacatttggagcactttgcagcctatggaagaaaagtaaatatcttcacataaaatctagacagaaacaatctgagaaacttctctgtgacgtgtgcattcatctcacagagttaaacatttcttttgattgaggagttttgaaactctct

SEQ ID NO: 172925 - DNA, 682 bp, Homo sapiens
atgtccacattcacagctaacaggagccaccagcaccaaagtttaaaggccttgggaggcctgacataatacaacaatattttattgagtacctactatgtgctaagcactgtgctaggtgccaaggttacaaccataagcaaaataatagatcattttccattctctgggtgctacagttcaatgggagacactgacagagtggtgcttccaatgccaatgctaaatgctctaatgtgggtggaggaggtggaacaggttattctgagagctcaaggaagggcgaaggggacaatcttctcaggagatagtgtcctccaagctgagacctaaaggatgaagtggaagcaaagaaaagacttccagaaggggagactcaagagaaagccggagctttgactctgggtatacagaaaaactggaatgccttagatccatctcatacaagaaaggaaaccgtgtcacctcagaatggagtgtttttctctttttagtgttttattaagtaatcctcctcatgggttgtgaggaaaaccctacccaggaagcagcagtcttttgctctctcaacaagaattttccctaactttgcttatctggtaattggtgaatctgaagattgttcttatctgataagatttcagagtattaggaagacattccaattcttcctgactttatc

SEQ ID NO: 172926 - DNA, 433 bp, Homo sapiens
agagagagagagagagagagagagagagagagcccttccccagctagtctggcagcaagtgatttctaaaggccagaaataggaaaaaaaaaataatcgaatcaaattgacttttggaattgtccttatgaagcacaagtctacaacctttaactcatagagaacacagtgagcatatctgctttgactggcaacttcaaaaaacccctctcccagaggcttgggaaaacacatgttggacacagactaatgataatgtggaacaattattacaatgaacacaataattgtatttgttttatgaacatgatagcctgaagaaacccataccaagaaatattttacgtgttgtcatcattaagaagtcagcaaaccttaaagacaaacacaatctattcatccatccatccatccatccatccatccacccatt

SEQ ID NO: 172927 - DNA, 288 bp, Homo sapiens
agctaagaaaggatggaaacaaatgtagtattttgcaggtgaatttttgagatgccccatttacttgaaattttaaataatggaggtaaaagactttagttgaagtttgaatgtctcagaatgatgaataaggagtttgtcaggtattatattttcagtgttagtgcagagtaattccttgtaacacaaatggctgatttttgtaatatgtacacacaagcttagtatggtatgataataagacaacaaaaacctagtagcctttgctttttttcactttgcagttga

SEQ ID NO: 172928 - DNA, 393 bp, Homo sapiens
aagcctggttttgagagtccctttttgagacataattgttatctccctgccatttttttcaaaagaaggaatttatcgtactccctaacacctctaagattaaaagtagcttaattcttggctgggcacagtggctcacacctgtaatcccaacactttgggaggccaaggcaggcagatagattatttggagtcaggagttcaagaccagcttggccaacatggtcaaacctcatctctaataaaaatacaaaaatcagccagacatggtggtgggatattccagctcctgggaggctaagacattaggatcacttgagcctgggaagtggaggttccagtgagtcaagacaccaccactgcactccagcctgggtgaccaagcaagactct

SEQ ID NO: 172929 - DNA, 623 bp, Homo sapiens
ggctctgctgtagcctcacctcagcgcattcagggctctgaacctgcctctgggcccattgagtgttttcacatctttgaacaaagagaagattgtcacagaccagcagacaggacagaaaatccagatagtcaccgcagtggacgcctccggatcccccaaacagcagttcatcctgaccagcccagatggagctggaactgggaaggtgatcctggcttccccagagacatccagcgccaagcaactcatattcaccacctcagacaacctcgtccctggcaggatccagattgtcacggattctgcctctgtggagcgtttactggggaagacggacgtccagcggccccaggtggtagagtactgtgtggtctgtggcgacaaagcctccggccgtcactatggggctgtcagttgtgaaggttgcaaaggtttcttcaaaaggagtgtgaggaaaaatttgacctacagctgccggagcaaccaagactgcatcatcaataaacatcaccggaaccgctgtcagttttgccggctgaaaaaatgcttagagatgggcatgaaaatggaatctgtgcagagtgaacggaagcccttcgatgtgcaacgggagaaaccaa

SEQ ID NO: 172930 - DNA, 494 bp, Homo sapiens
tggtctggaaaggcgggacaactcaaagttggccatggaggtgcttccaggtcttgggtgggttcaaagattttctcattggcagttggttcaaagagttatctaaaggcctggaatcaatagaaaggagtgtctggattatgagaaagggttgtggagaccaaggtttttattatgcaaatgaagactccatggtaaatggtaaatgtctcttatcagttgaaaacagtgccagactcttcagttaattctctcctagagagagacctgggaaaggaagaggaatgtagattttacaaaatgaatatactaagcatgctagattctaatgagattgctctgatttgacaatattaaaggttttcttaataaattgacttccaatcttatctttaatgtctgtagtactcttgtgcactgaatattatttttttcattaaacacttttctgtagatcctgaggaaaagatacaaaaaaaatttgaaaaactcaa

SEQ ID NO: 172931 - DNA, 374 bp, Homo sapiens
ggggagcccagagcccaccagctgaggcaggatacttggtgcatgtggggaggcggggctggcggagcgtgagcggcccccgctggcctccagcacccagctggtgccgcggcagccctgtccactccagtgtctgcatggcgccgcctccttagccaggccttaccttctggccgcatttcccccacaccagaccaccccttgggctgcagctggactggccttggtgaatggcagatctcactgttcccctcctctgccaggtgctaggtagagcctcactgtgaatctcatggctggccacagcctcaccccgaccccaccccaccccaccccagcacagtgtgctctccctgagcccctttccatagcag

SEQ ID NO: 172932 - DNA, 492 bp, Homo sapiens
gctgcaactacaggctcatgccactgtccctagtgccataatatgatcttttaaataactaactatgccttaatttcttttttgtttgtttgttctttgttgttgttgttgttttgagacggagtcttgctctgtcgcccaggctggagtgcagtggcgcgatcttggctcacttgcaagttccacctcctgggttcatgccattctcctgcctcagcctcccgagtagctggggactacaggcgcccaccactgcgtctggctaattttttgtatttttagtagagacgaggtttcaccgtgttagccaggatggtctcgatctcccgacctcgtgatccacccgccttggcctgccaaggtgctgggattacaggcgtgagctacggcgcccggcctaaccatgacttaatttctaatcagagaaataacatttaatatttcagataaatttcccaagttgtaagccaagaagcaggctatagtatctct

SEQ ID NO: 172933 - DNA, 169 bp, Homo sapiens
ggtgcccttcccgggtaaaactctgcggtgcttcaccaaagaaatcacagaaaaccacactctgacagcagtgtcttattctattagtacattttaattagaacaggagcaatggatgcattatgaatattcatggtgggttattaaaatgcatcattaatcggtgggg

SEQ ID NO: 172934 - DNA, 408 bp, Homo sapiens
ggcactatgtagtttataattttctttgtaagaactttgtgacttaagaattctctcaattttacgaacgcactgataggcgtaagcaaagtgactttccctaaaaaatcatgaactgacaacagacttaatctcaacttcaagtcccggcttagccacctattaagtgacttgaacttgggactaagcctgttgtcggttcagccctctactataccatcctgcttcattggtaaattagtcttttgtcttcttgaaaagttgggactacttagggctgttcaaattaagcagcatcttagtggaaggcttgatcctgtggtattcacaaagccctgtggaaattgtgaggagaggcagactaatgataacagcaaatgggttagcactgattgaacacttaccacg

SEQ ID NO: 172935 - DNA, 178 bp, Homo sapiens
aacagaacaagaaagatacaagatatatttttaaaattcagccctttaaaaaagtagtgcatattcccttttatcagtcaaagtttaacttttgcttattcttttataacatcctcatttcatgatttcttcagcagatttaagtattacataatatttgtcgatacaaaatgccaat

SEQ ID NO: 172936 - DNA, 313 bp, Homo sapiens
gattaagaaactttcttgatacaaaaatagaggatcattcatggtactacaaaagatatacaggaaatgatataatatttcatcaggattggtatgtgttatctgttttctaaatgactatttcatggataagtaacacttcagttatgaaatcttaattctcatcagctgagattttatggcaatgggctgtccagtatgaaatattttattttgattttaaagtctctctacatattaagtctaagtgctttctaaattactaattccagagtgactgtcacaatgtgtcacctcagtgctactcaaaatg

SEQ ID NO: 172937 - DNA, 204 bp, Homo sapiens
acatagtacctcttgcaagaacaatgagaagctagatcagctcctatttcccctgcacataggaaatctcagaatgtaggtatgtgtatccacacccgaccttcgtgcacacacacattagagatgctaattatgggaagacagcagaggcagtgcaagcttcatactgtacccggggagggggagtttgcaaatattttctcc

SEQ ID NO: 172938 - DNA, 544 bp, Homo sapiens
gagttttttttttttacttcaagttatgctgatttaattacaaaataagcttttccaaggcactggcctttgtaatgaaggtaaatattacatgtttgctaaaaaacagggttttataaaactcctcacctcatataaacaattgtaagtcttttgttttttccagaaaaaaaaaaactttcactaagtattagtcactcatatatctataaatctcagaggaatttccccaagcactctggcttcccaagtaggagattgtttctcctagttcaagtctcatttcactgttaggctggctgttatttcatggtgacttgccatgttaatagtatgtcttctaatccacgaatgtgatatagctctccaacttatttgagtcctcttcagttttactcaacagtgttttgtagttttctgtgtataggttttggaaatccataattaaatttatccttgggtattctatggttctttgttattatgaattgtattttttatctcatttcccaattgttttgctggtatacagaaatataattta

SEQ ID NO: 172939 - DNA, 131 bp, Homo sapiens
cagccggtacctgaacttctctgtgttaccaaatgtgtatttggtaacacagagaaagttcaggcctgaagattaaataaggtgacctgacatctttccaaattatcttgccctagtttcagaaacaaaat

SEQ ID NO: 172940 - DNA, 460 bp, Homo sapiens
ctccggatcaggatttgttcaaatctcaagttaacgaaggccttggggctggcagagccaagggcccttcccactacccccatcccttggggcgagggcatctgcctctgggctgcggccttcagctcagtccagtggccagggggagcccaagccctcaggatacacctgccctgcttccaggaacaatcaggccagacagagcccgctgactcgtgagcagcccagagctgcactggtccctggactgagactcatggggcacaccccagcgagcatctcagtgagtgctgcctcagaagaggggagatcagggtgaggcaggggacgctcccgagaggctgctggcccaggcctgatgtggagtccagatggaaacagaccgcaggaatgggcactgtcagcaaagccaggcaactgagctgggaggctccaggcagcggctgccccacacgccaac

SEQ ID NO: 172941 - DNA, 425 bp, Homo sapiens
atcttcaaagtgatgaatgtcttttttgtatgttaatgaggtggctggtggctcctagacagcttcaagataggaggtggggctggtcaccagaaagaagaaggtagggttagaaggttgggactcagccctactcttgccctctgggaagggagaggggctgatggttgagctgatcgccaatggctaatgattaaatcatgcctatgtgatgaagcctccataaaaacccaagaggacagggttcagagagcttccgggtaacgtggaggtttctagagggcagcgcacctcccttctacggggacagaagctcctgtgcttgggacccttccagaacgctccctatgcatcttctcatctggctgttcatctgtatcctgtaaaatatgccttgtaataaaccaggaaatgtgtttctctga

SEQ ID NO: 172942 - DNA, 209 bp, Homo sapiens
aaaaaagaaaaaaaaaaaaaaaggaagagaggtgagggccactctagggacaagggtagaggttgagacatggtggtgaaggtgccagacctcaggcttcaggcccagatggggttgggttcgggattatgagctgaaggtggaaagtgctcctagagccctagacctcaggctgctgagctggggaatggggaatgaagtagtgagac

SEQ ID NO: 172943 - DNA, 640 bp, Homo sapiens
ttaatttctaatcctttcctaatcagtgtatttattctcccatctctagattgaacctctgcagcaacctcctaatgggcctccctgttatcagatgttgaatctttcagtccattgtccacacaacattaatagtatatgtcatttgcgtgtttatgaccctacttggttttccattttatttaggataaatttaacttttataaaatattcacactctgttcctcagtggtcactccaatttcatttaatttttctccttactataagaattttatcttcttttatttcctcagaagagttaaacctttttctactttggggtcttcatatatgttgtttctcttttctggtatactctttttccctgatgatcacatggctgattcttgctcagcaaactcttagcttaagtattgtctccttccttatatttgcttagccttctgtaaccacattgaattagattctctctctctctcatttgttattcacaaatccctgtttccatcagaacatttactgctgtttataattacctgttattttggtcatttgctattgagactcttaaattccatgaaggcaggaacaatgtctaacttgtttatattgcatctccaagtactttgaggtgcta

SEQ ID NO: 172944 - DNA, 545 bp, Homo sapiens
aaagatttgaaccagcaattactacagaagatatactactgatgggaacgtaaaatgatacaatcactttggaaaacaatttggtagtttctttagaaattaaaaggccgaggcgggaggattgcttcagcctaggagtttgagaccagcctgggcaatgtagggagacttcttctatacaaaaataagaaattttttaaaaaagtagctgaacatggtggtacatacttgtagtcccagctactccagaggctgaggtggtaggatcacttaagcctgagaggtcaaggctgcagtgagccatgatcatgccactgtattccagcctaggccacagagcaagaccctgtctcaaaaaaaagaaataaagcacacatctatatttcctagccactttactcccagatgtttacccaacataaatatgtcttcatgtgtccacagaattatgtacaaatattcataccagctttatttctaatagccccaaactgttcgccaacagatcgtcaatcagatcgaccaccagatcgcccaccagatcg

SEQ ID NO: 172945 - DNA, 431 bp, Homo sapiens
cctacttcagcctcctgcgtagctaggaccgcaggcatgtgccactatgtccagctcatttttataaattttttgtagagacgggaatctgggaatctccctatgttacccagtctggtcttgaactcctggcttcaagtgatcctcctgcctcagcctccagagtgcagggattataggcatgagccgccatgcctgggccaattgtgtgatgtctgtgaaagcaaactcttcatatttttattcctgtgatatgttatttgggtaaccggatagctatattggaaactaaaacttcttatgtttatgaggtatgaatattataaaaccattttgttttttccatttattttctggcttgtcagttttaagaatttccacctcttctttctttagggcttcaataactttacaactaattgtgtagttta

SEQ ID NO: 172946 - DNA, 220 bp, Homo sapiens
caaatctgtacttttgtctgttcagggtcttttgcatttttatgtgaattttagaataaacttgttaatttctgaaaaaagcctgctgttattttgatagggaatgtaatgaatctatatagattagttttgggagaattaccatcttagctataataacgcatcttttttttttttttttttcttctgagatggattcttgctctgttacccaggctgg

SEQ ID NO: 172947 - DNA, 536 bp, Homo sapiens
tgtaccatctttgggataaaatgcatgcatccgtaattatgtcataaaaggattattgattttgaaccataaaaaggcttattggttttgaatcacaattaacataggtatacttttgaagattttgactgttgtatttaaagtttttaaaaaatttttattttattattattattattatttttagagagctcacatcctaagcaattgcctcattggtacctatgtaaagattaaattaaaaagaggacacaaaaaatgtgatggctagccttagggacacccttagcaagattaaatagaaatcagacttagaacaaaagctaaaatccacacctgcaaaaaattctccttttccatccacctataccccccttaacctccaactctctgtccctgaccaccaaccccagaagatcctctggcactctgagtccctggcttaaaccaccctcgcaaaatccagtcccatctcctcagacctcaatgagttttaagttttcaagatcatgtgatctggggtaatctttgataaa

SEQ ID NO: 172948 - DNA, 388 bp, Homo sapiens
gttccagatagcaggacaggaaacttattctgtgttgttcatctgctatctccagtatttaaaatagatgctagcacacacaaagcttcaataaacgttatttccttttatgataggattactaggctggtatgttataatcaaaccatggcaagaatatacactaacaggagctaacacatttgataaaatctcatgtagctttgataacaggactgagaaatttcagctggagtagaagacacgggtagtttttttgttttgttttgtttgttttttttgagacacagtctcgctctgtcacccaggctggagtgcagtggcaccatctcggctcactacaacctccgccctccggattcaagcaattctcctgcctcagcctcct

SEQ ID NO: 172949 - DNA, 306 bp, Homo sapiens
ccaaagggccaacctcttagctctatggccggtggtcttgtgtgagttttgtggtttggagtattgtcatcattagcagttctattgtttttaccctttgtcaaacagcagtaattagtgtgttattaataatagtattgattattaataacattgatcaagcaagtctgtgtcagacaaggtgctagaggttgtgtttaatccaatcaaaacccctaagagtgggaaggaagctggtcctaacctggagggacacaaggaagttttcagggcatggaaaatgtctctaccttggcctgggtggtg

SEQ ID NO: 172950 - DNA, 190 bp, Homo sapiens
catgcctatcactgtccccgaaggccttccagtgggatgaaatgtggagatggaaggcagtgacactgatgatcctgaccctgtctaggtccaggctaatgtgtgcgtttgtgtcttggtttttaacaaagaagtttaaaaggtaaaaagaaagttaaaaaatttaaagtagaaaacagcttacagaata

SEQ ID NO: 172951 - DNA, 283 bp, Homo sapiens
gagggaaggggcaggattatgtcagcagtgtgacggatacagtgtgaggtcaggctccttcctgccccaccacgggggcctagaggtcatggggagggtccctggcaggggattcaatcattgcttggccccatgacagagtatattctaaaaatgccttaagtttttttctttcaaagtttcttcctgttttgcataatggccttttgcctttgacatcctgaaaccgcagagctgtcattggtgttgcaggacactgccagcttgaaaaaaatcaacaaca

SEQ ID NO: 172952 - DNA, 389 bp, Homo sapiens
ggggtcttgctctgttgcacaggctggagagtagtggcacgatcacagctcactgtagtctctacctcctgggctcaggtgatcctcctgccttagcctccagagtatctgggaccacaggtgcacaccaccatgcctggataattttttaattttttgtagagactgagtctcgctaaattgcacagcctggacttaaactgctgacctcaagtgatcctcctgccttggcctcccaaagtgctaggattacagtagtgagccactgtgtccagcaccatgcctagttctttttctagtgattttttttttaaaggatagtctttgcaagtctcttactgcttaaaaatggaaccaaattaatttagctctgcttctgcccatgcacc

SEQ ID NO: 172953 - DNA, 678 bp, Homo sapiens
aattttttattgaatgccagacattgagaagtttactttgagatacatataatgtttatttttatgaatatttttgagctttgttctggggtgcaggtaagttccttggaaagagcttgatgcttcaggtcatgtttttacactttttttagggggtgggccctgagcagcattctactcaacaaatccttgagttgtgaaggttttcaccatgattggcggaattcggagttcctctgggccgtgcgtgagtgctggggattgttttctctaatattcgctggtgattctttatctggcatggggtaggagtgcctaccacagtaggaatttgaaatgcaggtatttcttcacttgcctgcactgctcagtagaagacttgaagggaaccctctgcaaacctctggcactctctctctctctgtacagctctgcacaacccccagctcagggagtgctgcttcttcctcctgtctgactccagagctcagtctgtggcagtctttctctgcagtcacttacttgctcattcatttcatctggtcttaaggctttcaatatgatctaaagctgatgattccttaatttctagcttgcctaggcttctatgtacaattgcttacttgatacgtccacttgaatgaatgcctattaggtttcttaatactaacgaaataa

SEQ ID NO: 172954 - DNA, 327 bp, Homo sapiens
gtacctctcttagcttccaattgatgctgtaacaaattactacaaactcagtgactgaaaacacaatttattattttagaatgagaaggccaacattagcctcactgggttcatgtcaagttgtcagcaaggcaggttccttttgaaggctctcgggggaatctgtgtctttccttttttaacttctagaggctgcctgaattccttgactctggccccttcttccttcttcaagtctagcagcatagcattttccagtctcttatctgattctgcttccattgtcataactttgtctctggctctgatcctcctgagcccacctgg

SEQ ID NO: 172955 - DNA, 297 bp, Homo sapiens
gcttacctttattttccaatttgtattagatgaacatgcattacttttgcagtaagggaaaaaagttatttttaatttaagaaaatggtcacacaaagacaagagaagtaatcttctattaataatgagcttatttcttacaaatgacaattctgaatgtttcgagctgataataaatgacaccattttctttctaactaatcttcttgtaacattctcccaacttatttgactataggaatttaaaagcaagttcaactaccatctgggaagttattaattactgtattcctcact

SEQ ID NO: 172956 - DNA, 502 bp, Homo sapiens
cggctcattgcaactttggcctcctgggttcaagcaattctcgtgcctcagcctccctagtagctgggattacaggtgtgcaccgccatgcccacctaattttttgtgtatttttagtggagatggggtttcgccatgtgctggtcttgagctcccgacttcaggtgatcccccagtttggcctcccaaagtgctgggattataggtatgagacaccaccccagccaatgtttctcaaagtattaaagatacatgtttacttaatgtggcatttgctactttttaaaaagaaatatttgtgaggtattttgcaagggagtaggaattaggtgaaggaattacctttggagaaaagacatccacagagctctaattgcttttcactttaaggtgtatctcaatatagactacactttccccctgtgagagagtaggtaaatgcttatacctctttgcctgattacttcagcccttatgaatttctcccttgactaaaattcct

SEQ ID NO: 172957 - DNA, 450 bp, Homo sapiens
ttaggcagagctggtttgtcacgtccaaaatcaagtattttcatagacttaaccagatattttccaacaaagttccatcatagcttcttccccagtaaagcctatagattttctaaccatctgtgaaagtgcttttaaaaatgcataaaaaagaaatgaaatgatgtctcacaagagaaggaagaaacagcaactaatctgccctgggaattatattacctttttcatgagtgtcattagtaaccacaggggctttcctaagagcctttcgagtatctttaattttgaaatctgctgaatatgtctttactgttaatttttagttttcattcttcccttgaaaggaaggaatttgatgtagcttcctcaggcgtgtttttacaaaatcctagagcaaactttctcataaaatttactcaaactttatttaaaaatgcaacagaccaatca

SEQ ID NO: 172958 - DNA, 373 bp, Homo sapiens
cctagacgaccccttacacggtagatttatctacaatgttggtcattaccacggtagatttgcagtgaagaaggagacatatgcatatatgtaagtaaatataatcgaggtatatttagcagacagaatcaatagacttgatgagtgatggactggatgtgtgaggagtctagatcacttccaggttgctgatttgggcaactcagtactaatcaatgaaaaagaagatccacagggaggaacttgtctaaggggtgaggtggggctgaacagctgcgtttgagactggagaagtgtgtgctgggcatgggatgcacaagtggaaatgcctttgggtctgcagctcagacatgggcatgaccagcatagagat

SEQ ID NO: 172959 - DNA, 318 bp, Homo sapiens
agccagtgtatcaagccagatttcccagagagtaatagttaaagtctataaaatagagcaatgacctctgaggtctaagcgttttgacagacttcttttatacagatactctgcacagaaaatatatttatggtactagaaaacaaaacaaataagatggctattataaattttcccacaagttcccataccaggcaggagaatgagactgccatttttgtaaatcctttttttttttttttttttttttttttttttttttttttgggaaacaaatttgtgcctttggccccggggggggggggggggggcccctcc

SEQ ID NO: 172960 - DNA, 229 bp, Homo sapiens
aggcatgtgccaccacacccagctaatttatttatttattttaatggacacaaggtctcaccaagttgctcaggctgatcccaaactcctggcctcaaatgatcctcctgcctcagccttccaaagtgttgggattgtaggcataagccatagcacctggcccaggtgatacctttaaaatatttcttcaaattttttttcatttttatgtgacctcagcgtatttcta

SEQ ID NO: 172961 - DNA, 611 bp, Homo sapiens
ccctcttatgcaagtgtcgattatgtggcaaaaatgacctaaaccaatggttcagcatttttcatggattcccttctttcaggacattgaaagactgttcttgctagctttgcctactcataaatattaccaggacagaagagcgctaaatgtaacattttatacatgtggcactagttaacataaatttagggggaaacttatcttaaatctcaatttcctcagtatcaaaatattgatctattttctttatgggttgaaagggaagcatgcaatttcaaaactgaaagggaatgaggaatcactcagtaagtacttggattctgcctgcatcctcttctataagcaaagaaaaagcagctcatagaggcaatttgtcgttagtaacataccttcttcaggctgtcctcatcgttctgtttcacttagaaccacgtgtcaccctttccctgctctgacccaaaacattagagggctgagtgacgtggactgtgtcccacgctcctgtattaaggagcttccagctgggaacttgaaaaagatctgcaagtgaaaggaagggaggaaccagggtatttcttcccacttttgctctgcctcaggctgctact

SEQ ID NO: 172962 - DNA, 461 bp, Homo sapiens
cccttctctatgatgccaaggtggggagcaatgtgatctttaatacaaaaggatgttaggcagtaaagtgtcttaaaacacagacatggatttcctttcttcttcctttgaaatatgaagacttttcctggttggttttgggggaagatagaaatcatatattcataaaggacacaccccatattcagagttcagaatttggagtttccaataatcatctcatgcacgagagctgactccctctgctggggctgccccacccccagttccagcctttccttctttcatttttatttatttattttcttagagatagatagagtctcactctgttgcccaggctggagtgcagtggtgcaatcatagctcactgcaaccttgaactcctgggctcaagcaatcatcctgccctagcctcctgaatagctaaaaccacagacacagcaccatcacgccaggct

SEQ ID NO: 172963 - DNA, 938 bp, Homo sapiens
tgagggtcagagccctggcacgctctcccaagagctcatggcattgcctgggatggggccccttttgctgagaggctctgcctaaaggggagatggtgacagccacaggcttgcgctccccgccacctacttcctaacccaaggcagcatcaccctttccgacatttgcggcgaagctctttttccctgactttggagttaccccagctacctttcctctgaagaaatgcttgtgaaatgcagcttctcagcaccctgctaaaacgtctccttttgcaagtcctggtctgtccccaacagtaccgtcatgacgatgcagcctccaagcagctttgacatcagagccagcgctcctgtgggcctgggggcagggggtcgtggtgcctacagcgagaaagacacacaagcagcacgcagctcgcgctgtgctctctcggaagaaggagaccttaccttcaggaaaaatagagccacagcagtgccacatgccagggcgagcattctggttgacaggggccaggctgtacttgctgctagggtctggtgacctggggccagagaagcaggctggagccctcccaaaattaggcatctctgtgaggaaaagaaaatgaagctgtcccttccacaaggctacaaggacatctctctccaaaaaccatctttttccacccgggcaaatgttttggtggaaaccctgccaggaagcaacattctctagcagtaaccaaagggccctgggaggcacccgaagtcattcccgggagccaggattccttaaagagagctgcatacttttcagctcagctatcctttaaatattgtttaagggtatatgcagcacacatttttaagtttaaatatttgcaaaggatagaatttgtcttgtatcattatttaagttccttaaatatatgtttgtgcaaacctcgaaaaaa

SEQ ID NO: 172964 - DNA, 546 bp, Homo sapiens
gaaaaataaaaaagattaacaccaactaataataaaatagagcaattacaacaatatactgtggttaaaagttgacatggatatggtctctcccatgcttgctctttctctcactgtctcaaaatatcttattgtactgcaccataggcagttgaaactgcagaaagtgaaagcatggataaggagggactactcttcagtcatgatctctgtctacagcagtttatattcttgtagataacatagggacaaacatagggaaagttaatcaaaattaatcaaagcttagttcaagggtttctttgtccacagagtattctcagacgttaccagctaggtgacttttccttttcccccaacgactgggaaagtctgagaatactttgtgaagaaagagggccttgaactaagttttgagagtagaatttggacagttcaacaggcagctatgggcacccttgatagaatggaaaagtagggacctggacatgaacttaggaaggtggaggattcaatcgttcaaggacaagtcacatgtggcatgtc

SEQ ID NO: 172965 - DNA, 419 bp, Homo sapiens
gagagaataatagtaataataacagcaaacattttgggagcacttaccaggtagcagctgtcatgcttatgttgcaagttctttctgttctcacagcagccttggaagtggagtttactctccccttgaggaagctgaaggtcagaaagggagagacgattgcctgaggtcacacagctgatggacagtagagctgggttatgaactcgaatgcatctgagcatacaggtccttctttgttacttgtgacaccttgatccacccaaaggtgccttaatcgggggattccaggcattgggaaggggctgtgggagatgggaggaggtctggcctgagatcaaggtcatcagacgcctcctagctcctcggggggaacatccctaatccctgaatagcccaaggtctgccacagctgaaaa

SEQ ID NO: 172966 - DNA, 339 bp, Homo sapiens
tatcactaaacacaaatggatttactgagtactatacaaaccccaaagagcacattacaagttgaagagggtacagtatcaattatatcattatctcaccctactctctgggtgaatagtctgaaagcctaaaattacagttgatgttagatttcttggcttcatttgcaaattggagtcattttccccctttttgttgaatgccataagcacatgttttattgttgaagagtaccagtccttatagtttgttatgatgtttttcttctttttgtcctacatgtcaaaggacctttaaaaaaaaatggattgtggaaaattggtgtaacgttgtatttc

SEQ ID NO: 172967 - DNA, 228 bp, Homo sapiens
ttcttggccattagctcctcaaatattgctcctctcccattctgtctattctcttccactgaaatttttgttagacatattttggaccttctctttctatctaccactacctcttaccctctccttcacactcttaatctctttatcattctgtgtgggattctatagaatttgcttagatctttacacttactatctctttagtctgtttttaaaactgtccagtaa

SEQ ID NO: 172968 - DNA, 205 bp, Homo sapiens
gcaggaggatagcttaagcccaggagttggaggctgcagtgagctatgatcaggctacttcacccagcatgagtgaaagaatgagactccatctacaaaattttttaatgtcaaaaccatttttaaatgtcaaatcaaaagagacatggtacaaagtgcttcatgacataaatggttttgaaccttatattgatattagattgca

SEQ ID NO: 172969 - DNA, 852 bp, Homo sapiens
agataagtattgaggcgctgctatgggggccctgctaggaggatttccctggactcaacgggttcctgtccaaggtcctttcattatccttcttcgccgatggagaactgagatccagagagtttaactaactcacccaagatcacatcagctactggggtggaagtaggagctgatcccagaccaacttgctcaggaagaaaggttttctcctgtgttggatatggtagagcctccgtacataccgggttcatctgaattctcagcctcagctgcggtcacgcgcatcaccagcctctcacctcccaaatcacaccaaagaagaataaaataggcatccatcggaaattcccgtctgctttcgacacacatttttgtaaatgttcgttacatcctagtaggggtgagtgtgtgtctaaggcaggcatgttgatggggttggggaagttatggcccaccttaaacgtaataaccttgcgcagttctttgggggctgcgagtacactacaggcatgaatgttcagtcacctgatcttcattccagacgctaggaaaagcaggccggtgtaaggaagaaagcctttcaaatttgtattggctcctatttagtatttgtcagggctccagggctgcactccagtgaacgcctcacttaggacaagattggacactcgacagaccacatatttatctcgctctctgtcggtcagtgcgttccaaagcccaagccgttatggaaaacaggctcggaaaaatgcatatttcccccaacatctcagactaacaagctgccccttcagcaaatatcctattgccccagccacggggatcaccttcatgatgccccctccc

SEQ ID NO: 172970 - DNA, 124 bp, Homo sapiens
gacctggtgatctttccttaaaaaagaataatttagattaaaacattctttagcttcctaacctctgccctttgttttgtacctttcctatctctctctgatcccaaagtgtttaatatactga

SEQ ID NO: 172971 - DNA, 378 bp, Homo sapiens
tggtagatgttttccgctaacctctgcagagcttttggcagctatttgcagacacatgggactgacagaccctctgcttccaaaagtgtctctcctgctcttgtctttcagcaccctcagggtctcccagaggcaccctctctggcagagccttgttctgctccaggtgacctcacgggaaggtggctcttggcacctgtggaaggccatccatctccttgacttcaaggcactgttgtcaacttagggggtggccccaggttgcccctgctcattccctcgaggtctcctctccaaatttgaaatcatctgaaaggccccaccttttgttgcctttttagcttgagaataaacatgtaacagcaccagcagcccata

SEQ ID NO: 172972 - DNA, 288 bp, Homo sapiens
gacttcgcgcgcgcgccccccacatcctcctcgggacacttgtccctggatcctctacccctggccggcccgaggccgccttctcgggaagccccaccagcccccaagggtgttttcccttggctacctgcgctgcgaggagagaagggaattcagagaaggggtacaaggggggcgtccctgggagggggcgcgactggaggagacagaacggggagcgggtgccaaagcgcgggcctttgctccgcctgggcgcagtgggagcaccaactggcagagttggaaact

SEQ ID NO: 172973 - DNA, 413 bp, Homo sapiens
ccacgttgtgcccaaatgagtggaagttgtgtggtgctcagcacacctgggttggccggagggattggggttggggttgggttgaggtcaggaagacatcctagagaaaggctggctttgagccctgattgatgatgaggcagcctgtgattgattcaaccagtacttcgttgtagggggtaatatgggtgaaataacttagtggttaagtctgctgtattaaaaatcagtctataatccccagacaattcaaattcttcagtatcttaggaaactcttctatacccagtggatgtttaataattcagattgtaaatggatttaaaaacatactggctggtagagtaggagacttcagcccactggacacatgtggaagggtgtggtgtcattctgagaaacaagagccaccc

SEQ ID NO: 172974 - DNA, 707 bp, Homo sapiens
gcagtgggcaaggtgaacctgttgggtgggttacaacattgtgaattttactttgttgggtgctggatatttttgtattcctgtaaatcttgagcttcactcaaggatgcagttaagttacttggaaatagtttaagcctttcatctcttgcttttataatttgttaggcaattatagagtggtgctcagcctaagactgattgtttcccactactaaatgctctacccaatgccccatgagttatgattttctttccagtctggtgggaagaacaggcattattcctggacctgtgtgagcaccaggttctattccctctggtactttgtcctgtgaaccctgtcttgatctttatcgactctcatcttgatctccctaactcagggagtgttctagactcaagagcagttcccttttcccgtactggagcctggagactctctcaaggcagtaagcaagactcatcttgtttgtttcctgtatctgcttaatttttaaatttttttgtcattgtttcaggtgggaaggtaagtcagaccctttaactccatcctgcccagaagacttcattatttttctttctccctctccctgccttctttccaccctcttttttaacttattttgaaataatttcatactgacaagaagttacaaaaacagtagagagaggttctgtatacccatcactcagttcccctaatg

SEQ ID NO: 172975 - DNA, 470 bp, Homo sapiens
acactggctgggaacttctgctctcagctgccaagatgagctctcagaaccttaagacctggaccccatctctggactccaggtccctggagagacactcggagcccagaatccacaaggcttagagaaatcagggctgttaggaagtgtttttaaatgcacttgctttaaaatgagtaaaaggctaaggaggacacgaatgccagcctgcagctccagccttgaaattcagagcccaggacagaagcagccacctgcttgcagtagcgttatgtttggcggcagggaggggatctcagaggagagaagtccacttttgagtcctgactctttaaactgaactaatccagtcttgagaggaaggcccctggaacaccttgctgagctcttcttggttctggggctgacaggcaccttagggagacttttaggagactttcaggggtctctgttaggtggttgtgggatgc

SEQ ID NO: 172976 - DNA, 260 bp, Homo sapiens
agggaaagagctccatgtgatatttcagcaagcaacatctcaggccatgtaaattttggagtgaaactgcttttacagttttgatgtgtgctttaaaatttctcttagaaaaatgcgttgttctttagtgggtttttaaaaaagtatttagatgggactgttagggaggtaggtggtagtttgtgtttaatattttagttgggtgatgaggaatagtgtaaggagtatgggggtaattagcacaatgatgtagaaataga

SEQ ID NO: 172977 - DNA, 514 bp, Homo sapiens
gcaccacggtgttctaattttctggccagaagctggacatcaatatattctcctaactcttcagactccgcaaactcccactcaagcccctccatgagtcctcaagcctgtccctttcctaacttgccacagcccagacttgcctccctctgtcccactgttacatggacctgcttacagctccctggccctgccaaatggggtgtgggggtgggacagtgtcacacagttctctctccttggaacattccccaacaaacctggtctttccagctcaccttttcacctgttctcattgcctttcctggaagccagatgaccctccgatcccatgcaccctctcctgctgctgtccctgtcttcactgtaacttgttcatttacacgcctgcccagttcaagtgccaacttgatcttattttgttcccacaaccccacgggttaggaactatcatcgtccctgtttcaaggaggagaaaactgaggcaaggacagggaagtgacatgatcaagac

SEQ ID NO: 172978 - DNA, 499 bp, Homo sapiens
aatgtttggtttaaagccattgcctttgctctatactattaaccctctagatatatgccaaaattgcccaattgttcaaacctaatgtcaggcttgggactctgtggtccgtgtcttcaattgactatttcctcatgatacagtgatctaataactgccgctcaggtcagggaaaaataaagcactcaagatgaaagcttgcattgcaaatctctttactgtttctatacaaatttcactgtaatatactctctttgacagtgtgctaggccagtatttcctctggaagacactgttgtagaaaccaataatgattttcctgagaatgttccctagcctgataaaagaacagaaaataattatgttgacaaatccagccaaattgagatgttttatactttcattttaaacatagttttcttggtcttgctagtagacttacatctgcagaatatacaagtgactaaaaataattctttcaaattgtagatgaaataaa

SEQ ID NO: 172979 - DNA, 525 bp, Homo sapiens
gccctattccgaagtacactaccatgacagcagagttgtcatctgttttatttactattagatccttcaggcctaaaacagtgttcaagaaatatttactgaacgaatacataaagacattaagtaactgaaccagaactaaaacccatgactcctaggtcttatactgcaaccacagtatcagcaaataatctttcataaggggattattctctgattaacaggaaatacaggaatttaatttgtgaacacgctaggtagaagcagaaacccaaatccaaatccaaatttaaacatttaaaattcattctataactaagatctaacagtcattttcttcccagtaagaaataaccaaagcatgctaaaaatcactggactaaattggtgtcaaaactgccacattgccaggcatgggggggtcatacttgtaatcccagcactttgggaggccgaggtgggaaaattgcttgaggccaggagttcgaaaccagcctgggcaacacagtgagacaccatctccac

SEQ ID NO: 172980 - DNA, 293 bp, Homo sapiens
caaggagactaggtcatctcagcatgtcacaagatgctcagctggcctggcatggtggctcactcacgcctgtaatcccagcactttgggaggccaaggagggaggatcgcttgagcttgggagtttgagaccagcctgggcaacatggtgaaaccctgtctctacaaacattataaaagttagccaggcatggtggcatgtgcctgtagtcctagctacttgcggggctgagatggcaggattgctgagccacagaggttgaggctgcagtgagctgtgttcacgccactgc

SEQ ID NO: 172981 - DNA, 196 bp, Homo sapiens
agatttcaattcaacccaagcaaatgcatagtatatatgtgcttatatatatgtaaaaatctgaagcctctgagacaaaagtcttaagacaatgtagcaggtgtcaattttttaccaagataatgatgagaaccctaaatcagaatgttacatacttaaaaccaatttgtttcagtggcatatactcaagtgtcaa

SEQ ID NO: 172982 - DNA, 528 bp, Homo sapiens
aatgagagattttctttggagaaagctttcaagtgccaggcatttctccccatcatgtgcccccctagtggaggaggggagagagggtgctctactgggagcacttcacaaactcttctggaatgtaactcgtgtggcacagagggtgatgccaggctctggggaagtgtcaagtcaggagatgctagctagctggctgtgctgatggcagaatagggagaagtgactgctgtcagaaatggcctattccctcaaggtttgtggaggccaagaatgtggacgtgttcccagcaggccaggatcaagacagcctatagctatcttaagagcaactgggcttttgaagcagtctatgtgggatggactaacagaaaccagagtcaaccaggagctggtggagatggctctcaagagagaatcagcgacaggtctccaaataatctgtaagggactaatttgaaaggtagcttaaatgtcagggtctaaggagaccaatgcccagtttttctaagttccaggcaagtgaga

SEQ ID NO: 172983 - DNA, 350 bp, Homo sapiens
taatgtagatgaatttattaatattttacttaatagtgccatttattttctaagaaatattttcctacctgaaggcataaaagtaatcatctctgttatcttcaaaaacatagtgttgccttttacatggaggtctgtaagttatctgaagttgatttattttgtggaggacagtataatgttcaagtaaggaatcaactttttaaaaatataaatagtcaattatcctagcaccattaaaagtttttgtgggaaatacatacaacaaaatttaccaccttaactatttttaagtatacagtccatggtattaagtacattaatattgttgtgaaaccatcatcaccatt

SEQ ID NO: 172984 - DNA, 220 bp, Homo sapiens
agtagaaagaaactaaaaatcattagtaatcccttatccagagtaggcttgttgacattttggtattatttgctgctagcgtttttttctatttttagcctatttgatcattctatagaattttatgtattttcctctgtgagcagtttcttaggtcattaaaaacaattgtctatggctgcaaaatactcccttttatggatgtttgatatatctccta

SEQ ID NO: 172985 - DNA, 283 bp, Homo sapiens
aggtacccaaggagatacaaaggcaccatggccctttggttagaaagaagagattgtggaggctggatagaggcctccacaggatagacaggagtcaagttgtttttatgaagaaatcctggaggaggcaagctcatcacctaaagaaatgaacattatcctcatatcagagcctggaggctaaacactggttccagtatttctcattaccccattccattcccatctctggaatttagatggaatctcagcctcctctccataacctcagggtctaagggcc

SEQ ID NO: 172986 - DNA, 455 bp, Homo sapiens
agcgggcggatcacttgaggtcaggagttcaagaccagcttggccaacgtggcgaaaccccatctctaacaaaaatacaaaaaattagctgggcgtggttgtgtgtgcctgtagtcccaactactcgggaggctgaggcaggagaattgcttgaaccgaggaggcggaggttgcagtaagccgagatcgcaccactgcactccagcctgggtgacagagcgagactccatcttaaaaaaataaaaaataaaaataaaagtcttcttgatttccagtgtattcctcctgcactttttggcctgtttggaccacagatttgtggctttttatgaaatacacctgtagattaattttcagtttttttatggtagtagacagtcaaaggctagatcactgtgatgagtagggcttccacatttaagaaaaagctgtaatgaagtgaattgaatcttgct

SEQ ID NO: 172987 - DNA, 433 bp, Homo sapiens
tgggagcctagccatcataaatattggactgcccatctcctctttggtttatttctcttccttctgctcccagtgaagctgaattctagtggtcaggcccattgtattcctgcaatagctttgtcttctgctttctggaccctgggtctggtatgagaataaaacgaatctccttgattcattgacattgaacacctggccagaactcccaggctctgttctggaggtggtttctctgctagttctggccacggctgaccttgctgagtaggactctgctggcttccactgggatgccctgcatttgggtaggagaggaaagtttggatatgttaatcagattgacttttctaagcttcttcagacagaggtttggttctgtgttagttgatgtcttgtgaaaaaatagaatgtgactagaaaaatagaatgt

SEQ ID NO: 172988 - DNA, 505 bp, Homo sapiens
tgaggaatgataggggcgtctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacctcgcgctaagagcgccttactttaaggttagtttctcggatcgctgaacccggggctgaaggaccagattgagcaggaggcccagtgaggacagttactggtgaggcaggggccccgagtgcgaatcctaccgctgcgccctccttagtgacccaaggctgggaggtgagcccagccgggtccaggcctgcgccccgcctagagccctcgggggcgcaataggaagcggcgaggagaggccgcggccgc

SEQ ID NO: 172989 - DNA, 304 bp, Homo sapiens
tgcatcttggggaggcagcgtacacagcattattgtttgtgaggcaccaaccaacaccagaaaggcattttatttgtgcgcagatactatatgtgcagagatggctatctgtgaagataaatgcttcagggactttgagctttagaaaaaaatgggatctggctaaagtttctcctctctgctttctcagttactttaatcttttataaccttacacaggccagatggaaatggaggcttccactcatctaaggtgtagaagtaagtaaaccaccgaaatttcacaaatgaacacacgtggtat

SEQ ID NO: 172990 - DNA, 989 bp, Homo sapiens
ccacatataaaaggctcaaacacaacagaagttatttctggttcacttaacagtataaaatgtgtgttcctggtctgggcagctttccttcacgtacccaggaccttttcttctgcagccttgccttctccagggactcactgttacctgtgtccagactgtggaaggatgatgagtgtggagaagacatatctgcccttcagtcttggcccagaaacaatgctgatacctccactgacattccactggcaagaacagcccgtgcgccacacctggaatgggaaggatggcgaggaaatatcattgctggtgggtagccacctcctagaacttccttctctagatgggctcacaaattccagtgtcagtgagccagtgctgccacagataactattctttgaaataaggaatgccgaagagagccagttctgtgagggagtattgggaattcacaccatatcaagcaagagaaaagagaggaagtatttcaggggtgcaccacctatgcatgtcatgtgatgccaaaagcaacccaccacttgggataaaaaacagtcagctgatcatttgaccttgaatccagaaacaccgatcaaagtaaaacactcacagctcggcagccggcttgccgcttgctcatttttgcatcacacaaatccagccgaggaagcaaaggttcaaatcatggcatctgcttgcagatctctgagaaacaagggctgtggccagaggagtggacgtgcagtcagtcaatatggggtgggcttttctgaacaaagattccgagaagaccatgagcttgtcagacagaaatctaatctgcatatgtgatccatgcagtcctaggtatagattgcatatacatatacaaaatttgtttttattcaatttggaaataattgttgaccatgatttcctacagctcacacaaatgaggtaagaacaaaggtgatcagtagttaataatggactgggactgtttgaaaag

SEQ ID NO: 172991 - DNA, 935 bp, Homo sapiens
ccacatataaaaggctcaaacacaacagaagttatttctggttcacttaacagtataaaatgtgtgttcctggtctgggcagctttccttcacgtacccaggaccttttcttctgcagccttgccttctccagggactcactgttacctgtgtccagactgtggaaggatgatgagtgtggagaagacatatctgcccttcagtcttggcccagaaacaatgctgatacctccactgacattccactggcaagaacagcccgtgcgccacacctggaatgggaaggatggcgaggaaatatcattgctggtgggtagccacctcctagaacttccttctctagatgggctcacaaattccagtgtcagtgagccagtgctgccacagataactattctttgaaataaggaatgccgaagagagccagttctgtgagggagtattgggaattcacaccatatcaagcaagagaaaagagaggaagtatttcaggggtgcaccacctatgcatgtcatgtgatgccaaaagcaacccaccacttgggataaaaaacagtcagctgatcatttgaccttgaatccagaaacaccgatcaaagtaaatccagccgaggaagcaaaggttcaaatcatggcatctgcttgcagatctctgagaaacaagggctgtggccagaggagtggacgtgcagtcagtcaatatggggtgggcttttctgaacaaagattccgagaagaccatgagcttgtcagacagaaatctaatctgcatatgtgatccatgcagtcctaggtatagattgcatatacatatacaaaatttgtttttattcaatttggaaataattgttgaccatgatttcctacagctcacacaaatgaggtaagaacaaaggtgatcagtagttaataatggactgggactgtttgaaaag

SEQ ID NO: 172992 - DNA, 419 bp, Homo sapiens
atagtattttgatggtagaagtttgatggtagaattttgatggtagtattttttgatggtactattgtgaaggtagaattttgatggtagtattttgatgatagtattttgatggtagtattttgatggtagaattttgttgctaatattttgatgaggcagtaaggtgtcaattatactagggggcagcagaaagcgttattgtttagtttagagcagtaatgtccaataaaaatgtcagtcacaaatgaaaaccagatgagaattttcatttttcaagtagccacatcagaaaaataaagtacaggtaaaaataatttaaacagttaattttaactcaatatatcaaaatattatttttcagcatatagcaaatacaaaaatattaataaaatattttacttttttcatttgtaata

SEQ ID NO: 172993 - DNA, 1688 bp, Homo sapiens
  misc_feature (1)..(1): n is a, c, g, or t
ngcacattttggatcctttgggattcccccacgggagtagtcaactgggcagcaggacacagtctagagtctagtaaactggagctgatctaagcaccagaacctgagctgatggcacaactgcccagtgcccagatgccggctccccgaacacagcccgacctcatcctggttcatccagtgctggccctgtctggacgagccccaagcatcctctgctcggtgccctgggacgcctgtgaactcctggccacggctatgtggtggaagacacggattctgtggggggttttccttatctctaggactcgcccacctgctcccatgcaaatcctcattttaactctggatcccagtgaaggagaggtgtgttgtaagaagaggaaacctggacagacaggaagaaaccgagtgaggatgacgacagccacctgcaagccaggaggagaggcctcaggagaaaccagccctgggacaccctaatcacaggcgtccgcccccacaacggtgagagaatgtttctgataaaaccacccagtttttgatactttcttatggcagccccagcaaacaaaaactggctccatggcctcccctgtcctggcccctcagtctctacgacctgggcaccttgcaagcacaagaaagggaccctccagttcggggtgcccacacaccttgctttcttccttgagctctggtcaccaaggaggcaaaggggagagaggcttccaaggggcccatcatttggaaagggaaaaccagcttctgttgccgtggcaactccactgggatgctctgctatttgcacattttgaaattggaggtgggtagtgagaagggaaaaaggaaagaaaaattgagggagatgagagtatccagggcaaaagaaaggagagaaaagcaaatgaagtttaggaaaaatccagcttcggacaggtgaccctgacagtgcttaatgacctcagatgagtcccagggccgcggggacttccccattaagtcatggtggctccagccaatgtcagcccaggtcccccactgtcagagaggaaacagaggctcgaagatgagaagtgccctgcacaaggtcaccttgtgacttggaggattctccaggtaaaagcagccgtattgggggaaggcctctattcttgtaatgaaccaaacgtttgtgccaaccccccaaattcatatgttgaagtcctaactcccaacgtgatggttttatgaggtggggtctttgggaggtaagcaagtcataagtgtagaaccttcataaataggattaatgtccttataaaagggacccccaggacctggatatggtggtgtgaacctgcaatcccagtgctttgggaggctgaggtgggaggatcccttgaggccacaagtttgagaccagcctgggcaacatggcaagaccccatctatacagaaaatacaaaaattagccaggtatggtggtgcacacctgtagtcccagctacttgggaggctgaggtgggaggatggcttgagcccaggagtttgaggctgcagtgagccatgattgcaccactgcactccagcctggaaaacggagtgagagtgtcttaaagaaaaaggggccctagagagttctctggtaccctggtttcagacttctagcctccagaatggtgagaaataaatatgtattttttacg

SEQ ID NO: 172994 - DNA, 342 bp, Homo sapiens
agaagaaggagaaagattggagaaaggttggttgttggagcaatcagaacatacacacatttattaagtttactgtgttatataagtgtggttcatggtgcccccagtaattataatagcaacatcaaagatcgttgactacagattttaataacagagataataatgaaacagtgtgaaatatggcaagaattaccaaaatgtgacacagagacataaagtgagtacatactattgcaaaaatgatgtcaacagacttccttgatgcagggttgccacaaaccttcaatttgtaaaaaatgcagtatctgagaagtataataaaataagatgtgcctgtac

SEQ ID NO: 172995 - DNA, 842 bp, Homo sapiens
tccggctagtcgggtcgcgggttaatcggcgatgttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtgggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgaccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggcgtctcctcatcttcctgtcaccatccccagccgttagccatggcttcggttctggctcccggtcagccccggtcgctggactcctccaagcacaggctggaggtgcacacc

SEQ ID NO: 172996 - DNA, 270 bp, Homo sapiens
gcctcggcagtggagagctgggctagaactcagccggcctggctctacatctcaggctctgaggcagctgactgcactgggtaacctttgaggtgccaaccgtcaaggcgtccttagcctgagctttccttctcccataaagcctctgttggtccagactcaaggtttccacttgatgagccatgagctgctgggtgacttagccctgagcaggccacccaggccatttcgggcccacaggatccctggtgacagccccgtttccattca

SEQ ID NO: 172997 - DNA, 177 bp, Homo sapiens
taataaagggggcagtagagagagattactttggtgtggggagtagaaaggctcaatcatggaagtgacattttgagcttactcttaaggaattaatgttttgtgaaacagagaaaagggggcattttagatggaaaggaagcccaaaggcatgtgcttggagcatagtacttgggt

SEQ ID NO: 172998 - DNA, 589 bp, Homo sapiens
gtgttggagttgcaactgccagatggtattatgagtaagggaaagtggtccagctctacccagcttgcagagtgatttccaactcagtacttcattccacaaacattcactcatgaaagggtgcctgccttgtgccaggcactgggctgagggcccagaaaggaggacacagcccctgctcccaagtttactgagggaggcagacagataaagtcaacaattatgacagagcccgagggctttgatggaggcctcagagagaaaagacgccacagggaggggcccttggccctctatctgctcagagcctgcttaaaagtcatgcacctaaggtgcagaaacacagttaagttctccttcatcttacctcaaactcatggtcttccactgctcaggcagactacctctactatggttccgtagacaaagctttgaagattagagcagcagcgaactaaccttgatctcatcagctttgcattagaacccactctctgactggattaggggctaggttggggtggctgtaacctgaagtatctagaaaatatgatgggctagagaatttcacctttggttgtgtgctgga

SEQ ID NO: 172999 - DNA, 302 bp, Homo sapiens
ctggagtgcagtgatgcgatcacagctcactgcagcctcaacttcctgggctcaggtgatcctcccacctccgcttctggagtagctgggaccacagttacactgcaccactcccagctaatttttaagatttattttttgtagtgaggggctctcagtatattgcccaggctggtcgcgaactcctgggctcaagtgatccacccaacgtcgacctcccaaagtgctgggattctatgcctaggtcaaaataaagcatttttaaaaaagtctttgaactaaaatttctagggtaatttggt

SEQ ID NO: 173000 - DNA, 331 bp, Homo sapiens
agtgggtgcctatctggggtgtcatagaacaggaacacaaatggaattgtgttacgtctgtgtggagaatgaagaaggagtcaagactagacatagggagactaactggtggtttcaataatccaggtaaaaagagagggacctagactaagagtagcagtagagatgaagattaagtggacagattccaaaaattagtaagatcaattggacttggtcagtgactggatttagggacgtatgtagaagagacaggggttttagtttaggaccttccatggctccacatggagggcctggagccaggccctgccatgtggagccatggaag

SEQ ID NO: 173001 - DNA, 133 bp, Homo sapiens
acttcctaatatttggaagtaaaataatttctttccaaaatttgatgtggctgtgaaactggctaagacagcttgttcattttgctttagttgacagcattaaaagttacagaattgcaggctaggtgcggtg

SEQ ID NO: 173002 - DNA, 162 bp, Homo sapiens
ttacacatgccttcctctaactcctataccataagatagattccaaagccaactcgcctgccatttttcaatagccacattgcatccaagtcctaaaagaaatttttcctccagcagatctgtagtcaattttacatttcagttttaggttacctcactgat

SEQ ID NO: 173003 - DNA, 304 bp, Homo sapiens
cttcccacaccaacctcccaaagtgctgggattataggcatgagccacctcacccaccctattattattattagtcctcccaacaactcttaagaaaaacatatcatattcttatccccattttttatacaaaaagaaaattaaatgtagatttgggaatttatagccagcttttaattgatggctagcatttgaattcaagtctaattgtagagccctttcttatccaggaagactatgtaacaggagaaaggaggaccatgtagaactctgaggaataccaatgtttaagaggtgggcagga

SEQ ID NO: 173004 - DNA, 600 bp, Homo sapiens
gaatgctataaacaggactatactaaggtaaatgctgccgtaccctaaaaaggctgagccatctctactgatagttagattataaactgactccatggtggaagaggggtactgctaatgtttgcgatgtggtattctcatatgcactagacactctttagacctttggaaatgtattcttgaaatgcttggggctgaaaagataatcccagtttggagctacaggagaaagtgcaagctacagtttctgaaaaagatatccagtctttccccagacattgaagtgagatgccttgattgaggtgacacagaaaaaaaaacaactaaaggagagaagcagcatttatatactttttttctctgaaagaaaaagtagaagtaatttatcagaattgttattttgcgagatcaagagattgacttcattttggagaaggatttaaacttaaatttaataaggtcagaaacattgtgattttatattgtttacattgtattatttgagctattatatcatctctgttcttggtataatcttgtcaggtgagtttggttgggcaagtaatcctgttcaacataatccaacaaaagaaacaaagc

SEQ ID NO: 173005 - DNA, 479 bp, Homo sapiens
cctttcagagctggaaaggtgctggcgaagctcgcctggtgtgccaaaatgacctggaattggaggagtctgcgattgtggaataatgaacttcgaatgatgtgattctggatgaggacttggatcaagagaatcgcaaattaattgtgccagagaagctttcattcattcaacaaatatttattaagcatgttttacactccaggaactttacaagaaacttgggctacttggtgactttactcaccaggagtgggttcagactcctgatggatgagctccaggtcctccctaacaagactgcagacttcctgagggcacagcccacccctcatgctttgagtttctcatataacccatcatagcaagtagaagatgcttcagaacatttgtccctatgagatagagtcatattctatttagcttgggacatggcaggtactcagttgttaaataaaaaatagttattgagtaattta

SEQ ID NO: 173006 - DNA, 518 bp, Homo sapiens
gttaattcttggaaatgtctttctattgtttctacaataattttcttcccctctagcttccctttttcttctggatctcgttaggtattgaacctcttgagttgattttctaatttttgtcatctccctctctcattttttgtattttgtgtttaattttctggtatctaattcaccttgattttctatctttctggtgatattttcatatgctgtcactcttacagttgtcaaacgccttctcctgaccttgcccttgtgttctgtttactctgcccacctcttcgattctccccattgctacctggtgttttggtttctttttcttttcttttcttttttttttttttgagacagagtctcgctctgtagccaggctggagtgctgtggcgcgatctcagctcactgcaatctccacctcccgggttcagtagctgggactacaggcacatgccaccacacccagctaaattttgtatttttagtagagactaaacatacatttcaccatgttggc

SEQ ID NO: 173007 - DNA, 196 bp, Homo sapiens
  misc_feature (13)..(13): n is a, c, g, or t
cgtccactctgancactggggactctgaagctggggaggactctgaactgggctgggtggtgaagaggttgaatggctgctactacacatggtcccagcagagctccatcgaggaacctctgccttttgctttcagctcttataccataaatgaatgcccttttcttggtcgttttggtttttttttttttttttt

SEQ ID NO: 173008 - DNA, 363 bp, Homo sapiens
taaataaatattaatagtgaacagcagagggcgtcgctgatcagaatttggagttaagattgaagaaattatacagtccacctcaaagctccatttcaggcaatggacagtaagcagaactggtcacatttatcagtcccaaatttgaaaaaatgagaattttcttggacagttaagagaatttaaattttctgatttccatctataagcagtttatataaactgaagatatactttatgtacagccaccctggctaagcagcccccatactctctcttgccactatagactatactgttgtttagactttcttcatcttactcttggtccaagtatctctgtttaattttcctctccaagta

SEQ ID NO: 173009 - DNA, 355 bp, Homo sapiens
ccaggatggtctcaaactcctgacctcaagtgatccacctgtgttggcctcccaaagtgttgggattacaggcgtgagccactgtgcctggcctgatacgaattaagtgtaaagattgatcatggttgggaagatgagaccttaaatgggaaaaggacaaagactgtttgtttgcatgtgttcagaatggtgtatggtcaagtactagttgactgtctcctatcttggccaagtctcacatcagctaatatcttaacttgagacatgtcattggtagataattatttctattcattgatataataaaaatttgctatcttttaagaaaatgaaccagcagaattcttacctcagt

SEQ ID NO: 173010 - DNA, 252 bp, Homo sapiens
agaaaaaccgggaatatgaatgcaatcaccttatgattcatagtatttgtacttccaggttttaatatatcagggttttgttgtggctgttcttaaaatgtaaagctggaagccatcccagagggatgatcctgtttgttattcaagttgattggacaacccttatgttgattttcgaaagtgatgcaagaatttaaaactggccatagctttcagggatctcagtgctaataaactaaaacatgacttgta

SEQ ID NO: 173011 - DNA, 375 bp, Homo sapiens
attccttcagctggcaaccgtccatttgtaggggcagaggcggcagggacatagcctcctgcttggagctgggaagcgggggcggtgagggggacacagaggaagactacccagctccacccaggcctgcctgtgggggcacttcctgcgggatgcggggactctgatgagacccaaaggaggaatgagaaatgtgggcagagctggagccggccagggatgggatgatcccacaggtgtgagagcaagggagtgccctgtccgcacctctgctttctggtgtccccaccatacctttctgttacgtcccttctctccttctgagaggctgtcccatcccagctgcacaccattctcattgaagtgaaaaggctg

SEQ ID NO: 173012 - DNA, 352 bp, Homo sapiens
gaggtgagattctgactatcacactgattcacatgcctggggctagtcactgctgacttttgctctgcatttcctatttgtaagagaagattaggtggggaatatgccaacagaaggaaattactttgaaaaagcaaagttgaggaagaaaaggcatctgaaggattttaataatagagataacctcatgaggtctgtcctatttattaattagaaaatggcaatggtgtagcagcttcagaagaaggtaaaaatgggcggaaagagggaacaaaggagagaatataaataagagccgggaaacatggccacagcccttaaaaaggtgatcctttcatcaagacatgtgcac

SEQ ID NO: 173013 - DNA, 360 bp, Homo sapiens
tttgagttcatgagtgtagacagttctttaaggacaatatacttaacgctcatgactgagaatgatgtaattttcatccacagtcatggaaaagtgatagacaagaaatagtagcttccaaattttacataccaggtggagttttcaaattttatgtaaccattatatattctaaaggttataaaaattatacacatatggcatttagaaatgtcagaccaaggttttaaaggccctttgaacatttctagattacataagctgattatcattttgttcacgcttatacataaagaccaagaaatactaaaactctcaaggagaatatttcttgcttgataaaaatcagccaattctagg

SEQ ID NO: 173014 - DNA, 181 bp, Homo sapiens
cctcaggtgatctgcccgcctcggcctcccaaagtgctgggattacaggcgtgagccatggcacctggcatgtatttttctgttgttatttttgtggtttcctgaagaagacatgagaagattcagagctaaactttgttcccactgggaccagataatgaaatgctttttttttttttga

SEQ ID NO: 173015 - DNA, 288 bp, Homo sapiens
ccgtgaagatcggcgacttcgctctgaagatcggcgacttgggctccatcaagagtatggacactcggcgtgtgcacacgccgaaggtccagactttatcagtgtgttagagagaagtcaggccctgttctcttctctggggtgtatgttttgtgatgatggcgatgatgacagtggtgatgatgatggtgataatggtgatgatgatgagtatgatggtgataatgatgatgatgacattggggatgatgatgatagtactggtgatggtgatgacgtggtgcatgc

SEQ ID NO: 173016 - DNA, 259 bp, Homo sapiens
gccccacctccagcactggggagtacaattcatcataacatttgggcagggacaaatatccaaactttatcagtgtgttagagagaagtcaggccctgttctcttctctggggtgtatgttttgtgatgatggcgatgatgacagtggtgatgatgatggtgataatggtgatgatgatgagtatgatggtgataatgatgatgatgacattggggatgatgatgatagtactggtgatggtgatgacgtggtgcatgc

SEQ ID NO: 173017 - DNA, 552 bp, Homo sapiens
gcgtttgacagggagaacaggtacagtatatcttgggtgtgtttaggcacagtggagatagggagggctaatagatgaatgggtaagattaccttttagaatagaacaaagaaccaggaaccaaaaccctttgaagaggaactatttgttcttaacaacggcagcacaagtgggatccatgcaatgccatcccactttcccagtagagagtaaactccagattctaaacaatttgggggtcaagcagcattgcaactgcaagagaaaattctaaggagggcttagtactagacctcataacctctgccaagagcatcccctttggggaggttgaggtctgcaggatcccccagagcatcctcctgtgggctccaatcttagagtgtcagatgtctctgaccttaggtgggcactggcgccactttccatgtgttccctccagagcctgctatgagctttcctttggtacctgggtgtaatccctgacttttagcatccttgtaatttgataaggccacgctttcccatgcttcctgttccgtgaactttaat

SEQ ID NO: 173018 - DNA, 153 bp, Homo sapiens
aaaaaaaaaaacacacacacacacacacaaaccgcttattaggttaaacaaccactgtcaatgaaacttttgcatgtgcctcatactgagtaatgtgttttgcattgctaccaaggatagataacgtaaaatagtaatttacaaaacaatata

SEQ ID NO: 173019 - DNA, 220 bp, Homo sapiens
atggccggggtggctccagagttagttcctaagatacaaatctcgtcaagcccctcctctacttagaaaccctttgctggctcctcattgcccttttattaatttaaaaatatttaataactcattaacaatcacaagcctattacttgctaacataaatatagatttttgaaataaaaaataaccatgttttcccaaacagaattactgagaagagtgg

SEQ ID NO: 173020 - DNA, 130 bp, Homo sapiens
aatgcaaatcttacctcacaagctctaacctaaatcacagagacatgcatgtttcatgcattaacactcggaaaaacaccttggcccgggaatggaccgtcacaggcttgcggatgatcagcccatcttt

SEQ ID NO: 173021 - DNA, 259 bp, Homo sapiens
agccatgtgtgtctattcttgatggatgtattcctaagataggaagcatttctaggttaggtggttcattgcatcaacatcacctttttttattatctcagtcctcattccaagtctcagtgatgatcccgtgctgctctcagcctgctgaggtgtggatgatttcttcctaaactacgtcgctgctgctgttgctcttgactctgagctcaggtctttgttacaaagaattcgtcgttcagttactaaacttccttgt

SEQ ID NO: 173022 - DNA, 343 bp, Homo sapiens
caaccatgtgctttctggccatacttcacacttacttcccaactgggacagatagcatttcttaagtctaattccaaacttctgggataatctgattgcccttcattgagtcagaagccagtggatagggacatggaagatgctatagctgggctccacccttgcaggtgagaggagcagtttcaggaaagtctgccaggcatgagctgagaccttaagagatgtcagctagaattagccactgtcagtatatctgcttctgggtcccactcttcatcctgcttttcaaggttttcaaatatacactcctactcagtctcatgaaaattattatttttaaaat

SEQ ID NO: 173023 - DNA, 276 bp, Homo sapiens
tatagacagggtctcactatgctgcccaacctcaagcaattctcccaccttggccctgcaaaatactgggggttataggtgtgagctacggcacatagtctaaagtgatagtttttggtttcattttgttgagaaagggtctcactttgtcatccaggctgagtagtggcatgatcatggctcactacaacctcagcctctcaagtagctggaactacagcagcatgccaccacgcctggctaaattttattttttgtagagacagggactcgcta

SEQ ID NO: 173024 - DNA, 398 bp, Homo sapiens
tctcttcctctacagcaatgcttatgttaggcttttcgaacaagccttcctcatgcggatccctgtgtgtgctccggggacgggacgcgcaggcccttcggggttgtgtaggtgtcatctgaggatccagttgctcttccctgcctgaggagcctgagcttttatcagagctcaccgccctctcccacacagtctctttgatcagtatttacacaatgttaatgagaatggaaaaactccatgcttctttcttggtgtgaaagatccagcaaatgagatttctaaaacttgagttttaaaagttttcctgcagtttaggaatatcgtctactttctaataatttcaagtgaattttgagtttaggagggcatgtgctttttctaagttggaaaaattt

SEQ ID NO: 173025 - DNA, 311 bp, Homo sapiens
agaaataacatctctgctggagcactgtccctgttgcttcccccatcaccatctacgcagaccctcccctggccacacagcttctgaagtgcagccacacctaccataggtgacaggcgggttctgtcggggcacagcgccgtgagccggtgcacgctgagattaatacacagtggtgcaggtgtctgggggcttagggagatgctcatttggccatcctgcctcgctgaggtcccagcagctccgcctggccctcaggggcactcctggtggctttctagatgctcactgtccctccccttcctgcccct

SEQ ID NO: 173026 - DNA, 581 bp, Homo sapiens
tcctatttgccttaagaagcctggcagagagtattgtttaacttaacaaaacatagtcacagttttatttttcaattaaattttaaagccgggaagaaaaatatctctcagatgtttagagaaagaatagctaacaagttacaaagtaaattaaaatataaaagtataatcccacataaaattctgaacaaatttaagggcatattggcatcctggaatctctgtaacaaaataagtagatttgcaatcacctaatattaacaacagaaataaaattcaaccacctcactcacatgaaatttctcaattctttaatatctttacaggtttcacgggtccacagctttggttaggcagaaaaaacagcactgtgtctgatcaggcttctgactctaatattaacagaagggagaggcaacagcaaaaattgagctacaatacacaattctgaaatgctgccacggaaaaaagacttagcactttttcctaccatttccattttctttgcaacaaatctgtcctttaagactaagatgttaagatatgacttatccttgctgaagccatctccttataaatgc

SEQ ID NO: 173027 - DNA, 545 bp, Homo sapiens
tataatccaaattaaagagggtttcagacatcagggttaactttcctactctgatgtcactgatcgtgggttgcattgcagctgcagaggattccctccaccatcctgggacatggacaaggtaacaccctgatgttaacgtccaacactaccttcagaatcccagctatattactccacctcttcctacagccttccagcccacaaataaagactcttccccatggaggctacagcctgcatgacacattgctatgggaaccaactccaaaattagcaaacactaagaacaggagaactccaaaacagagagaccagagtggcaagcataacgttaggaggcaagccgagaacacactgttgagggctcagagccttactgacaagaaaaccagagtctaagaaattcatcattttcattcttatctcctgcctaagatttttttaagtctcttaagcctaggaccattggctctctctctggaattctggaaagggcacaaatttgtccttaatagaataaactgtgtgttggggataaatca

SEQ ID NO: 173028 - DNA, 334 bp, Homo sapiens
tatcactctctaagctcagccaaataagatctccatgagtacagctgtgaacattgtatgggacactccaatagcaacactagacagggatcccaacgagagaccagagtggcaagcataacgttaggaggcaagccgagaacacactgttgagggctcagagccttactgacaagaaaaccagagtctaagaaattcatcattttcattcttatctcctgcctaagatttttttaagtctcttaagcctaggaccattggctctctctctggaattctggaaagggcacaaatttgtccttaatagaataaactgtgtgttggggataaatca

SEQ ID NO: 173029 - DNA, 500 bp, Homo sapiens
ggattatctttttaattctcttcggtgtatacctagaagtggaattgctgtgtcatatggtaactcttatgtttgtcattttgaggaactgccaaatcatttttcaaagcagttgaatcactttacgttcccaccagcaatgtatggcactttcagtttctccctattcttgccatacttgttattttctgggtttttttttgcctttttttttttttcttaaatggtagccatcctagtgggtgtgaactggtgtcttgtgatttttagtttgcatttccctgatggctaatgatattgagcattttttttgagctgttgaccatttgcatatcgtcttttgaaaaaatgcctcttcaaaccctttgccctgtttttattttttattttcactttttgagacagtggcaccatcccagctcactgcagtgtcgacctcctgtgctcaagcaatttttccccctcagcctgctgagtagctgggaacacaggcatgcaac

SEQ ID NO: 173030 - DNA, 658 bp, Homo sapiens
gaatgcaagctcctgcttcccagaggacttgtctaagtgtaaagtgtctgttatttaattccttgccttttgtggtgttttctttgtgtgtcctagcagatgcttctgtctttaggtaccatgtcacagttggctaagatgtacttgtctctgtgtattctaaccctggtatatatgccagaaacatagcccttttctctgacagaccatgagcacatacggtaggctccaaacactgaaacattacacttgtaaaggtctgagagggtagtaatgggtttcactattttcaatatttcatagactttataaataatcacatatttattggtgactagttaactacaacatcaagcctctgtaaacttagctagaattatatcaagggtgacaatattagttaccttattttgaacataagtgttagcagatatatgtctcataaattaaaaatgagcaactattgaataatgaatagagtaatgctgacagatttgttgaaaacatgagatctatcaataaaaatgatgaaagtagtcctgataggtggtagaaagttttgagttaatttgtggcacaaagacacaattattcatttggtctatggaccttatttaagtgctacatttcatagtaagaagggcttttaaaagcaaag

SEQ ID NO: 173031 - DNA, 210 bp, Homo sapiens
ataaataaattatgatatatttacatacaaataaaatagcaaaaatgaatgacattgatatgcatagccacatggatgaatttttgaaaatattatcaaggaaaaagagcaattcaacaatatgtacagattgattccattacaaaagtttataaatttgtaaaaactgtgtgtattgtttaaggttatatatgtgtatgtgtgtgtgta

SEQ ID NO: 173032 - DNA, 462 bp, Homo sapiens
tataattattttttgtaaaagggtggaaagagaaattgcctcagtttgttcattcatctgaattacattaaattacttgactgtgtaagtcagaagttctggaatatgaaacaaaacgtattaattggccaagtcccagtctgtgctttatacaattagcccaatgttacaaaaacaagtatcccttgttatccaaatctattcagtttctgagtttggaaagtgaaaggtcaaacacagagtggtaactgagtttcctttggtcagagaggctcaatatctgacaagctagcaattacttctttcttcaaagcaaaataagcatcaatataacatagctttctgcttttaccactaatcaatagcccgagtcacaggattattggcttgtatatttaagtgtgcacctgtactattaggcatttaaggcaaaatttgacactaaataaactattacatcta

SEQ ID NO: 173033 - DNA, 548 bp, Homo sapiens
tggatttgcaatcaaggttaatcaaacttagtatctggtttctctttatctgattatagaatcttacatggcaaaggagagctcttttgaaatccactcctccctcccaatttgacagaggtcaaccagttctagaaggtttccgggctcaccccaagtcctcagtgagggagacctgtgagacgtaggccatcgaggatggtgaaccaattttcatggtcttagtttcacaacataccatggccaatggtgggtcatctcttaatttaaaactagtgacacctcccagttgggatcccatttctaccttttgcccagccccccatggtctattctcatcactgcagtcaaagcgatccctaaaaaaaaaaaaaaaaaaaaaaaatctctggtcaggaatgctgccgacgagcatcccggcttaccttggggttagcttggccggtcgtgcctataatataaatctcccaaaatcagttctaagttgggtaacatctctgacatgtgcggtggatcccggcttacatctgaaccattcctccgtcgta

SEQ ID NO: 173034 - DNA, 568 bp, Homo sapiens
tgtcttttcctgggttatttatttgtagaaaccactctggtttcctactacttcaaatacacctacaggaagccactggcaggtggggttctaacgcataggcctgttttactgccctgggtgccaccggctcattgtgatgggatcagttacctggatccctgcacgcaggtgaaatttacagccctgggctatagaacaaaaggccctgttctgtggaagaaaatgggttctgataaagctagctgggaggagaggccagaaacagggagtcctaggttctagtcctgggagaccttggcagaccttccctgggcctcagtattctctctctaaagtgagacccaggaaaatgcatattttagtgcttacccagggccagggagctgtgacagagatatgtaaggatgacagttcctgactgcataatctcagcttgcaatcctgagctccgggacccctaactcaccactaggggaccccaggattccacataatcgctttcccctccaacccaacattttgctatgaaaattttcaaacacacagccaagttgaaagaatctca

SEQ ID NO: 173035 - DNA, 261 bp, Homo sapiens
agaacccccttgatatttttctctgccctttggcccttggggaggggggcatgctgagataggcaatctgatattagccattggcctctgctggggctggctataatcagatgcttgtgccacccccaatccactggtgaccaagtcctgcccacatcattgagctaatgtctcccatgctgtctctgtcctccctccatgatggtggctccttgctaatctctcacctgaactggaagcaaaccacctacttagatctgg

SEQ ID NO: 173036 - DNA, 511 bp, Homo sapiens
tttcaagaaaaatatcctttaaatattggataaatatgtaaaaatatgtatataaggatgttcattacagtattatttatagcaacaaaaaatagaaataacttcgatgttcaacaataggggattgactcaacaataggtgattgaccaaattgtaaaaactatacaatggaatcatgaatagtcatgacaaattatgttgtagaatatctcccccagctaaaaattagttcaattcccagctctatgaaggctttctgtctgccctggcctaacaggacctcttcctccttgaagcttattcatgcttattgtctacagcatcctctggcccccacagtggaagaacaagtgcagctcacacccggctggctctgagctgtgctaatggaaggggagcggagcagagcaatcctgaacaatagataattcattcctttgtaaatgcatcagataatttattttgcagtggattcaccttcctaattagctttccccatgttagtattaa

SEQ ID NO: 173037 - DNA, 637 bp, Homo sapiens
ggcaatgtccccagccgactgagtgacaagggtcctcctcagaggctaaagccagcatctctccagttcagttgccctgactgtagatgggtgctgtgtcctggggcctgggatgccctgagttctcgagttaaccgctgtcagtcatgtgccctccagggcagacctcaagaaggaggcagttccagggatactgcttattcagctcaccaggctcgcaagggtctcttccctacttccgatccaccttcagttgatcaccctggccttgcctggagagggaatttgaaattctgtgccctaatcctgactgcttctctaggatttctttggacctttcgttgagatgctgatattgaagaaaaggtcgtgtgaagtccatgctcaccctgttaagaagtgtttgtgggtcccctgctaaagcagaactgaaaccctgtttctgtcattctgtcagctcgtggcctcaactgggcacagcgcttgggttccctcttgtaccctccctcttggtgtaagggatggccctgaagaaggtgaagagcaatctatgtgatgatctatttcatttattagcccgagtgaaattggaggcctcttttcttttacagagtcattgtcgagcaaggtcagtcca

SEQ ID NO: 173038 - DNA, 489 bp, Homo sapiens
atatggcatttgcgtaggtagatcaacagtaaacttctacatacataggcactgagtaggtgtttataaaatgctcactgaatcaatttgtcaggacaaaactaattctggaaagtgaaatacatggagtcatcttcctgttttccagctgtagcctgtcagcaccactacctccactgtccatggggatgccaactctgcccttacttttggccataatatctacagaggcctgttactactgtgacctgggcttcagatgactggggtcctgttgctcctccattcttgactcctggctaagcctttcccagccatccacatgcaaaccttagttgaaaaggcctagtcagggatcagcaaatgacagcccatgggccaaaactgaccagctgcctgtttttataaagttttattggaacacatccatgctcattcacttatgtattatttaaggctgggcaacaagagcaaaacgccatctcatta

SEQ ID NO: 173039 - DNA, 406 bp, Homo sapiens
gtaacacaataatagtgggagattcgatactccactcaaagcactagacaggtcatcaagacagaatatcaacaacaacaaaaaatgaacttaaactataccctagaacaaatggacttatcagatatttacagaacattttactcaacaactgcagtatatacattcttttcatcagaacatggaaccatctccaagataggacatataataggccacaaaacaagtctcaataaatttgagaaaatcaaaattatatcaagtactccctcagactagagtggaataaaattggaaattaactccaaaaggaaccctcaaaaccatgcaaatacatggaaattaagtaacctgctcttgaatgatcattgggtcaacaatgaaatcaagatgaaaattaataaat

SEQ ID NO: 173040 - DNA, 637 bp, Homo sapiens
tggataaacaatgcctcacaggagagaaataaagcattcaaaggaaccctctgtcaaaccatgtccaggattctagaactcaaattcttcgtgttgactaagatggcaatttgttacttttaggtcattctaaatgaccacccgggacaaaagtgaagcaatgctgagaaatctagtataaaactacataaagaaaggtgcatcctgcaaaaaccctaagaaaatcaaacaaactcctgctgaggcaggagtctagggtttctcagaagaaattcagcaaagataacaacattgctggaatcacctaattcaaatacagaaattagtacttcaatgactacaattctttgaatgagaagttcattgaggctgctccattccattacggatggccaagtaaacacttatatgattcactttcattccctgtttagcaaatctaggtaatattattaacacccccaacaaataaactaagttttcaactggcatagctttaagtgccccttatacttctaaaggtaggggtacctacttttgggggctcaactcacccccaaattccttctttagagaggtaaggaacaaagattaacaaggctgaagagtataaacaggtcggaaagcctccaaaaag

SEQ ID NO: 173041 - DNA, 270 bp, Homo sapiens
agggagaggaagggagttccaggctgagaggagtgagtgagggaaagtaggagtgaagagggtacccagaaactggatgatccagcagctttagttcagtggggtttgaggcacttgggaactcaccaaggcgaacctgccacaagctacccagggtctccacctgccaaccttcagcagcggctctaggctgctgatgccagctcctcgatgtgtgagctcctctggccttctcccttggtgagctcacacattcatcatcatttacag

SEQ ID NO: 173042 - DNA, 375 bp, Homo sapiens
ccatgttggtcaggctggtcttgaattcctgaccttgtgatctgcccgcctcagcctcccaaattaaatgctttttacatgatcctattttgaaatatttatgtatgacttgactgagatggctgacctcatatgtcatttctgagactaaacattacttccttacttggtatgatgtttagtttgttttgatacaaatacctcaaatctggaaaggatattgaggatattgacatcctgtatccaaaaagtttattcctgaataagtgcgtctgactactttataatgatttccaaggactgaaagtttatgagctctcttagtgacctcttccagtgtctgatcaccccgtcagttcaagtacagaatggtat

SEQ ID NO: 173043 - DNA, 474 bp, Homo sapiens
ggtcacctcgcgccgtataagagaacaaggatggtccaggatcagtccaggattacatattgcatttggttgctgtgtatcttcagatttctttaacttgaaatagtttctcaactttccatcatctttcatgaccttaacattttttttatgagtgcagcccatttattttgtagaataaatgtagaatattttgtccttctgtttgtggttacctgaggtttcttcctgattagtgttaggtcttacaattttggcaggaatcctgcagaagtgatactgtgtccttggtatattagtgtgtcatataaggatacatatgacattactggtgatgctaattttcatctctggttcctttccctttgtaattactgagtatcctatggggaggtactggagacaatgtaaatatcctatttttcatcaaattttcaccaactagttttagcatccattgttaattcttgactg

SEQ ID NO: 173044 - DNA, 280 bp, Homo sapiens
cgatatgagtaggagcataacttaacattttttttatgagtgcagcccatttattttgtagaataaatgtagaatattttgtccttctgtttgtggttacctgaggtttcttcctgattagtgttaggtcttacaattttggcaggaatcctgcagaagtgatactgtgtccttggtatatgtatttgtttttgtaccagtaccatgctgttttggttactgtagcctagcagtatagcttgaagtcaagtaatgtgatacctccaactcatatcaaaca

SEQ ID NO: 173045 - DNA, 558 bp, Homo sapiens
tgaacatactgcttccctcacgggctggtcaccacggcaggcacaggacagcagagcatgtcacaggccctgatgtccaggaaagcaaagtctttgcagtggaggcaggcacaccaacactcgcaacacagtgtggcaaagaaaagcacagggtgggagtgaggggatggggactacccagagaaggggatcccagaagaatttctgaaagaggtgacttctgtgcttcattgtaaaataaagcagggaggtagaagggagggttttggatacaaaggaaaggacaagggccaccttttcttctcactacagcatcagcgtcaatcgagcatcaagcagtagtcgagcagaccgtgcagattcagccactggacgaatccagtgaaactggtctaggatgcatggttactatcactgccccaggactcagggatgcccactctcaagtagatagccattcgctcacctgttgtggcctgttgggagatggaacagcctgtctgctctgctcaagccttcgcctagccccatgcagtacagaaaagcccttctctctgg

SEQ ID NO: 173046 - DNA, 167 bp, Homo sapiens
tcctggccaccccacatggcacctggcactcagagtcggcctcctggcctccccacatggcacccggcattcacagtcggccctcctggcctcccctcctcgcctccccacatggcgcccgacactcacagtcggccctcctggcatccccactggcgcggctagga

SEQ ID NO: 173047 - DNA, 207 bp, Homo sapiens
ccatagttttagaagtttcaatagcgacgagagcgagagagggaacgggagcgagatagataaatacaagatagctttttaaataggtttttttcttaatacaaatatacagtatctataacacatatttatgcaacattccctcccattgctccctggggataaattaagtgcacgggtttataaatagggtatacaaaatgaaca

SEQ ID NO: 173048 - DNA, 580 bp, Homo sapiens
ccttttagttctgggaaaaataatctgtcataaagaagataaaacatggttgtgtgggaataaatgaacgccggccccgtgagcgcaggcagaggctgttccctccaagcccgctctgcaagggcctgggcgccgtcctgcccgcgtggcgaaggctcctgggggcacgggagcaggaggcatcatggagaagagggaagctccggggtgccgagggggtgctgtaggcacgcggagctgtaggccggctcgccacagtcaggcccttgtgtgatgggtcaggagagcaccgttctctgatgggtccgaaattgaaagcggtggctaaaaggagggcagcgggaagacaccgatcaagtcctgagcatttggggccgattgctgcagaggtcacagtttctcctcctgggctgcagactgtgggtcagtattacagtctaccgttgtttatatcatgtggttaatatcaagcatgcgagcctccctgtttcctgggaactgacgggtaccctcaatgctcctggtagattgtttatatacaatctaccattgtccatttgtgtattcagtctcattttga

SEQ ID NO: 173049 - DNA, 194 bp, Homo sapiens
tcgaactcctgacctcaagtgatctgctcccccctcggcctcccaaagtgttgggattacaggcgtgagccaccgcacccagccttcattgttattttatgtctgtttacttattctgtctccctccatcaaaagataagccccggggctggtccaatggtagtgggttatcagaactttttttttttttttat

SEQ ID NO: 173050 - DNA, 192 bp, Homo sapiens
tgttatctgcctgcatcaaacctcactgtcctcatgtcatctgctctgaggatgagggccagcttcacagaactccggaaatcaccaggtcctagtctccagttgtataaactgcactgccctgggctcctaattccttcaagtttgttgtgttgtatttttttttttttttttttttgacacagagtcttg

SEQ ID NO: 173051 - DNA, 928 bp, Homo sapiens
ggtaggagacgcagccccccagtctccctgggcatgaactctctgggttttgagtctgaaaaattccagaaaagggattcattggcccatcttggatcaggggctcacacttaggctagtcagctgtaccctgggggctgtcctgccataggtggggagcaaggggaagatgtgttctccagaagagagctggtggagggcagtgctgggctgtcatcctcatagcaggcccctgcagtcactaaatcatatatgtgatcatgagcttgtgggtgatgtcctcagtctatcctgagtcattcagagaaggttcagctggaagaaactcatggtctatgtgtactacatagaatcaaatcctcttcttcccctgaacacagagagtgattgtggtgagtgaaaagtgagtccacgtggactggaggagttgggcaggttttacagagtgggggttgtgtaagacagacgatgagaagacagctcagggcatcatgtatggaatgaactggaaaaagattggagacagagaaactgctgcattacagggtagcagggatgcaaagggagagcccacttgaaaatgattctttatggagattggatgtggagagaggaaggggaaggggtagtgagagaagaggaggaagatttgggtttctagatttgtatgatggtgattcccttaacctgagacaagtaatgtaggtttgggagaaacttggtgactttgactttgatcaggactagagccctgactctgactttgaactggagccctttgaactctagccctgaaaagggtcagggctagagatgaaggttgagaagtcattagataggggagtgtgtattcaaaccaggagtccagaatgagcttgtccagaaaagagtatagactaggaagagagaaggggtacagcataggact

SEQ ID NO: 173052 - DNA, 864 bp, Homo sapiens
gtgcttttatctcaggttgcccaatggataagtacattactttttaactctatgcctgattgaccaaggtaaagctgaaagagtctcatctgaactataacccaagtgggtaagccagtcccttggcactgcccaggaagaagatatggatgggaggactactccttcttgaatgcagaggataaaagttatctgggagctcttttacgattgttggagaagataggagaaagtgaagaagggaagaagagaaaaaaacagagaagaaagaaggaaaagaagatagagggacaagtagaagaaggaaaggaaaggaaaagcaaggaaaaaggataacctgtcctctttgactagtaggctcaccaactcttctttaccatggaagggatttcagtaggaccaaaggcttttcccatgaaatagtattttatcttgataagaacctagcacattggttaccaacctccttaaattgattccctcaaaaggaagaaagtgtatctggaaatcctctgaaacttccagagtcccccaagcccagtgctatttctaccaggggagaaagcagagctctttgtatatatgggtaggagcaaagtaagattctcctccccctttccccaaacccgaagcagaagtttctcctgagatttcaaccagtaaaatcaccatataatagattaggcatcctgagaagttcttaatggaacgagagctctcactaatcaaagcaggaaagaacagggccttgaagaaatcagaaatctaattagggtggaatttcaagagatctgactggatgttaaataagttgtagaagcctcatccaaaggattaactcagtgcagagacaacgcagaagtg

SEQ ID NO: 173053 - DNA, 300 bp, Homo sapiens
tatatcaactttctgtgtcaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtggtgagccaaaacatagtctttcagtttg

SEQ ID NO: 173054 - DNA, 406 bp, Homo sapiens
caggcagggacttggccccgggaggccgccgtgggggcaagagctgggcctggagaggcccctgggaggcaagagtggggcctgcagaggctgttctccaaccagtgctgggcctgtacaggccaccgggaggcaggagctgagtccaaagatgttgttgggaggccagagtcgggcctggagacgcagccgggaggaagagctgggcccggtttttcacttctggcagcctcttggcctctaatttttttatcttttgtgtataaatcccaaaatatggaattttggaatatttccatcattatgtaaatatttgggtaggtaatttatttggagtgagtttctgcaccaagcccgaattttttattttattttccttattatttggtgttaaacaggtttaatg

SEQ ID NO: 173055 - DNA, 261 bp, Homo sapiens
tggaaaatgagtcagggtggagtaagtaatcgaaataagtctgggtggagcaggtatcagaatgagtcagggtggagcaggtgatcgaaaaaggttgctttacggagaagtttaaaagtagaaggcaaagaattaaacatactgacatattgattttttaaaaagaaatttaaaactcatatctaacaatcacttgaacccgggaggtgaaagttgcagtgagccaacatcgtgccactgcactccagcgtgggcgacaga

SEQ ID NO: 173056 - DNA, 278 bp, Homo sapiens
aaagaacttaaaggccaccagcatggaaaagggattttacaatgtttctggcagcctgcaagctgataaggctatgtgactactaaattagtgtgggggctgcagctggggaggctcaccttggagactgaatgctgggtgggtaggagtcccacgtggggctgaaaatcacagggttccatgggatgcctatagtcagatcacttcacggattctctccttcttccacccctgccgtgggtacaaccaaggactagaaaccatatatttatccctct

SEQ ID NO: 173057 - DNA, 656 bp, Homo sapiens
ccagtatacagtctgtgttttatatttcatgcatagtgaactacataactaagggcaatgcatgtacatagaattgctgtattgcctggctgttatataactgtagttgtgatatcataattgaaccctctgacactgttagtcaattcttttttttttggagacagagtcttgccctgttacccaggctggagtgcaatggcatgatctcggctcactgcaacctacgcctccttggttcaagtgattcttctgcctcaccctccagagtagctgggattacaggtgcctaccaccgtgcccagctaatttttttgtatttttagtagagatggggtttcaccatgttggccaggctggtctccaactcctgaccccgtgatctgccctcctctgccccccaaagtgctgggattacaggcctgaaccaccgcatcctgtcgttagtcaattcttactccttataatgctgtgtatttacttgaactcatacatcagaaggtagtgatcttaaatgtatttcagttcttatagtgtgtgctggtggtaagtagaagttgtggcttttttcttaagagggattgtttagaggtctgctggctgtataaatgtacttattatttcgttgctagtcttatcatgggttacaatatttt

SEQ ID NO: 173058 - DNA, 757 bp, Homo sapiens
taaggaggtgaaattcaacagaactattttggggtggagatcttgaggcccacagtttgtgagtggagtatgtagatttttggtttagtccttgtagctatattgtttaggaataaaatgggaggcaggtttgtctaacacaggtcccagcatgacttttctctttggatagaattgctgtattgcctggctgttatataactgtagttgtgatatcataattgaaccctctgacactgttagtcaattcttttttttttggagacagagtcttgccctgttacccaggctggagtgcaatggcatgatctcggctcactgcaacctacgcctccttggttcaagtgattcttctgcctcaccctccagagtagctgggattacaggtgcctaccaccgtgcccagctaatttttttgtatttttagtagagatggggtttcaccatgttggccaggctggtctccaactcctgaccccgtgatctgccctcctctgccccccaaagtgctgggattacaggcctgaaccaccgcatcctgtcgttagtcaattcttactccttataatgctgtgtatttacttgaactcatacatcagaaggtagtgatcttaaatgtatttcagttcttatagtgtgtgctggtggtaagtagaagttgtggcttttttcttaagagggattgtttagaggtctgctggctgtataaatgtacttattatttcgttgctagtcttatcatgggttacaatatttt

SEQ ID NO: 173059 - DNA, 404 bp, Homo sapiens
atttggccactaagtggcctcctaaatggctgatttctttttaaagtatgaagattgtttgctgtggcattattaattacacacagatttgtaccactttcctccactagaattaaggaaatttgtaaaaccaactcgtggtcagactccagcaaatgacccatcgttttccaccagtgtctctgtttctatgtaaaattatagattaaacgccaagtcctctgcctccacctgtccagggtaagtaaccacctccagaagtgagaagctgggagtggctctgagaggggctgactcaagtattctcctaataaataggggcgggcgaagcatcagggcgaatcccacgtgaggcagaaaagtgagctgaactatcctggagtgttttgttgcattccatatct

SEQ ID NO: 173060 - DNA, 698 bp, Homo sapiens
  misc_feature (357)..(357): n is a, c, g, or t
  misc_feature (366)..(366): n is a, c, g, or t
gtatcattcgatgccagtagctggagttctacctcatttctaattcattttattgtagtgtaatttacatacaatagaatgcacatattttagttataggttttgatgcaattttatacatgtttaggcctgagtagcctaccttgatcaagatgtagattttcccaactccgaaaagctccctgtgcccctttgcagacagtctggcctgccccatgctcagcagtgactgacctgctttttctactgtagattgtacagttcatgcaaatggaacaatacagtggtgtcctctgttgccctctgtttttcagtcaatgagtagtacttccatttatgaataaaaaatattcttcnccccaaaancccccctttttccaaaacccaaatttttttttttgaattttttattttttttatatcacggacgaagaggaggggggggaacagaacggggtcgaaaaaaactcctcatcaagaatcgcggcaagacaagcggggagcaaggcttctttgatccatcatcacccccacactcgtttttttcacacccacagacaaaaaagggctgccttctcggtggtctggggggggggagcgggtgttctgatgagggagatcaacgacatcattctgcaccacacgagtgtgggagttatttacatcctgtcaaccatccccctcgaggaaacacaatg

SEQ ID NO: 173061 - DNA, 258 bp, Homo sapiens
atggtcttgatttcctgacctcatgatccgccggcctcggcctcccaaagtgctgggattacaggcgtgagccactgcacctggcttcagaagaatttatttttagtcttttccttaccagtttttatgaaacaactgggcaagaacactgttagatttcaccaaaaaattgtgatgaatcattgtctttatgatcccatttttgaaaattgacattttaattgtaaaccaaaaataaaattctaagcccccacaact

SEQ ID NO: 173062 - DNA, 670 bp, Homo sapiens
ggaacaacttaattaaaacaagcctcaattttaatacgtttcaaatatttcttcctggggaaactttattttatgtgcattttattttatttgaaaattgacaagttgtataataaattagatgttatactgcaggacaagatatgtattattaaacaaactgcaggacctcttaaaagtcagaacaattgagaaagctgttccaaaataatatcagtaagtttagaattatatagaataaaaactgaaattgctgaagaagtttaaaatgctttctaacggggggggtcaatggaacgtaatatacgactaactacaatttcaaaccacgtgtgttttattacaccttacacattctcaaacaacagggggttacgaaaacacacgtaaaatctccaaaactcccaatttcccttaaattttgtcaaacaccttcggcgggcacaccaatttttccaaaatcttttttccacaaaccttcttcttccggccactttcctttccttcccagccacaccaccaaacaacgtttctttaacacttataccccccccccctcacagacaacacgcataaaacactgttcagcgccagccctgtcccgtctccccacaaccaaccctaacaacacacacacaacaacatcacaccacaccaccatttatagaga

SEQ ID NO: 173063 - DNA, 888 bp, Homo sapiens
tgttacttaattatcatacccattgaatcagattttagaaagtgtgctggaggccgggcaaggtggctcacacctgtaattccagcactttgggaggtggaggcgggcagattacttgaggtcaggagtttgagaacagcctggccaacatggtgaaaccccatctctaccaaaaaatgcaaaaattagttgggcatggtggcacacacctgtagtcccagctacttgggaggctgaggtgggagaattgcttgaacctgggaggctgacagatgttgcagcgagctgagattgcggcctgggtgagagtgagaccctgtctcacgaaaaaaaaaaaaagaaataaagaaagtgtgctgtgtgctgggaagtaggactttgtgaaagattaattttactcttttccaatatgggtattgattgttctattcattcttcaggactaaggcaatctatttcaaaaaagaaatgagtaagcctcacttacctgcataagggcttaaggaccatggctctgggaatgggtaaatgtgagatgaaaagcaaatctgagactatgcccccaggcctcctttatatttccctgggcagggatcattccttatctcaacctctcaactaggaggaaagtggctgaaaggtaaaggaagctgtttccttcacgctgatactcctgtgcacttcatgaccaactcttctccaatggtctgtctgtggaagggggacaagttctcctgactgtcttcccagacactcacacgatcagctccacgggtgctcgcatgcagattcagcctatatgtctgtctttctgactcttttctaagaagctctgagccttttgcatccaccagggcctgcaggaccgacctgctgaaagcatagaag

SEQ ID NO: 173064 - DNA, 461 bp, Homo sapiens
tgttacttaattatcatacccattgaatcagattttagaaagtgtgctggaggccgggcaaggtggctcacacctgtaattccagcactttgggaggtggaggcgggcagattacttgaggtcaggagtttgagaacagcctggccaacatggtgaaaccccatctctaccaaaaaatgcaaaaattagttgggcatggtggcacacacctgtagtcccagctacttgggaggctgaggtgggagaattgcttgaacctgggaggctgacagatgttgcagcgagctgagatagtgccactccactccagcctggatgaaagagtgagactgtgtctcagaaaaaaaaaaaaaggaaaaaggttcagatggggactaaggaatgaccatgggatgggggacctgggagatcttggaccacggtgagagctgtgtgtgtgtgtgtgtgtgtgtgtgtgtgtg

SEQ ID NO: 173065 - DNA, 163 bp, Homo sapiens
aagtcagggcaacttctggccaccagagtcccagcattagcaaagttgcctgggcacttaatcaccatttgccacaaattttctgaggaatatgctctaaatgcatgccctaaaagttcaatttttgaaacacagcaatactacctatttgtaagacaggctc

SEQ ID NO: 173066 - DNA, 164 bp, Homo sapiens
gtgaaactgacagggattaattgctggtatcactaagaaagtttagaggaagaggatttggggttctaaactaaggtttgacaggaaaaattaaatgcaaacttagattaaacatacatttcaaaacacaaaatttggaagtaaaatccgttttggtgtaaaac

SEQ ID NO: 173067 - DNA, 191 bp, Homo sapiens
aatatttagcatgtgataatttagctagggaaaaaatacatgtataaaaccaaactatgtggtccacggttcactctatttaaaaatacgtagtcctcataatattccctttaacagcctgttgtagctctttggtgttcagcccaagcacatctgatatacgctggtgccatcaccaggaacatgtgtcc

SEQ ID NO: 173068 - DNA, 538 bp, Homo sapiens
cctaggggagggagtagcaggcagcagtggaacagctcccaacccaactcaatgaaagtggaagtctttgatttgatatgtgtatgagtgtacacatatatatgcatactcacatgcactcacatacatgcacacataatttgctctatacacctgattttctttgaagaagtgctctgctgctaaagataattttgaaaaaagatcaatttaaaaattggaaatatgaaaaccaggatttgaatagagagaggaaaaaaattgggaagaacagcttgagtagaagtaggaaaagggaaaagtagaaggagggcatgggatattgttttaccttttttgcaagcaatgtattaaattattcattggctcaatttatattgataaatttataaattatatttcaaaataaaatttatgccatgctatgcccttgcaattcttttactgggtataaataccaaagccatgatcaatatgaccattaaggagcatattcaagggtaggcagtgtatagttgtttatttgctagggagttga

SEQ ID NO: 173069 - DNA, 311 bp, Homo sapiens
ttcatagattttcaagctttaactcttctatctatctctgaatcatttactattcatttttaaaggttaaaaaggcaatctgtctttagaacagatatcctgattttaaagtaagtattttatcttcatctgttttcgttatataacgattaagcatggaacattgcatttcttgattacttgttcaaatacatgcattaatttttattgtcataatttaaatcatgaaaattaggggtaatgcagatactatgaatttgtattttattataagatttaaactgttttttctatttataataaatgatgag

SEQ ID NO: 173070 - DNA, 473 bp, Homo sapiens
ggtgattaggtcatgaagaccagagccctcatgaatgggattaatacccttataaaagaggtcccagagaactgccctgcccctcccaccatgtgagccagaaagtgggctctcaccagactttgcatctgccagcacctggatcttggacttcccagccactagaactctgaagaataaatttatgttgtttataagccacctagtttatggtgttttgttataaaaacccagcagactaagatgtgatctaaacaaactaattaaaagacagaaatttataaacatgcattttacaaaaagacccaactatatgccttctgtaagtaatccactttaaatgcaatgacattgatattttaaaatgtgataaatgtaatgaaaggatggaaagcatacattatgcaaatactaattaaaagaaagctagaatggctacattcacatcagataaatatcagaaacaattaaaa

SEQ ID NO: 173071 - DNA, 152 bp, Homo sapiens
tctcctccctcttcattcagaaagttctcctttctataggcccatcagctgtgtgtcagctcttattcttttctccagtttttgagcccttcaaggtttttttaaaaattatttatatctctgtgatgcattctaggtgatttcctcagaag

SEQ ID NO: 173072 - DNA, 707 bp, Homo sapiens
gaatgggtggtgtcgctatatagaacctgctgattttaactataatctttagctgataaacttttcattttcattttttttaaatgaaacaggaatatccaaccataagatctgcaactaaatttttattattacacatttttcttggaagaaaatcagcatctgaaatatataatgtatgacttcaagtggagcactgtaatccacaagcagactcagatttgggcacttcaggtgagtcacatatggaacacagcattctttgcaaaaattaatcttttggccccattcaatgtggttatttttggccaggcacagtggctcacgcctgtaatcccagcacttggggaggccaagactggtggattacctgaggtcaggagttcaaggccatcctggccagcatggcaaaaccctgtctctactaaaaatacaaaaactagccgggcatggtggcgtgcgcctgtaatcccagctacttgggaacaaagcttgtttgtttgtttgagcagagtctcccactgtcacccaggctggagtgcagtggtgtgatctctgcttaccgcaacctccgtctcccatgggcaagcaattctcgtgcctcagcctcctcagtagctgggattacgggtgtgcaccaccatgcccagccagttttctgtccttagtagaatggggttcaccatgtggcctcaagtgatccgcct

SEQ ID NO: 173073 - DNA, 127 bp, Homo sapiens
gatgaaagtctttctatccgtatttgagtgccacatcaacctttcttcagactcaatttcccatggtgtctaaatcctgagcaaagacaagctggcagtttgtctcattccactgtttttaagaggc

SEQ ID NO: 173074 - DNA, 260 bp, Homo sapiens
tagacttgggaatgtcaagagaaacacatgcctttcagtcatttgcacatgagcctttcttctttggtcattgtcttagatattcactccacagaagagaactccgagaacagcatctgaatgctttgaatgtggcgctgcatcagggtcaggcagtgtagtattaggagaccagtttgggtgcatgtagcagatccaaaatagcagtgtcttgcacaaggtgggtgcttatttctttctcatgtaacagtttacagttt

SEQ ID NO: 173075 - DNA, 719 bp, Homo sapiens
aggaaactgagactcaatttgttagtgaaagtgcccaaagttcacaacactaataaatattccagccaaaattaagacctaggcctgtctgattcagtcttagccaatacaggacactgcttccttcccaggcttccccttgggatgcaatcctggcgatgttccatggcagccatgcaggcctgggggctggactgctgtgttagcctgggaagcctttggttctgccatgctcttctcccctgtgcttagtaaggaagggtaaggctcagcctctataacaaagaggcctagcaatcattctgtggatgaaagaagatggaagtttatttgtctcccatgtaactgcctggtgaactttccaagtcagcaggaagctccattcaacacagacatcctgagacccggattccttctgtcttgatccctcaccacccactagggcactgttgtgcctacaaggctgcagctaggtgtccacaagttcaagccaacaggaaagggaagagagcctggtagagacatgaccaccgtcttttttattttttatttatttacttatttttgagacagaatcttgcttggttgcccatgctggagtgcagtggctggatcttggttcactggatcttggttcactattgcctcgacctcccaggcccaaggaatacccagcctcccaagtagctgggaccacaggtgtgcaccaccacacctgg

SEQ ID NO: 173076 - DNA, 214 bp, Homo sapiens
cccaactgtgaaggctactcacgttctcaccctgctgtatcgtagaatggagctgaaatacaaaattgagattcaacacattcagtcccgaccagaaacatttcaaggaaatctgtgctcacagcaagattgagtgatgggacacagcgcttgagatttcaaggcaaatgctttttatgtcgtactcaacatgattagcttcacacgttaccca

SEQ ID NO: 173077 - DNA, 498 bp, Homo sapiens
ggtgaggacacatcctccagctctgctggggacaatgtggggaattctgtctggagcaaggccttcgataagcttgaggcagcttgtaactcttagcgtttagactttcactggctgagttgttattcttcatatttgaatctaagagccatggagagttcttagattgttagttttcctggacagttttctttccctatacctccaacccaaacacttcctttgcccttcaggtgaaaatggaaatgctcttcactcttgggatgggccctcaccttttagtaagtgttatggttgggtgtcgattaaaattaagggggctgtgtgttgcaggactactcccttgttcagagccttgctttagaatgggagctgccacgggaacagagctcatgctatgttaatatgactttattgcggacacggtgatgatctaaaatcctttgcaaaggcacttgaattttgtaaacaccactgtgttctcccactccagataca

SEQ ID NO: 173078 - DNA, 316 bp, Homo sapiens
ctcaattcaagagatcaaaaccatcctggctaacatggtgaaatccagcctgggtgacagagtaagactctgtctcaaaaaaaagaaaaaagaaaaagaaattaggctcaattaaattaccttttaaaaattaaaatggcatgaaggcatttcagattgaaaagcaaaacaagggaggatctaaaatacttttaataatagcaacaacaaaaaactatacatataaaagcttgtgggttgcagctcaaatacgatttagaggaaaattaatggtcttaaatgccagtattggaatattaatgagccaaacaatgct

SEQ ID NO: 173079 - DNA, 232 bp, Homo sapiens
tgtttttcttctgctgagagccaaacccaagtaggtttgcttttgattagaatgattaggctgccccaggggtgactgggagggtgttttcagaagagactggcctgtgagtcagtggactgaatgagggaatatccaccctcaatgtgaccaggcagcatccaatcagctggtggtccagctgaatagaaaggtggaggaatgggctggatgttgtgagaggctgaggcag

SEQ ID NO: 173080 - DNA, 488 bp, Homo sapiens
ggaatttgtaaaataaaaatctttattcatttctccactttatgaatcagttcttcaaaattccagacagaaaataatgttcaaaattcaaggctttggattcacagacttttttttaacagaaccagctggcatatgacatccatagtaactgttaacagcaagacactctcagaaaagcaccacctgcaaaccagctggttcactagaggacagataaacaacctcaaggaaaaaagcaggaaagaggtctaacagaacgggtcacagagaaacaagagcccatctgatggcacccatatggcccactatgtccagcccaactttagaatagaaaataagcaaggacccttcctaagactccagtgtaaatattcatcagcagagaaagcttatgtattttaacatttactcctaccaagaactctgaagtaaatgctaccgttattcttcatttatagattaggaaactagggtacagaaaggtt

SEQ ID NO: 173081 - DNA, 1889 bp, Homo sapiens
  misc_feature (3)..(6): n is a, c, g, or t
  misc_feature (1883)..(1883): n is a, c, g, or t
ggnnnnaccatgttagtcaggctggtcttgaactcctggtatcaagtgatctgcccgcctgagcctcccaaagtgctgggattacaggcgtgagccactgcgcccggcccctgtcctcccccttttacagatgaggcagctgaggcccagagtcacagggctggtgaggaacacagcctggatcagagcccaggaagcctgggtcaaggctcacgtctcttgagtgaggggctctgccctcctccatcctgttctttgtagtgtcatctttcatgacctacatggagacattcaaatccggggatgacacagagcttggagggagagacgtgtcaggagacagaaacagtgtccctggagatatcagcaggcaagtgtgctgagctcacactgagagccagaggggattctgaaaactagactgatgattaaaactgcttaaaaactcagcagcctccccatgctcccgggattaatgatgcaggctcacattgactacacacgtttataccaggcgccatgttctttgccgaaactcccgctcagagcctggatgatctgcccctcacctctgccctcgttcccatccactctcccctccttgctctgttccagccacactggcctcttgctgttcctcacactctccacgtccaggcacaccccagggcctttgcactggctctcactgctgcctccagtgagctccctccagatcttcttgggtgcagctcatgaggactcgctctaatgccaccccctcaaacaggtcctcctggccttcagtagcccaggctgtcattctgtgtcactgtactctgttccacatcccgtgtcccccatgggaaacaggtgccaccgtcttagtcacaaggcacttgtaacgtgcctggcacacagggcatgctccatcctgaacataagacgtgtggatcttgtttgattctcacgtgaccccaataagtagatactataaggcccccacttttcagtgtggcccaagttgggccctgctgaaccctgttaccctcctcaacaatcacccgtacacactgcttcctctgcctggaacccaccccccaacccgcacccccactctaggcccactcctgcccacccatgttaatttgctggggcagccgcaacaaactaccacacactgagtggcttaaactgcagaaatgtatcatctcacagttgcggaggccagaagtccaagttccaggcgtcaacagggtggttccctccaagggcggtgagggagaacctgttcctggcctccctcttagcagccggtgggtgtcagcacgtagattcatcacccccgtctctacctcctcttcgcatgatgttctccctgcatctgtgcccacatttcctctttctgcaaggacgccaatctaacgggattaggggtctaccctaatgacctcattttcacttgattgcctctgtaaagactctgtctccaaatgaggtcacatttggagatgctggggcttaggacttcaatgtagctttttgtggggccccagttcaacccataacaccactccttgggtatcaacacagacacgcctttcttgcagaagttgtctgaacccccacaccaggctcagcccacccccagcacctgtcccagggcacagcgaccgccactcccttggcaacttgcttcctctctgtcacccccatggggcccagaacagagacatcctgaacctcacccagaccacacacttagtaggtgctcagaagatgtacctggagagacaacaaccctatccaacaacagctttcccagtgatgaaatccagagatggcttgtatatgtgtgtgttggtgtaaacatatgtaaactaagcatataaaatatcagcagnagacac

SEQ ID NO: 173082 - DNA, 380 bp, Homo sapiens
caggatcccctgctgctccctcttcacacatcaccatggtctctcatcaacatcacaacagccacttaactcatgttctcattccatcttttttttttgagactgtagcgatttcctgcttcctttaaggtagtgatttttaactttggctgcagggagctttaagaaatctagataccaagtataatttgtagcaccttggcttttctccactctcttctgaaacccaaagttattttagaactttaaacatgaggacattattccgcactgctgtatcctgagctcacagcagaaaggactgaattgatttgcttgcattacattgtaaagggggtagatgctgtaaggggaaccagcctttcccctggacttgagtc

SEQ ID NO: 173083 - DNA, 449 bp, Homo sapiens
attcactgtatctgttctgtcagaacaagtctatcatctgttgttttggatggagtgtggccagccctgcctttggatgtaaggaaatcaggaaacgcttgtcagatgtcaacaccgtgccagacactccgctagggatttccacgtaaatcactatattcatttctgttgctgctttaacacatttccacaaatttagtggcttaaaataattgaaattgtatcatctcacagttctgtggggtagaagtctgacgtgggtgtcactgggcaaaaatcaccatgtgggctgggctgcattcctcactggagaattgtttccaagcacttttggccaaatatagttccttgtggttgcaggactgaggtgtccccttgctggccatctgttgggggctgtcctcagctcctgaggcctctatctggtctttgcatgtggtcccatcagc

SEQ ID NO: 173084 - DNA, 254 bp, Homo sapiens
gctgacctagaggatcccccgactcggaccatctcacagttctgtggggtagaagtctgacgtgggtgtcactgggcaaaaatcaccatgtgggctgggctgcattcctcactggagaattgtttccaagcacttttggccaaatatagttccttgtggttgcaggactgaggtgtccccttgctggccatctgttgggggctgtcctcagctcctgaggcctctatctggtctttgcatgtggtcccatcagc

SEQ ID NO: 173085 - DNA, 402 bp, Homo sapiens
cagatggagcctttgattgtggggtggacgagcaggcagtagccctactgggtgtgcttatgtgttacgccacagaccttacttgactgtcacagtgttcccgtactttcctttctgttccaggatccagtccaggggaccacattgcatgtggtcacaccagcccagcaccccctgcccggggacagctcccgcctttccttatttcacacacagtttggtggtctccatgtaacacgggatcttcatagctcccagaaggaaagccatgcagcggcagcgtgtgtctgaggcccgccttgctcaatagaggaagaacctgacttgagaaaatcctgctttcattcttgcagggtttctggccttattccagaaactttctcctgcctctaaatatcagaa

SEQ ID NO: 173086 - DNA, 495 bp, Homo sapiens
atatatgtttccattttctgtaaatattttaatttttatgtagtcaagaaatctatcagtattctcatttgtaatttttttacacattttagtgtaaaaattaataaatttcagagctttaattatggaaactattccataaaactataaaatgtcaatatcatcacaataacaaaaataaagcctaggtcaggcacggtggctcacacctgtagtcccagctacttggaaggctgagtcaggagaatcgcttgaacccaggaggcagaggttgcagtgagccaggattgcgccattgcactccagcctgggtgacagagtgagactccatcccccaaaaaagaaaaagttagatagcaaagcattgtgtttattgtgctacagcattatggctaggctaaaagcatatacatcttatgtagcctcacatttccatatagatgtctcactgttacctcgactacagtgtgaccagcattgacaacattaatcttt

SEQ ID NO: 173087 - DNA, 511 bp, Homo sapiens
ggtttgccccttgaccgtcactgccttatctcatttttttcatatgaagattgagtatcccttatcctaaatgcttgggaccggaaatgtgttggatttcagattttttcagattttggaatatttgcttatacataatgagatattttaggaatgggacccaagtctaaacacagaattcatttatgtttcatatacattttatgcatagagcttgaaggtaattttgtacaatattttaaataattttctgcatgaaacaaagttttgactgcattttgactgtgaacgtcacatgagatcaggtgtagaatttttcacttgtggcagcatgccagccctcaaaaagtttcagattttggagcattttgggtttcagatttgtgggttaggctgcccaacctgtattttaaaatgattttgttgtatgatttctaggttgtggctgtacaaatcccagttagctcatgctataaaatagactcatatttcccccttttatacaggggtt

SEQ ID NO: 173088 - DNA, 458 bp, Homo sapiens
ctctgcctcccgtgttcaagcgattttcctgcctcagcctcccgagcagctggaattagaggagtgcaccaccaaccacaggtaatttttttgtatttctagtagagatgggatttcaccatgttggccaggctgatctagaactcccgacctcaggtgattcacccgcttcaggctcccaaagtgctgggatcacaggcgtgagccacccagcctggtcttttctattttcgtagagacaggttttcaccatgttgccaggctggtctcgaactcttgacgtcaggtgatccacctgccttggcctcccatagtgttgggaggcggcagccacagtgaccgcctagattccatatatcttaagtgaaatttggcaacaggtaccaagagctacaaaactcaagtttattttatatagtttcatctttgagactataataccaaggttgggcctcacg

SEQ ID NO: 173089 - DNA, 705 bp, Homo sapiens
ataccatgtcttatcagtggtccctgtctcccttcttgtacaatccagaggaatattttttatcaactattttgtaaatgcaagctttttagtagctctagaaacatttttaagaaggagggaatcccacctcatcccattttttaagtgtaaatgcttttttttaagaggtgaaatcatttgctgattgtttattttttggtacaaccagaaaatagtgtgggatattgaattatgggaggctttgactgtctcgggtgtcagcttaacattccatagatgggggggttagtttttatatcctataatacaaagcatattaaatggcaatatggagtcagtcctgcatttaatatcttgaacattttaaattacttctgttgccatgttgttttttagtagaattgtttcctaaagaaaaccactctttgatcatggctctccctgtcagaattgtgcactctgtaacatctttggttgtggtagtcctgttttcctaataactttgtcactgtgctgtgaaagattacaaatttgaatatgtagtgtacgtgctattcagttgtgaactggtgggccgtatgtaacagctgaccaacatgtgaaaatactggtacttgatagcctcttaaggaaaatttgcttcccgattttaagctggaaagtcactggaataactttaaaaaagaattacactacatggct

SEQ ID NO: 173090 - DNA, 494 bp, Homo sapiens
cccaatatttcattgttttccatacaaccctagagtaggggaaaagtttggagactagctctaggttttatttatcagtcatatcttgcctcatccttctttttttttttgcactcccagactggagtgcaatggcacaatctcagttcactgcaacctctgcctcccgggttcaagcaattctcgtgcctcagcctcgcaattagctgggactacggatgcctgccaccaagcctggctaatttttttttgtatttttagtggagacggggtttcactatgttggccaggctggtctcgaactcctgacctcaagtgatccgcccgccttggcctcctactgggattataggcatgagccaccacacctggcctcatccttctcctttatcttcagttgtcacagataaataagctatgttgaatcagaaaaaaaggtagtttaatatatcatttggggaagaaacatcaattctgtatcaatctcatgtttt

SEQ ID NO: 173091 - DNA, 366 bp, Homo sapiens
ctggtgtgggtggggcagcataaactataggggagtaaatagtagaagacctggtggccaccagccatgagaaaagaggcagaccttgaggagtgataaaaaccaaccaaccaataattgcatgatgaggaaaagaaggctaaacagtatcagaatactggagtcgtgatttgaatggagggagtctgaagcagcaacccctgcttctgacctcagtctgaattgaaagcagttcatgggtcacccttaaccatcatacaaagttgcctctcttcacaaaaactgtcttatccattctcaagaaataaggaaaagagaaagcttgtggaaaggatccttcctggctggcagacagatctgagttaa

SEQ ID NO: 173092 - DNA, 607 bp, Homo sapiens
tactattgactccattttttctcaggagcacatggaaaattatatgtatcccttaattattacagcagcgattttatttatggtttggctgttccaagcaaaatgtgtacaatcaattaaatttcttgtttcctgattacaagaattttactacatgtttattatagaaaatttagaaaatacggaaaagtgcaaagaaaaagataaaagtcacctactagcttaaaaagtacttaaggtggcttagaagaaaggttgtattgtggttgccagcgaaggttatctccaatcaatcaataatttaacaaataattcagcgtatatttacgaatgtcaagtgctactttcctttgctttcctttgggatcggtacaactttagaaattgattgaggttttgctactggtagataagtctctgaatctgtctctctctctcttgctcagagttggggcagtaggattcagttggttatctccagtgtccaacccagtgcccagacatcagaggacaatcattggcaaatgatatttattgaatgaaaggggctttccaaatgtgtaataaaacaggaggaaggaagctgaggaattgagcaggggcctaa

SEQ ID NO: 173093 - DNA, 539 bp, Homo sapiens
aggactacaggcaggtgaccctgcatctggcttaatttttcctgagattgaaactccaataatactcataaaatcttctttgctctgatgatttttcaaaaagctaagttttatctatatttgaagggccaagaagctagaggaatggctcccacaagattataaaaccagcacgaaggaatacctaacctaagttgaagcctagcagagaaccaaggcacttaatgaggcaacttctcatagccggttcacacaaaacctaggaaactagggagcatacatcatgccatagcctagcttcctggtgtgtggtggtgtgcacacacacacatatattaatatgtatagaagggatggaagaaaaaagagaccaagggagaaaaaagacgggaaagaaaaacacaatagctacccccttattatccttgggaattcacactaaacactaaactaaatactatttcctcctcctggaattatatatgtggagcctttgctttacatggaggggaaagtcatagcctagaaagagaaaaatg

SEQ ID NO: 173094 - DNA, 762 bp, Homo sapiens
aatatgcatcctaaaagaaagtaccatgtataatggttaaaaatgcaggctcggatcaggtgctggagtatcaatgcaggctatgctacttattcactgtgtgactttgggaaagttacttcatctctcaatgcctcatttttctcagctgcaaaatgagaatgataaactacttacctcacatggtgactggaggatcaaatgaaataatggagggtaagaaggtagaatagtgtctggcatatagtggggtgctcacttgtagcgctagtagttagcaatgtgataattaccagcaggtacttttcatatgtttagcaatgacttagaaaggctagtggattttaatggaataaaagcgcaatacgtagctaatagtgaaggtggggtaatatgtttaggtagctgcaccagaactaagagcatgagaaagtgggaaagggaaggtaattctctcactgcagtgaattgtagtgattctctagttgccgttgatgtgctctttagtcctgagtttgcttacgaagtgcttctgtttaaatcaacccataagcagcctgttctaaccttgcttattgttggtctccagtttctccctttttaattttctttttattgaaggagaacacgaggtctattacttgaaatggggaaaggctacagttgggagttgaatgagctcattgtaccacaaagggtcccatttgcagtgtaagcatcatttagatgttcttcagagcctcctttctgaagaatgaccat

SEQ ID NO: 173095 - DNA, 156 bp, Homo sapiens
tcgaatctttgtcagaggagtattaccattagattgaaaaaaaggaaaataaataatacacacttttaaaaaaactccccattctcttattctcacttttaggaaaagagactgactaatatcttctgccacaaataccgatgttcttaaaaatat

SEQ ID NO: 173096 - DNA, 691 bp, Homo sapiens
ggctcactgcaccctctgccccctgggttcaggtgattctcctacctcagcctcccgagtagctgggattataggtgtgtgccaccatgcctggctaatttttgtaattttagtagagatggggtttcatcatgttgcccaggccagtctcaaactcctgacctcaagtcatctgcctgcctcagcctcctgaagtgctgggattacaggcatgagccatcgtgcccggccacatccagacttcaggtgtggaaaggaatcatggttctcacaggtggctgctttcagcagctgagggggtttctctttctggccttcatctcttcctctctttttgcctgctcgctcttctttctctctctctctctctctgcagatttctgctttctgggctcttgcctgccccacacctaagccctgtgctaagccctttacctcctgagcttatgtaggcctcaccaccatcctaggaggtaggtattgttataaaccccattttatagatgaggaaactgaggcaggagcatcaggaggcttctcaagacgaacaacacacaacaaacacaaaaaaagaccgcgcgcccgccgcagccacacaaacaccaccaacacacacagcggcgcaccggcccacaaagcacgcaactcgtccacagcgtccaagacaaccgggcaaacaagaggggcccaa

SEQ ID NO: 173097 - DNA, 777 bp, Homo sapiens
gaaagctctagagttaaaagctccagccagacacctgtgagagtgggactgataacaggaaggttggttgagaatctgtagttaagaatgattcaaacctacaggttacctctccaattgcaggcaagctagatcattgcccttctactcagtgaaaaccaaaggcttattcactagaggggttaaaatggagtccattgacagggggactatatagatagggcattagaaggctgtgtaaagaattcagacaacctgtaatcccagcactttgggaggctgaggcgggcaaatcacttgagatcaggagttcaagaccagcctggccaacatggtgaaaccctgtctatactaaaaatacaaaaattaggtgggtgtggtggcaggcacctatagtcccagctactcaggagactgaggcaggagaatcacttgaacctgggaggcagaggttgcagtgagccgagatcacactggtgcactccagcctgggctacagagtgagaccctgccacaaaaaaaaagaatttagacaggttacaagtttgctattatctaggacaggaatcagcaaacttttttggtaaaaggccagtttataaatatttttggccttgtgaaccttgtgctcgctgtgacagctatgcaattctgagaaacagcgtgtgcaatgtgtggtaaatgaatgcttgtgcctgcgttccagtaaaacttatttacaaaaccaggcataggctaaataggggtatagttggccaaccctaagtaccacattga

SEQ ID NO: 173098 - DNA, 306 bp, Homo sapiens
gtgacctagaggatcccaacttcgacggacggcatttaggctaacatgaaggaaaagttggaaagcaaaattgaatataaaacatggaaactctcaaagaactattgaaaaaggaaaataaaattcttcctttaaagcacactccagaattaagttccaagggtctttccatatcaaaaaggatgctcccacagcaccatcacttccctgccttattctgctcaccctttattttagttgtctgtttgatgtctgtggtctctgctgggtgggacgactttggaggatggagaaccagagcaccat

SEQ ID NO: 173099 - DNA, 969 bp, Homo sapiens
  misc_feature (7)..(7): n is a, c, g, or t
ggtctcntgttccgcaggatggggttgttaaagtgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcagcgtatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggacccgtcccaaaatgtcccttgctcagaagaaggatcgggtagctcaaaagaaggcaagcttcctcagagctcaggagcgggctgctgagagctaaaccaagcaattttctatgatgatttttcagatatagataataaactgatgaacagcaact

SEQ ID NO: 173100 - DNA, 549 bp, Homo sapiens
tctgacccttcctcctgtttcattatttcccccagcgcttgtcaccgcctcatatatcctttcgcttttttgtttatgatctgtttccaaccagctccacgagggccggatgtttgtgtttgattcacagctgtatctcagacgcctgtcaccgtgccctgcaccgcggctcgcgcacaggaggcgttcaacacacgttgttgacgggacgaaggaaggcgggatcgcgaggccagctgtgcaggtggcctgggtggagagggatgcacggccacgcgcgtctccttggcccgatcccggagcccgcccccggcctccccggcaggctgggccgggcaggcaggagttaagccgcgctcgcttccgacccgcaggtggcgccgtcctgccttggtgcccggctccgggcgctccgaagtgcgggacagaatagcagcgagcgcggagccgaagctcagccccgacttgttgatctcgcccaggcagccgccgccgccgccgccgcgggagcaggaggaggaggaggtggaggaggtgccgcgcggccgc

SEQ ID NO: 173101 - DNA, 461 bp, Homo sapiens
ggcaggacccagcgctgcactcaagcctcagccaggcccttcctgcaggacccagcgctgcactcaagcctcagccgggcccttcctgcagaactgcaggggcatcaggcaggtgatggaagccagaggctcagatcgcccactgcccaggccctgccagtgacgacatctgcttctctttcctgggaccagaggccccacctctgctccccacagcctggctctgccggcccagtcctgaggccactgcaaacaagggggctgtggcctcctgattactcactggccctcggctgcctgggagctgcagggacccacccaggctccctaccacctgcgaagcccacagtgccccccaggtgcctgacgtactgttgtgctgttggtggtattattaccacctcgggccatgcgatgacccttttgcttatctgcaaaataaagcgggtttggcagcaaga

SEQ ID NO: 173102 - DNA, 404 bp, Homo sapiens
ggttgccttctcagatggcctctctgacctcctaagctaagggagcccctccactatcatactgttattttctctgtgacacttaacactgtttgaaactgagttgtgtacatttttattgcttatctccctcaactagaacaataagtttcatagcaactgagactttttcctatttactaggtgtatccctgcatctagaacagtgtgtttagatagtaggtgctcagtacatattgttgaatgaatgagtggggctgggattctaaaccgtaggccattagttctcaggtggtataccatgaggcctcccatattcaattttcataaacatagaaagttgacttttgttataatcaagcatagagcattttagagcattttgctgagcgggttgtgcagtg

SEQ ID NO: 173103 - DNA, 733 bp, Homo sapiens
cgcacggcgaggcatggacgctttcatgggtggttacgcgacagttgccaggaccgagggcgaaaccggctgcaaggcattgtgggacattggaggacttggaatatgcgctagaaggctcaatccaagcccattggaagaggaagacgtacgcagcggagacagctgatccggagtcggggcggcctgccaggtgcccaacctctcccagagcatggcgtcttgggcacgcccctgccggcggacagtgcgtcctctagggccgggagctgcgggccgagttcgcgtgggccctgcgctttcatccctgccggggacgccggggttgcgggataaaccgctcgacacaccctgcctccctgactgcgcctgtgtgacacatacgttcactggtggggcacgcatcagatacggatggcagtggttttgaagtgggaggccctgtataaatgtaaacggttattactgtaaatgctctaacagagctgcctggggggcgcttccagggaagcgtggcaatctcaggccgggagaggagaggcgtcctgggccagggcgctgcaggaatacaggtctggcgatgtgcaagtacacagattcaccaggcaacagcattgcggcaagggtgggatggggaagccagacctaaggccagaaaaggagattgcgaccagagcatgcctgctgtgactgtcagagtaagctggtttcaactttattagagacttctaag

SEQ ID NO: 173104 - DNA, 140 bp, Homo sapiens
aggggaagtaaaaataatggaattaagcagtgggatcatcccccttcaaaagtcttacatttattagcatatatttatttttttaagacagaagtccacaaactatggcataataaacaataatgctattctggaacatg

SEQ ID NO: 173105 - DNA, 456 bp, Homo sapiens
gtgaaattctgtccccccaccaaaaaacaaacaaacaaacaaacaaacaaaaatatatatatatatatgtacacacacacacacacacataatatatacatacataatatacatatatacataaatacgatgaagcaaatgtcacaaaatattaataattggttaatacctgaagggtatatgagtattataatttatttcaaatttgtataggtttgagatttttttttaaataaaaagttggaaggaaattaatattaataatgaaaaagacactcagtgagtttcctagatggtctaccttgaggttgaaatagtcagcaaaagtaacacaatctgttccacaggtgtctaattcacacaaacatgaccatactgaaggtcttgtgttttatagcatccagagaagacagttcctgtcagtaggggacagatattactctaaagcggaattct

SEQ ID NO: 173106 - DNA, 478 bp, Homo sapiens
ctgttcccattttaccaatgaggaaactaaaattcagcgaagtgatgagactttgcctgaggcccctggttactagtgagggcattcaacttcacagcatgttaaatttaccagtgcaacaggatacatgaagagattttactaagaccttctttccttcaccctttcacctacccaatatttactgagaatctgctattcttaggccttcgaagtcagagatgactttaagtacatggaagtagcattcccccctggttccctgggtgccttgaggggtgagaaagggaagagtgtgctgaggctactcagtgatgaacccactttcccctaagccagatctgcaaggacagtacttgcagagagagttcctccctctgtctgatctttatcttggaaacaaaagtgatgccacgtagctttggtgaagctattagatgagttttctaagatgggacatgacctatttgtaagccag

SEQ ID NO: 173107 - DNA, 707 bp, Homo sapiens
tggagacggactctcgctctgtcgcccaggctggagtgctggagccttgacctcctgggctcagctcaagtgttcctctcacctcagtctgccaagtagctgggactacaggcatgcaccatcattcccaactaattttttaaaatttttggtagagatgggggtttcatcatgttgccaggctggtctcgaactcttgggctcaagcaatctgcccacctcgtcctcccgaagtacagggttataggcatgagccaccactcccagcctcagatttttttattgatgaattttattataacagctacaatactgagatgcataacccttccctttcctgatacccagttatcatctgtttctgtttaatacactccttaagtacctcacatttgctattcccctgccccccatggtctatgcatcttcttcattgaagtggtagtagtctttgttagctcatctggtcatgtcatcaattcagagcacattacctctttagttcagaacacattaattgcttcccataatcttcaggacacggccccatttcttcacgtggcttggccattgcttccctgttcagcttcccccacactccctcacctacaccttctgtctcagtatagtactgctagtctccagacatgccatgcctttttatgcttctatgcgtgttttcctgtctttaatgtccttgtccatgt

SEQ ID NO: 173108 - DNA, 637 bp, Homo sapiens
accttctgtattttaactgcttttgagcacatcttacatatgtgtttttgtgcagttggctcttcaggatataacttttagtcatattaaatagcatgtaagtgtctgttttagtcttgatcctattattcactagataatattcatttattccagttttggtcatccgcagattgggcaggcatacagtcttcaggtcatcaacaaaaatgttaaacagcccaactcttggtgccagtttccctctccctttgcctctctgctttagtccttgtggcctttttaaaaattacctcaaagtcaccgtgctgcttcctgtctcaggcacttttcataacctctgcctggagtgtcctccttttgccatttccctactttttttttaatccctaactctgaccattctgacctcaagtaaaatgttgtttgcccagggacttcttccctgatacaaaactaggtcaagtcccccttttataggctttcacagcacctgtacttgttcacctagcacttctcattttgtaattatacatttatttgtgtggttactgtctcttctccactgtattggatgctccacagtggcaagaaccatgtttcttttgttcactgttttatctccagaacataagca

SEQ ID NO: 173109 - DNA, 302 bp, Homo sapiens
  misc_feature (5)..(5): n is a, c, g, or t
  misc_feature (12)..(12): n is a, c, g, or t
  misc_feature (15)..(15): n is a, c, g, or t
tcagnggatccnagntatcagcagagaagagggtgtgaggaaaggaaagtgagtcgattctagaaacagccaaacagaaaaggtatcaaggaaagaaaggaacagaaccctccaaagccccctcaaaaacacaagttcaattctgataaggtactcccctgagtaaagttccagaaccaattctccagaaatgattcgtgtggtgtgaaaataattcaatctcaaaagacaattagctcttctgacctggcctaacctacgaagctgcacataatctctattacttctctgctggatacctt

SEQ ID NO: 173110 - DNA, 666 bp, Homo sapiens
tgctcctctttctaatgcttcttagcagatttgctgttattagacatgtagatttgtttgatagttaaattacgcttcctcactgccatgttttcgagaactaatctgttaaattatcttttgatgcctatttacatggaagggaaaagtgggttatcgattatataaacatataaatattaatgcatttgttcgcttcgcaaaaaaatactcagcaaaaaaaaaagagacaagtgagcagtgcacacacatcttaggatttcgcaaacaatattgaacggacagcgactgcatttagggactggaacaataaacgatgcaaaaaaaaaaaaaacaacaaaaaaaaacactttgttggggccggccttggggcccttggaaaagagttttattaaacaccattccggttgtgggccgcggggccccagtgatatggttaaggtagacacgttgggccgatatagggtggctccccaaggagaagaccccgggcccattggactataggcgtttgggattctcttccccaaattaaaaaaaccggcccgggcggaacaccagacgcggtcttggaaacaaatcccagaatagggagtccggaaggccaataacggggccctactcagaggagtccaagaaggctcgattatattacccgctgctggc

SEQ ID NO: 173111 - DNA, 147 bp, Homo sapiens
atttcatatttgttcaactttcatgactcttatgctgggaactcctagcataatagaccattagcagaatgtataggtgttgattaccttataagtcagtctgtctctgtctctccatttccatagaaatttagaataacatttcta

SEQ ID NO: 173112 - DNA, 493 bp, Homo sapiens
ttagtgtccccttagagttgcctaataggatcttagtgaactaacaatcataaacagaccaatagaaagaaaccttcttccttagaggaaaaacagtttcagagtcttggggtattcagtttgctcatgttgttagaatagtttcttttgccaaacactgaacattggggctgtgttttcttgttcaagaaggaggaagaggctatatgctaatgacagaaggcagctacttgcatgggtaatagactcaaaggaatgtaaatggctttcataaggcaaaatatctcgtgtataaacacttcaaaatctagaactcatatttcattaacaaagatattatttccttgtcttatttaaaactcacaagatattttaaaaattatgtttgatattgggatattaaagaaattcttttattttggaattttctcaagatgagacaaatgtagaattatgcatttgtttaaataccaatggaaataaaaaaatcact

SEQ ID NO: 173113 - DNA, 421 bp, Homo sapiens
atggtgaggcccggactgttgaatgttcaagttaattcatagttttaaccagaattcttttttcttgattttattatttttgattaaaattttggaaaaatagagctagatttttcataagtaggtctttaaggtgcttttaagaaattgcttttattagaagatatgttatttttgacatttttaaaatgtcaaaacttcaaaaattataaaaattgctgcttgtttttatgcttgaagaaaatttttaaacttttgcttattgatatgtaatatttgtgcatatttatgtgatattttgtacgtgcatagaatatgtattcaggacatttggggtatccatcatcttgagtatttatcatctctaagtgttgggaacatttcaagtcctctcttccagctattttgaaatatacagtgt

SEQ ID NO: 173114 - DNA, 195 bp, Homo sapiens
caccatgtttatcctgagttcttgccatttatcttctcatactgtgtccagatacattgaatttgtaattcccagaattcacaatactccgtctcgtctccatgcctttgtgtacactgttcctcaggctggagtgccctccttgcttttttgtttcttctatgcctttcatacctaggtcaggtatctcccttt

SEQ ID NO: 173115 - DNA, 424 bp, Homo sapiens
tgagggagaaaagggaggacatgagatcagagggtgagggcatgtggaaggacattctccacatgagatggagagaattgcagggtttggggtgggaaggaggaattttgtctccaggggacatttagcaatctctagaaacattttttatcatcacagcggtggaaaagagggtggagtagcagtatgacactaagtgggtagagggtacctttcaatgcacaggacagtgttttcctcccctccccagcaattaccgggcccacagtgtctgtggtgtcaaggttaagaaccctggtttcaagctcatggtgactaggtctgacttttgtgttaataggttcacgttggctatgttggggacaactttagaagaggaaaggcagaagcagaggcacccttgatccaggtgagaaataatggt

SEQ ID NO: 173116 - DNA, 349 bp, Homo sapiens
ctcctcccccatcatcctgcccatccctggcactagaccctcaccccagaactaaataagatgcctgattcagagcaggccacactgactaccaaattctggcaaattgtaaatactgtgaatggtcttgggccctctgcttccctgggccccttcttctctcggtccactccccatgcagacccctccttggctgtggggtggcatggacggcggggcctttaggcattggcattggggagagtgcaaacttggccctgattctccactcctagctcaggagtaggtcagaaaggcccagaatcgccctccagactgaaataaataacaaaataaataccccctcccc

SEQ ID NO: 173117 - DNA, 560 bp, Homo sapiens
cagggtgggctcctcattactgctaagtgggggaagaagtttaggctttcccccgtggcaatggagacctgtctccttacgtggccctctctgacaccaacccatgggagtgagacatgccctgtaaggggctttggtggccgtggaggcaaggaacagtttctctcactgtgtttggctggagtagcgtggggttgccgaaagtcttctgtctgcggaggctgtacctttggccctttggcaagagagcagtctttggttaggatttccaggttgctggcttctttatctccatttctgggatatatgtgccaaataaaacaaaatgaaacaaaaaccagggaacacacagtcatatagttcttttaaagcactacatggccaaagttttcagccagtgtgctttcttcttttcgtatttcagagtctccttatgtttattttgtacacaatatcctaggttttactaaatgggaagaataagaagaagtatgtctactatctttctattctaacaatattttgttattatataataaagtccattttaatattattga

SEQ ID NO: 173118 - DNA, 218 bp, Homo sapiens
gagccgcgtcccatttggatagcggatagtgggagcactccagttagaagaggagcatacagtaatggaagcagaaaagccaggagtgtgtgacatctggagtactaaggaagaaatgtttcaagatggagggagtaggcaattgtataaaacactgctaaatgaggattaaaaattgaccatgtgaccaagtgaagtagttgaaatttgataagaac

SEQ ID NO: 173119 - DNA, 490 bp, Homo sapiens
gccgtcacatgtcactggaaagctggagcacatcacagccgaccagaagcgcacgatgccatcagaatccagtgatctgaggaggttcccaatttcccagaacaacagccacgttgcactgtgacctatccttcagcttcctcaattggttctggtggtgggagtagagaagctgatggcatgactgtacttgttcctcgagagactcggtcttgctctgtgtttgtagacagggaggccacagcaataggctgcagcagagtggttgtcatgccagtggtgactgtcaggctgtggccagagcccttgagtgtaagatccggggtaggaaggagtggcttgaggatgctgacgaggcagaaagcagatccacttttaggaatgaaattcaccttgtttttgtcaggacaataaaaggctgggatttcatgaagctgttttggcctagacatagaacagacaacccaatgcttttaagtcactgaactta

SEQ ID NO: 173120 - DNA, 388 bp, Homo sapiens
gaagcatggaaagtctgtgctctggaaaagacactggcaccagcaaccctggattgctgtagaaaagggttctattttttggatataaaattatctactgtatcagaagacacatatgcagatttaaaacttgagcattacccagcagttttatgccctctaccctaaaggttagtgactaagtggttgcagcagtccaggcagtgggagaagagctagcaaagccactagcctgctccagaagagatgactcagttactggcatcttaagggccaagcatgtgggatcttgctaatggcaccctgctcacagtttctgctccacggttcagccagaggtctgtctaggttgtccagtgccaactggagcactggattaaacgttgag

SEQ ID NO: 173121 - DNA, 426 bp, Homo sapiens
gccctgggagtaaatattctgggacaggcacagggggtgtacagggaaagagtctttcctctctgtggcatctgggaggctttaggatgtgggaaagatggtctcctcatctcagttgcccctcattttcaggcagacacgtatgaaatgattacactcccctgaaagatcagcttctacataattcaagatcatcctcaatctctctcatcagagaggaagaaaagccgcatgaattatttacagaacactaagttatttccttttatgagctccaactttgtttttgtctctgcaaactgagattttgtttatccatgaatagtttccccaggggcatgaaaaatatgactcttaaattatgaatgaggttttttgtttcagtccatgttaactaaaacatgcaaaataaactatgtttttcat

SEQ ID NO: 173122 - DNA, 412 bp, Homo sapiens
tacttgcagttgctatttgaaccccaaaacaacattgcacccagccaagattttacctgccaatagcccaatttaaaatgtgtcaagaaacaggctatgcctaaaagcaaaagtcagctgtaaataataaatcttaaagaaacaattgtgtggccgggtgcggtggctcacgcctgtaatcccagcaattcacgaggccgaggcaggcagatcatgaggtcaggagatcgagaccatgctggctaacacaatgaaaccccgtctctactaaaaatacaaaaaagttagccgggcatggtggcaggcatctgtagtcccagctacttaggaggccaaggcaggagaatggcgtgaacccgggaggcagaggttgcagtcagccgagatcgcgtcactgtactccagccttggc

SEQ ID NO: 173123 - DNA, 536 bp, Homo sapiens
cagtacaaggcttccaagatggtgtgttctcagtaatcacctatttccagcaggaaaaagattgtctttgtcacattttctcttatgtgtgggagggaagttgatctgtttggcggctgccttctttgtcagttctcactgaaatttgagacaaaggtgggaaagctgagggtttcaatactcatttttgtcctgagctgttgacagtccactagccagaaagaagttaagacttctggaatcatagcatcatatggaatggtcatttactgcacaaaatacatagaaaccttgtatttattcatttaacaaatatgtgtgtatagaccattcattcattcacttattcatgccaggtaccatgctggaccttgtgaaatcattggtaagttaaatggatgatgttcttgttctcagggaacttacagtcttgtggaaaggcagacagtaaacacatcctataatgataagttatgataaatgctctgaaggaaaagtataggatactctgagaggttttaggaaacaaaatgtga

SEQ ID NO: 173124 - DNA, 336 bp, Homo sapiens
aggtgacaatccatcacttgccatattctctttattacaagtgagtcactggacccaccacatattcaagaggaaggaactgcacagaatgtgaataccaagtcacgggtttggggggaccattttaaaagcctggttaccagaatctcctgtccttttctgagcttgtgtagctagtgtcagagaggtggattgctggtttccttggttgttgaggaactgtggagaaatgtgtcggaagtgcccttagccatatggtaaaattcccggaagtagatatgctaataatttgtcagctattcccttgtgagacttttctagatctctcttccatcc

SEQ ID NO: 173125 - DNA, 342 bp, Homo sapiens
cctcccgagtagctgggacaacaggcgcccaccaccacgcctggctaattttttacatttttagtagagacagggtttcaccatgttagccaggatggtcttgatctcctgacctcgtgatctgcccgcctctgccttccaaagtgctgggattacaggcgtgagccaccgcgcccggcctcttttttcttatcctctgacttgggtcaggtactgacctaggtcttggctttatcacttattatagggtatgtgactttggacaagctgctctctgaacttcagcttctccatttttaaaaggtagaaaataatattaatactacccatctgggagggttc

SEQ ID NO: 173126 - DNA, 162 bp, Homo sapiens
cggcttagctctgtcccttggggtcctgctgactctataaactttcaactcctaaatccaatgctggctcacccaggaaagaaaaaagcaaactgaacaataaaattcaagctgtagcttccgttgtgactcaagaataaaaaatgttaatggccaacagca

SEQ ID NO: 173127 - DNA, 238 bp, Homo sapiens
gtattattgtggctgtcactcaggttttctgctcattggtagacaaagggtgaggaggtgactgaaattggaacagtggaaggacccttcaccaaaacctggaacttcagaagaatggcagggctgaaaatgattagtgttaattcattccagttgtgttaccctacccataagactgcctgaaggagcctgaacttccacgtgctgtcttccatataatgtgatctgaggtgaagag

SEQ ID NO: 173128 - DNA, 156 bp, Homo sapiens
ctgcaacacttgttaaatctgagatggctgggtttccacttccagagtttctgaacctgccaatttttggtgcagcttaataatttgtatttcttttctttctttttttttgacggagtttcactcttgttgcccaggctggagtgcaatggtgca

SEQ ID NO: 173129 - DNA, 493 bp, Homo sapiens
actgcactccagcctgggtgacagagctagaccccgtctcaaaaaaaaaaaaaaagaaggtggtgtgggctcccacacagttgagaggagactcctgaggggaaggggaaacagttgcccagatctgctaagagcgttggcaatgcttctgcctcctcctctgttgagcctgctcctggaagggattgacaaaatagtatgaaatctagaaatagctttattcccaaagaggataccggtggtgttattgaaaagagcaaaaacttggaaagcacctacatttttaaagtaaggaattggtgaagtcaatagttgtacatccatttaacaattatttagtagctaattggacaattatgcttaagaagttttcagaaaaagtttataaagccatgttatatgaaaaagttaagttataaaatggcatatactgtataattataactgctccccacccccaaaaaagccaaatcgtagtggaaaatgactagga

SEQ ID NO: 173130 - DNA, 114 bp, Homo sapiens
ctcttgctccttaggcaactaaggttttcaaaccagtgccctagcttatctgatagttaactgtcattctctgtattatttgggaaaagttcttacatcagtaacatgaatttt

SEQ ID NO: 173131 - DNA, 286 bp, Homo sapiens
acttcacattctcacaatctcagaaaataagaaaaccagttgctaatgtattattttcattttcactaaaaaaaagaaaaaaaaattcccaatttgtctctttttgctttcataagcaaatctagccatacacaggtaagaaaagaactcctcaaaagatatatatataagtgaaacaatgcttcctgagttagagtacaatcaatccatcagaaaaagataacttattgtagcaatactaagtagaattatataataatgtggcatgtacatgacaggaacaaca

SEQ ID NO: 173132 - DNA, 206 bp, Homo sapiens
tagctgggctttcggcttggaggagcccaaggtgcagctttcttcggttgtccagaatccaggtttttccaaaaccaatcacctccaccatgctgccaaagttcaaccccaacgagatcaaatttgtatacctgaggtgcactcggggtgaagggggtgccacttctgcactagcccccaagatcggccccctgggtctgtctcca

SEQ ID NO: 173133 - DNA, 990 bp, Homo sapiens
actgagaagctcagcggtagcttttgggaagcaggacgttctcaccaggagagcgtcctctcgagatttctgctccctccattcagggcgtttgggagccaccccttcattttttaaaaaaagtatttctctgtgaccgacggccggggccttctgacggtctgaggtcttgcttgggccagtcacctcctgtcacggtccgcggaggggggaaggataagagggcgaggagctcatcgctcgccacccccgtgggcttcttgggcgcaggtcggagctgggtgggccggctccccggcccctggcttgggcgaccatgtccgcatccgcccagcagctggcggaggagctgcagatcttcggcctagactgcgaggaggctctaattgagaaatggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccaaccttcaaagggttctcagaagcgagctatctctaccccaggaaacccccctaacaaaaaggagtgtgtcaacctcgtaggcccccatcagctactctcaccgtcacgtttctctccaagtgctaatccctcccagaaatacaactccacgaaggtaacccgaggcccaaagggttacctccttcggcttagccacaaggacgtatctggactgggacaaggaggagtgggaacacataagccgaaggcctcggatgtcagagggcctaccgggacgctaaatccggttcaaacgccccagacaatcgaaaggccagacacgtacaacgacg

SEQ ID NO: 173134 - DNA, 655 bp, Homo sapiens
ccgagattgtgccactgcactccagcctgggcgacagggtgagactctgtttcaaaaaaaaagaaaaagaaaaaggataaaaaaaaaaaagagaaaatataagaaatgctgatgagtcctgctcaatgagccatggttactttgttccctcagtggagcaagttgctactttcaaggcggggctggggttccaaaccccttatgatgactgtcacacacattcttagtagatgcccgattctgctccttgacacagatttaagcacggcgtctggcacatagccatatgttccacagaaaccctccatccgcttaatttatgcttttggcatctccacctcgttatcagactggagagggtggggactcttctcactcagtgcaacaccgaaagtatgccccgtgctctgtgctaaatgaagaaaaaccaagctggcatctcagaggcgctcctgttcattaaagcctcccatcacagagaacactggggcagtgacgcacaggctgccacagggccctcacccctccagcctctgggttttctaactaactgttccaagtcagtgttgtgggtcaccaggaggcaaagtccatggccagcccactgcaccttcccagtggccagtggccataccaaagtcgccttccaggtaca

SEQ ID NO: 173135 - DNA, 1147 bp, Homo sapiens
  misc_feature (4)..(4): n is a, c, g, or t
  misc_feature (6)..(7): n is a, c, g, or t
  misc_feature (938)..(938): n is a, c, g, or t
ggcngnngctggggacggtgcgcgcggcctctcgcagctcctgccaagccgggcggaccgagcgcgcccgggacgtccgcgcgcatcgcccgtgcaaagtgtgccgggcctggcatctgctcgcggctggagcccggccagcgccactggctcttgaggcacccgaccctgaggggaagaaagcctggactcgccccgaggtcagacttgtattgtaacccaggtctcagatgaccatccccggggctctccaaattgtcagttccagctgctgatttcaggtgtccccggaagcagccggtggggccaccgtgggtttctggtttctttttctcttcacttaaaagaccccgccacgaccccacgagcgcaaagacaaaaccatgcgtacattttattcttgttatttattggccaaatctccgtggaaatgtaaaggatgaaaagagagttcgccgacaacgtacggtcaccgtcacgccctctgaagccctgttaattaccctggcgcccgcgtgcgcccgtccacctgcactcaccggttcacagctgtggacgcggacatcctgcggcctttcaaggctgagagccaccacgcaaggttcggcttaatgccctggcgcgtgggtgcgaatatgcgaggcacctgacacagaaatgtctacggagcagagaaagaccagagaaagcggccgcccagtagaccttaccggctgtccggcatacaggagttctaagtcctgacgccagcgtccccgggaagtagagaaaagcgtgccttgcgtgcctgggaaaccagagcccaggatgccgcatggcctggagaggagtttgctcagggtctccactcaactcattttcctcccgcaaccacgcggaggaaaattctgaagatggattccctgagacctagcaactacttgaattccccaaaagangctttcatgtctccccagactgagtttctagcctcaggaaactacgcctccgcctccgttgatttctgccatcattctctctttctctctccttccttccctctcccttttttatcttcctctctccctcctctaatataaaatgacactatcaattcctcgtattcataaagatcagtttgccacagttcgcaaaattgagcctcacc

SEQ ID NO: 173136 - DNA, 181 bp, Homo sapiens
ggcaaaactgacttcaaagtgtggggagggttcctcttcccgggacgcagccttcccgggcattggcagacggtgccccggttagacagagccgctgaccaccccgccaccccgaggctggacgcacggatgcacacctggtcctgggagagacaggcgccccttcctttccgcaccccgc

SEQ ID NO: 173137 - DNA, 409 bp, Homo sapiens
tacaggtttgagccaccacacctgactgattattcttatattttagggagtatgatcaatacttattagtggtcagtgatagtggagaatggtaatatcatagacaaaagcaaaccacaaaacatttgaaataatttaaaaatagaaaatactaggatttttctcccctgcttgttcagttaatatattcatgtggtagacagttttggaaatatatataatctcttcatatagaaataattcactgttaaaatttggatgtgcttcctctaatctccgcattaattgatatttatgtatatgtaatatattcagcatactttttcctctattgtttgatatttaagcagtttctgtttttcagatggctttcttcatatctttggtaatatggacatcggtatacgta

SEQ ID NO: 173138 - DNA, 503 bp, Homo sapiens
aaaggctcaaaggtggcaacttttctcaaaattatctttaccaaaaagagtaaccatgctcttcttgccccattttccccatttctcacccccgtctcaacaagattcctggtaggttctggtgaccggggctgagccacacacctatgctctaaatgcaaaggaggttgggaaagtgtgtgcctggcatttccagtctccgtgtgagatggtagagtctgtctgcttggaggaagtgtgggtgcaaagcagggaagaagtaagtagagtgattgctgggtaggcctccaacacggtctttcaaaacaagaaaagaagaaaaggggagttattcatggatctcatgttcaggacctggcacagtgctttgctttctgcattgcaggcattcaattgatattttttgattgtggaatcattatcatggaaatagaaaatcaatgtcaggtcaggcgagtgagtagtgaaattaattattctttccaggccatgactagatgaca

SEQ ID NO: 173139 - DNA, 721 bp, Homo sapiens
ccccaccaacaacattatgaggtaggtattagccccattttacagataaagtaactgaggcttaataacttacctgtgatcacacattagaaagtaggggagccagcgtcccatccaggcttgcttgactctagagccagcgtgatctaaaacaccataccgcctttggtgatgccttcttcagacaccaaagttgcattattactctacaacttgagaaaaactttatttttatcaacggatgcttgcaagttagtacttaccttttactttccaatataatgtacctttaaaatcaccttataaaatcagccagtgttcctgaattatcttgctagtgttccaccaataaccatcccctttactgtcatgaaaacagcttggcaatatcaagtgtaccaaactgtagaccgaggatgtcaggttcctgttcacaacaagtaaaatgtatgcttaaagtatattgtgaaaccaataaacctctcagtggcttcatatttgtcatgtgggttcctgcatgtgcaatttaagatttcccattgctttcaggagctgttgaactcctgaaagaagtaactaaacattttgttattaagaattaaacaccaagtgatagcaaaatcaaataataccaagtttaaccctaggaaacttgttaaataaccatggtactttcataaaatagagtattagactactacttaaaagagtaaaatagact

SEQ ID NO: 173140 - DNA, 341 bp, Homo sapiens
tgtgccgctctgaatcccctttaattgtgttgaataatccttttaatttattagttagaatttggtttgctagtattttgttgagggttttttaagtctgtagtcatcagagatattgacctgtagttttcttttcttgtagtgttcttttctggctttgttatcagagtcatattggccttgaacagtgttttcaagtgttcaacaagaacacttggccttgttcagtgttttctatgtaaaacaagtttggaaaaattccctgcactttgaatgtttggaagagtttgagaagggttggtattctcaatccttctttaaatgttctttaagtgtaggtt

SEQ ID NO: 173141 - DNA, 315 bp, Homo sapiens
ataaggccaacacaaaaacttgatataaagaggaatttattaatttgtgagcagcaacaagaaaaaggcaatttctagaataatgtaataagttctttccaaaaaagctcttatttcatgtgcagtagtttatttttgtagcttatatgctagaaaacattgaaataacttatctaagtgagataaaggtagtattctacttatgctattatagactgtcttacattggtctggaaagatacttagtttgaaaaagaaattttcaaatattgaaatggtttatgatgtaactgactaattttggttcttttggat

SEQ ID NO: 173142 - DNA, 519 bp, Homo sapiens
catatccaaattgtaagggtgaagaaaaaccagatgcagttaggatcttctcacttcccaaaactggattcaggtgaccctttgctgcagccgctacccagagcaaatgtaaatcctctctggactgatcttttgagttatttttataacttttcatgtttagtgttggaaagttatttaaggtatctgaggaaacaaggcaacatgatgaaaatccgaaagaagcgacagatgatgggacagagccaccgtgcccagccataattatcacttttaatgacagcataaaattccattgatagatattatttattggactactgtcccccaaataatgtgaattttaagttgtttagagattttcactgtgataataatgtcaagctatgccttcgcttaaccttgcatcctcctcaaagtgctcccatatctccatttcattcatagccaggttttctctttcatttacttgtcaaatcattccaatctggatcccatctccatgactctcccaaatta

SEQ ID NO: 173143 - DNA, 376 bp, Homo sapiens
tattagggaattgtggatatatcccatctggccacattacatagctctctggctttttggagccagaagtgtgtctgtctttcaagccttttttttcctctcttgggaaatccctgttcagtttggtctgtagaataagtgccccttatgtaattttgtttttcctttttagtgtttgagaaactttcaaaaagggaacgcaaatattgtagccaaccagagtgactctgtgcctcactccccaaggattcagaggatttatggcttatctgtaatactgttactgaccaattcaaaaataaagattccagaaacctgagaccttatggattctttataaggttgactgataatttttatgcagaatagcaatttg

SEQ ID NO: 173144 - DNA, 210 bp, Homo sapiens
ccagttctccaccccaaaaagaggtggggaaaagaaggaagtcaggcaagcttggcagattgattctaaagttcatctggagaaataaacatgttaggcctgccaagaaattgttgaaaaagaatgaggatgaacttgccctatcagatatcaatacacagtataaagcagagcctggtaaactctgtatgaagggccagattgtaaata

SEQ ID NO: 173145 - DNA, 150 bp, Homo sapiens
tagagtaggttcttggaagaacgaaatcctattaacttattacaaaagttatctaagtaagatatctaaatgcctactacagcattacactgggtaacagaaatcttgccttcaaaggcctttaacacatttcaataatttactaaatgc

SEQ ID NO: 173146 - DNA, 618 bp, Homo sapiens
tagctgggcgtcgtgaaggatgcctgtaatcccagctacttgggaggctgaggcaggagaatcgcttgagcttgggaggcggaggttgcagtgagccaagatcacaccactgcactccagcctgggtgacaactgtctcaaagaaaaaaaaagttgcagaagaagttcttcaaggggtccttaggaacagcctgctccactctgacctcccgtgaggacgggaaggggacccacgccacgcagctgtgggcagctctggctctggccgtagcggccacagtgtcctcacctgcagcgcagggcatagagggctgttggtgtggggccaagagtcacacacttcctccagtctgagcccatgaccctttagaggaaaggaatggagtatttttcctgccttttctattcaaacggtactttagaataacccaagagtagataaaaggcagtgtctcagcccagaaatgttcatcaataagtgaagaaggagcaggatggtcagaataccacccatcaggtgcaatcctcataaatcaatggatgtaggcatggattcttgacagctgctggggtcacgaaggggagagagttaggtgtgaggtgagccctggtgtgcac

SEQ ID NO: 173147 - DNA, 553 bp, Homo sapiens
ataaagtccacgattatagttgacgacatcaactatctttgtcagaaaccaatagaacaagtaggcagaaaatcagtaagaatatagaagacataaacaatactaccagctgtctgacctaatgaacactggtagaacaatttatgcaataaaagcagaatacagttgacccttgaacaacatgagattgaattgcatgggcccacgtacacccggattttcttctgcatctgccacctcttgagacagccaagtccaatccctcctcttcctcctcctcctcagcctacttaacatgaagacaacgaggaggaagacctttacgataatccacttcacttcatgaatagtaaatatatttcctcttccttatgattttattaataatatttcccttcctgtagcttactatattataaaaatacagtatataatacaaataacatacaaaatatgtgttaatcaactgttcattaaggcttcgtcaacagtgggctactagtagttaagtttctaggaagtcaaaagttactgggtttttgagcatggtgcc

SEQ ID NO: 173148 - DNA, 343 bp, Homo sapiens
cgcctggccgatgaaatgttaagttcaatattttaggtcctatgagtagagaggagttaggcaggttcctttcatggaaagcctaagctctgttaaagaattcctctaggagagctactgaaggattttcatcaatgaagtggagtaccaggctcatattcacatttaaaagagaacctagggccaatgttcagaaacagattttagaaagacaagagaccaaagtataatctctaggaagacaaattatgtgactagagcagtacatatacaagttaaaactacagtaatcgagacataaggaacaacaaatagatcaatgaaacaatacaagcaaacagat

SEQ ID NO: 173149 - DNA, 395 bp, Homo sapiens
ccaggcgctgacaaaaagggtcatgtccactgaccaaaaagaacaaacagcctttcttttggaaaggtttggaagccacaaccatgcctgttgaggtccaggtgaagaaatgaggactgttcattcttgaaagggagataattataaccatgcagcagagacttcatttacctggtacttgagtaaggcagcggtcagaagggagtttttgtttttgcttgtttgttttttttttagacagggtctggctctgtctcccagaatggagcacagtggtgcaatcacggctcactgcactccagcctgggtgacagagcgagactgtgtcaatcagtgaatcaatcaaagattttagctatttgatacaacaaagtactactatcacaaatatatta

SEQ ID NO: 173150 - DNA, 1289 bp, Homo sapiens
gagtagatttgttattgtttaaaacttactaatacttgagagaggagaagatgatattcctccaagattacctttttcttcagacagacacctcagaaagaacccttttaatacttcatttgtactgcatttcttcaatttgatttgattgtaatggctcttaagttaggtcaaacttaaaggggccattttacagtgaacaaagtgagagtaagtccagaaaagcctgcatgtgagggtgggggtgcttaactccagataagttacttgaatttgctgtagaacacaaatgatagattgtgtggttgcggggctggcacaaggatagaggaaaatgctctcctttggggaagaagagtgttatggcagggccatttctctggttatctggcaagaagatcagattagaatgcctaatagggaaactctaaacttaacaaagggtaaacaaaagggctagtggtagaggcaggcagcatggaagaggaagggaccagacaggtggtttagagatggtctgtgaaacaacccatggaactgtgaagtgtttcatttattcaacaagcagttattgaacccctgttcatatgccagatactttcctaggtgatggggacacaaagatgccttagaatggttaggaagacattctagtaaaaacaacgaagtaacggtttaaaaaaactcagagcagctcagtcatgccttaggagagtgtgcagagtgcttggaggagcttaatgagatggtacaaggattcaggcatgttttacctgctaacttccaccctgctctctgctggtgtccatctccatgttcacttttacagcctacacctttcagttcaatgaaacttttggctaccctcaaacatgctgtactgtcacgtttaaataattttggtttttattgccaattagcctggaagttttattcttttgaattaatcttcacatgttgaaatttgccagaatgaaaataaagatttggccaggcatcgtggctcacgccagagtggccaaggcaggaggattgcttgagcccaggagttcgagaccaggctgggcaacatagtgagaccctgtctctatttttaaaattttaaaacatatttgaggtgcctatagtccagctactcgggaggctgaggcaggagaatcgtttgaacccaagaggtggaggttgcagtgagccaagatcacaccactgtactccagcctgggccacagagcaagactctgtctcaaaaaaataaataatactttttaaaataaagtaaaataaagatt

SEQ ID NO: 173151 - DNA, 329 bp, Homo sapiens
ctcagaagattacttgtgtcatggagaaaggcctttgctccagatgaaatcacagagtgttgggactggactacatcttagattccactttgtgcttgagaaaactcaggcccaaatgggttaagtaacttggatctggtcagccagctagttagtggcaaagctgaactcatgaatcaaatgtaactttcagccaaggctttcccgttatacctcctcttaacttcctatcaagccatttaaaagagaagtgactggagaaacaaaataagggcaatagagcgaaacacttaataatcaatcaccctgatcccttgataagtggtata

SEQ ID NO: 173152 - DNA, 692 bp, Homo sapiens
aggagaatgcttgaactcaggaggcggaggtgcagtgagccaagatcatgccattgccctccagctctgggcgacagagcaagactccgtcttggggagaaaagaaagaattgtcttacttcttttctcactctgcatggtctctctgctagcttatttacatcagtaacctcaaatgcaaatggcttacatcaaatctatagctcactccggacccctctctgcagttactgcccctgcttggcatctctactcagctctctcatagatactgaactcaccttttgcctaattttgcaaacctggctcttttaggtttccatctccattagtggctccacagttcacccagtctttaaagccagaaacttctgaagttattctagactcttcttccttagcttccacaccaattactggtcacacaatcctaattgatctttcctcagatatctaaataaataactcagatccatcccccgtttctcctttcccacaggtgctttcttagttcagaattttgtcgctttatacctgcgttgctgcaacagccttctactttccttgcctctaccatgagtatctctcattctgtctttcaaaaacactgatctgaaaatttcccttctgtgtaaaattaacgattctttgtagctggcagaatacagttttgtatggtacgtcgttagcat

SEQ ID NO: 173153 - DNA, 664 bp, Homo sapiens
aggagaatgcttgaactcaggaggcggaggtgcagtgagccaagatcatgccattgccctccagctctgggcgacagagcaagactccgtcttggggagaaaagaaagaattgtcttacttcttttctcactctgcatggtctctctgctagcttatttacatcagtaacctcaaatgcaaatggcttacatcaaatctatagctcactccggacccctctctactcagctctctcatagatactgaactcaccttttgcctaattttgcaaacctggctcttttaggtttccatctccattagtggctccacagttcacccagtctttaaagccagaaacttctgaagttattctagactcttcttccttagcttccacaccaattactggtcacacaatcctaattgatctttcctcagatatctaaataaataactcagatccatcccccgtttctcctttcccacaggtgctttcttagttcagaattttgtcgctttatacctgcgttgctgcaacagccttctactttccttgcctctaccatgagtatctctcattctgtctttcaaaaacactgatctgaaaatttcccttctgtgtaaaattaacgattctttgtagctggcagaatacagttttgtatggtacgtcgttagcat

SEQ ID NO: 173154 - DNA, 259 bp, Homo sapiens
agctgtatagctaggtattcattcattcagagatacatttttgtaaatctgtagtcattctgctagttattcagttttaatacttccatgtgaatatatctgaaaagtttatgcatgattacatgttctttatgccccaattcatgtgaaattcctcttgaccattattttgggatagcagacttttgtttctcttgcattttgtgattttctctttattgcttagtgagctaactttgctttatcctttctttgatag

SEQ ID NO: 173155 - DNA, 540 bp, Homo sapiens
acatggtttctacctttacattagaaaagtgtaagtttcttgtaaaacagataaatcttataaattaaaacttgttagattttatcttctcaaacttgggcatgcttattctttactcctatgctcatgatctctccctctctctccccctgttaaactgttgaacacaaaggacataaagttgttgacgtaaagaaagaaactgaggcaaaactgataaagcagacagtttatttaggccaaatttgaggactgcgacctgggagacacagatttttttttgttttgttattagaatctagcacatcttgagagacacagagtcaagttgcctggaatatatgctctgattagtattacttacaagtgggttttttaagaaaaaaagaaaaggtagttcctaagttgaacatgagctatcgattgacacgttgaaattgtaccacaaattcaaggaatacgaagataatgggtgatagtcactgtgcaacttgggatagctttcaggtaatttatcagctagtgtagaaactacaggga

SEQ ID NO: 173156 - DNA, 656 bp, Homo sapiens
cgtggcggcctatttgactcatgctattgacatcagtaataaaatactaacataaaagctgatagagccctatactcttgtcaggatctgtgcattgattatagcattcatttctaacaactactttgcatgctaagcaagccatatgcacctcctactgtttgatgttagtcaaaaccaaagtctttatgaaaattgatgccactcaatgcaatttagcaatcatctataaagcaactactatgtgccaggctcaattctagccataaacactcggggtacatcagtggggaaaaaatacagacaaagatctgttcttgttaagtgagggaaaatagaaaagaagcaataaccagaaaatgcaaggaaattataaaatatggttcaatgagacaagtgctgtataataacaacaacggaaaaatggaactgcataagagaaaaatggcaatggagaaagataaagtataaaattttgaacgaattgctcagggaaggttttatgggaaagtgacatttgagcaaaggtcagaaagagacgagactgtgagccctatagctatctgggggaagatgcttccaagcaaagagaataggtgggagcatgcctggttcattcatggaatgccaaggagtacagtgtgactggaaggtat

SEQ ID NO: 173157 - DNA, 493 bp, Homo sapiens
tggttaaattaccttatattcctgtgcttatcttcaaataattatagtaatgtctatctcattaaatttgttatgaggattatatgaatcaatacacacatggtgcgcaaagcagcttgtgactcacactgtgaatttaatgtgctcactaattgctgtgacttcttgcattagactctcctgggcacgaatctgaactccattataaaccattgcatgatgttaggtcatcatggactcttgtggatgttagtgtcctaatccacaggaacccagaactgtcaggaatcctgacggaggcagactgaagctccgagaagaagaaacatgaatgcactttttaagtgctaaataattgtatgtttcatgctgtaattttcattgtttgtactgaataataaaatgcagaaataatctcaaagtcacttcaatgattttaaatttctactaaatctaagggatgcaagacggaaactagctaggagtcacctga

SEQ ID NO: 173158 - DNA, 351 bp, Homo sapiens
ggggacgcgtcaccagtcgtctcccttctccatgacagagtccggatctacgtggctccttccttgtgccctcagatcgaaatatccattgagcatccaggatgtagcggatctcatcgtccgtgcggagcgtccgatctgagtatcttattttgacctcgatctcccttgagttttaagtccttcctttaacaagacaatcagtcacctgcgatagataattattttcagaatagtctagtttgtcattttgtacaatagtttattagtatctaaaattcttctgaatagtaaatactgtcaggtgttaacttgagatttgaatactctcagagagtctgttggcctagc

SEQ ID NO: 173159 - DNA, 312 bp, Homo sapiens
tggacaaggctaaggtgttgtgttgctctttgaattactatagtatctgtcacagaatttggtacaaataggaaaaccacattataaggcatctagagaatccagtgccccttctagtcttggtaagattcttagcctagactttataaagaggtgatattgctctgagaagatccaggactacagaccacctgatgtgcagtgattctgtggcagaataaatgacacatgcaccacgtaaagtattgctaaactgtggtgaggtatttttggtctgttcacttattttaaagtatgcctgtagttgactag

SEQ ID NO: 173160 - DNA, 211 bp, Homo sapiens
ccttctgcttctgccccaaggtgcccatttccccactccgctcccccttccctgtcacggatcaaaatctcacatccaaaccctctacctccctttccagtttctgattctaacctctcatctgcaaaataaggtacccatctctggcctctgcttcctgcttctgccaggcttttttttttttaaatttattattattatttttaagaga

SEQ ID NO: 173161 - DNA, 1302 bp, Homo sapiens
cggctcccgaagagaagggccgagttgcccgcggctccggcccacagcggccccacagcttctccgaggcgttgcggcgcccagcctccatgggcagcgaaggcctcggtggagacgcagaccccatgaagaggaaaccctggacatccctgtccagcgagtctgtgtcctgcccccagggatcgctgagccctgcaacctccctaatgcaggtctcagaacggccccgaagcctccccctgtcccctgaattggagagctctccttgatgccctctgttagggcccaccccaatcccagggcagaaggacatgagggagcaaagagcttgaggaatgccatactccggctggtccgggacatggaaattcggactcagggaggacccgggctgggcaatgactgggagacttgcctgggttcccaggacttgggggtcctgactcccagccctcatcctgccttacccctctgttcccagccccagcctttctaagccattgggaatagaatggccccttttgttctggtgtccaggggtgattgtgccaaagctcttatttccagtgccaagcccccagaggcttgtaagagttgggatgagggatggagagggactgggtctctgggaacaggttggaggtcttatctgtggactgtctgactcccagctgaggccaagatggggcatgtccccgtctctgcttagcgtctgggtgagaaaaacaggctgtgatccagaagaagggaagatagagaaggagggaaaggatgtaggcgaaggaggtgagagacaggataggaggaaggaagtggaggaggaggtgataggaattggaaggaggtagaagccgtgcagaggaagaggggagagggacgaaggaggagcgatgaagaagaggagggagacaaaaagagggatggaggagagagggagtctggagaacaaagggtcctttctctggggaggggtgcagtgggcggggctgacactgtcagccaatcctcccatcggggaagagaatcctggacagggacaggatggggagggtatttataagggctttttggtgggagatgggtacccagtgggggccactggagggtctccgggcacactctggcccttcccagaaagggggtcgtttttctcgaatcttcaaccagttgtgtattggaaactagggcgcattttactattgatcacagtcattatattgttattatattactatttttattaaacctccccccactgaagtgtggggggcaaaataagtatttatctcctcaaatgccaca

SEQ ID NO: 173162 - DNA, 348 bp, Homo sapiens
  misc_feature (49)..(49): n is a, c, g, or t
ctggctcctccatgtcactgctctggtaacctgacgggtatcatgcgcngccatagtctgttccctctcccctctgcaggtataattcaggaagacatctttacctcctctctctccccaccctctctgcccaccttcaacgtcatcgtcaaattgttttgatacagcctctgaaatctattctaaatatatgtccttctctctattccctctgccctgggtccaaccccagccctggtcactttctgcaaatgcctcttaaactcccctgactcctgtcctcctcacacagccaggagcatcagtctaaaggacctcggatggggtcctttcccggccaaaaccccc

SEQ ID NO: 173163 - DNA, 202 bp, Homo sapiens
tggtacctaatacaatgtaaatactatgtaaatagttgctatactatattttaaaattagtgttctcttttatagttgcattatttcgtgtgtgtgtgtgtgtgtgtgtgtgtgtttgtgtgtgtgtgtgtatgtaaatatttccaatccatgattgattgaattctgggatgtggaaacctcagataaggagggctgactg

SEQ ID NO: 173164 - DNA, 2435 bp, Homo sapiens
ggcgggcccagcgagcggacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattgagaagtgcaggaatagcatctttgtcttgggccctgtagggactacacttcacctccacagttgtgacaatgttaaagtcattgctgtttgccatcgtttgtccatctcttctacaacaggttgcatctttcacgttcttacgcctacacgcccacttattctctctgggaaccagacagtaacttttgccccttttcatacacattacccaatgctagaggaccatatggccaggactggccttgctacagtgcctaactattgggataatccaatggttgtgtgcagagagaacagcgacacaagagtcttccagcttttaccaccttgtgaattctatgtatttattattccctttgaaatggaaggggacacaacagagatacccgggggtcttccatctgtatatcagaaagcactgggtcaaagagaacagaagatacagatctggcagaaaactgtgaaggaggctcatttgacaaaggatcaaaggaagcagttccaggtactggtagagaacaagttttatgaatggttgattaatacaggacatcgccaacagctggacagccttgtaccccctgcagcaggctccaaacaagcagctggataaggatcttacatgcagacactgggccctggaaatacaaggataaatggaggatggtgctcatcttgaaacttgaaactaaattgggaaggtgctattgctgcttaagagacattgggacttttctgtcttttttttttttttttttttgaggcagagtcttgttctgtcgcccaggctggcgtgcagtggcgcgatctcggctcactgcaagctctgcctcccgggttcacgccattctcctgcctcagcctcctgagtagctgggactacaggcgcccgccaccacgcccggccaattttttttgtatttttagtagagacggggtttcaccgtgttagtcaggatggtctcgatttcctgacctcgtgatccgcccatctcggcctcccaaagtgctgggattacaggcgtgagccaccgtgcccagccttctgttctatttaagaactttgatttccattccattttcatttattactgtttaggccgaattttcgctaaacttctgactttcatataaacatattgcttatagaacatcagaagactcatctttgtgatgcccaaatgaaaaagttggtgaaggtagtaccattgtatgtatgttaatattaaagcaactgagtgtagatttgcaactata

SEQ ID NO: 173165 - DNA, 967 bp, Homo sapiens
  misc_feature (66)..(66): n is a, c, g, or t
  misc_feature (854)..(854): n is a, c, g, or t
aaggtctccctaaggacatctgttcaactgttgaatgtataagaagagcagaaactgtagcgtgtncactgaaagctgattttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattagatttttcagtcaggtcaggagactgagatttgtttctgggactgggccactcttcgccaatcaaagatgnccttagggagaccttgttcaactgttgaatgtataagaagagcagaaactgtagcgtgtccactgaaagctgatttctctgcttttcaacttcctcctcaggagcgcctggaa

SEQ ID NO: 173166 - DNA, 1695 bp, Homo sapiens
ggcgggcccagcgagcggacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaaggtattttttaatattttaatctacattaaattgaatgacaacttaaggaacctagtgttttctaatatattagtgatctcgtgtcttctctagaagacctaaaaaatactgctcctataaaagagaaaaaggaacatctgtcttttgtgcatgactttttctctcaaggattatactaaaatattaaaaatgatagtaggattacaaattatttttatcttcttttactgttatttttctaaataaccatatattatgtacctggtacatgtgtaataaaagtaaacgtatgtaataaaaataaacaagaaatgttttaaaagaagaagaataatagcatactcatgtgacctcccagtatttcagcggtgttgtttacaagggtgtcccggtggcttgcagggaggtacagtctgagaaggcagtcacgtaacggtgtgactgtgttaggagaacctgcgcgtattttttgagtgtcagtttgtgcaacacaccgtgcccagccttctgttctatttaagaactttgatttccattccattttcatttattactgtttaggccgaattttcgctaaacttctgactttcatataaacatattgcttatagaacatcagaagactcatctttgtgatgcccaaatgaaaaagttggtgaaggtagtaccattgtatgtatgttaatattaaagcaactgagtgtagatttgcaactata

SEQ ID NO: 173167 - DNA, 1361 bp, Homo sapiens
  misc_feature (1248)..(1248): n is a, c, g, or t
ggcgggcccagcgagcggacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagctttcagtggacacgctacagtttctgctcttcttatacattcaacagttgaacaaggtctccctaaggacatctttgattggcgaagagtggcccagtcccagaaacaaatctcagtctcctgacctgactgaaaaatctaattgtcataataagaactggaatgattacagtcaccaagcttttgtctatgatcatctgtctgatctcctcgagctgcttttagatccaaaacaactcactgcatcatttcattcaacccatagtagtctagtgtctcgagaagctgttgtggcgctcagcttccttattgaaggtacaataagtagagccaggaagatctatccacttcatgaacttgcactgtggcaaccactgcatgcagatagtggcttctcaaagatctctaagactttctctttctacaaactggaaacctggttgaggtcctgtttgactgggaatccatttggtacatcagcttgcctcaagtctggaaagaaattggcttgggctcatcaagttgaagggaccaccaaaagagctaagattgcttgtaatactcatgtggcccctaggatgcaccgactggtagtgatgagccaggtttacaagcagacactggctaagagctcagacactctggcgggggcacatgtaaagattcatcgttgcaacgaatcttttatatatctgctctctcccttacgatctgtgacaattagatttttcagtcaggtcaggagactgagatttgtttctgggactgggccactcttcgccaatcaaagatgnccttagggagaccttgttcaactgttgaatgtataagaagagcagaaactgtagcgtgtccactgaaagctgatttctctgcttttcaacttcctcctcaggagcgcctggaa

SEQ ID NO: 173168 - DNA, 583 bp, Homo sapiens
ggcgggcccagcgagcggacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaagacacctgaggagcgcctggaatggtctgaggttctgtccaactgcatgtctgaggaggaagttgaaaagcagagaaatcagttgaacaaggtctccctaaggacatctttgattggcgaagagtggcccagtcccagaaacaaatctcagtctcctgacctgactgaaaaatctaattgtcataataaggtactccttatatcttgatctc

SEQ ID NO: 173169 - DNA, 405 bp, Homo sapiens
ggcgggcccagcgagcggacgccgggcgcggcggcgcgcggagaagtgcggcggagcggcgcctgcattagcaggtatgcaaagaagccttttcaccctgatgtccttagagataatatggatcagtccagagttctcctctgggtgaaagcagaaccctttatagtgggtgccttgcaggtcccccctccatccaagtttagtcttcactatctcaggaagatatccacctatgtgcaaatccgggccacagaaggagcttacccgcgcctctactggtctacatggaggcacatcgcttgtgggaagctgcagttggccaaggacctggcgtggctttacttcgaaatatttgatagtctttcaatgaattcccggcgccctgaattcagactttcactaggt

SEQ ID NO: 173170 - DNA, 328 bp, Homo sapiens
tgaagaataacaagtctattgacagcagatttcttaacagcaacaagagatgctagaaaataattaaattttagctttaaaatacagatagaaagtaattatcaatctaacatctctataaagtatcacttaagagtaatggcaagagtgcagtggctcacgcctgtaatcccagcactttgggaggcagaggcgggcagatcacctgaggtcaggagttcaacaccagcctggccaacatggtgaaaccccatctctaccaaaaatacaaaaattagctaggtgtggtggcacacacctgtaatcccagctactcgggaggctgagg

SEQ ID NO: 173171 - DNA, 265 bp, Homo sapiens
cagatgccaggggcttccagcctgcaccctgcagcctgctggccaggcgcgccccatcgcgccccattgcgccccatcgtgccatgtgctaactttgcctcccagaggcggatcttgcgttgggtccacctcagagtccccggtgcccaccacagggtccccacagagcagaaatttggtgggtgcttgaaagttagatgaagtaggtcactggttttctctcccctggggctttgcccttcctctgtgcctttctgaaccccat

SEQ ID NO: 173172 - DNA, 484 bp, Homo sapiens
atgagccggtccaaccgaagtgccaaatatttgtgaaaagtcttaagaagtaagcaattttaattatgtatcttgatacagagcccagaaaaaaggacagagttatgaaagcaatgcctggagaaccaacccctcccagcattttcaggaggcacaagtgagccagggaagacatgtagcgtagctctgccccacagctcttggcctaggtgctgcagacatccacgtgtccccaggccttcccgtggccacttgtctataccccagaatcaaacaggtatcaacaatatcacagaagcaacagttttatgaccttaaacacctaccagaaataggctaaacctatttgactagtagacccaggcaaaaatctctaaattaaattctgaaaatatttctattttattttaccaacaattttaaaactagcctcatttaccaaagattactgaagtcacatgaacttgaaaagcatttgggctta

SEQ ID NO: 173173 - DNA, 2780 bp, Homo sapiens
tattccttcaatatccctttggaagagaggagtgacatgttcacatgggacccctatggaccatgggaaggctgtaccaaaatgtgtcaaggtcttcagcgaagaaacataacttgcatacataagagtgatcatagtgttgtgtctgataaagaatgtgaccacttgccacttccatcatttgttactcaaagttgcaatacagactgtgaactaaggtggcatgttattggcaaaagtgaatgttcatcccaatgtggtcaaggatatagaaccttggacatccattgcatgaagtattccattcacgaaggacagactgttcaagttgatgaccactactgtggtgaccagcttaaacctcctacccaagaactatgccatggtaactgtgtcttcacaagatggcattattcagaatggtctcagtgttccaggagttgtggaggaggggaaaggtctcgagaatcttattgtatgaataactttggccatcgtcttgctgacaatgaatgccaagaactgtcccgagtgacgagagagaattgcaatgaattttcctgtcccagttgggctgctagtgaatggagcgagtgccttgttacatgtggtaaaggaacaaagcagcggcaggtatggtgtcagctgaatgtagatcacttgagtgatggcttctgtaattcaagtaccaaacctgaatctctgagtccatgtgaacttcatacatgtgcttcctggcaagtaggaccatggggtccttgcacaaccacatgtggacatgggtatcagatgcgagatgttaaatgtgtcaatgagctagctagtgcagtgttagaggacacagaatgccatgaagctagtcgccccagtgacagacagtgctccgtatcttgtggaagaggtactcaagcccgctatgtaagctgtcgtgatgctcttgatagaatagcagatgaatcatattgtgcccacttaccccgacctgctgaaatatgggactgttttaccccttgtggagagtggcaagcaggggattggtcaccctgttcagcttcctgtggccatggaaaaacaactcgacaagttttatgcatgaactaccaacagccaattgatgagaattactgtgatcctgaagttcgccctttgatggaacaggaatgtagcctggcagcctgccctcctgcacacagccactttcctagttcccctgtgcagccaagctattatctaagcacgaatttgccattaactcaaaaacttgaagataatgaaaatcaggtggtccatccatcagtcagaggaaaccagtggagaaccggaccatggggatcatgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataaaaagatatttttattagctatcttagattggaaatccactttctgcttactgtgtctctgttccatcttctttcattttattggttttagtttgcaagcctagttcttaagaagactgtggattactttcttggaattttttcccaattaggagagcagaatcctaactgctaatgagattgaattgtaatggcatttgtttctgagcatagacgttttattttccctacccattcatgacttcaattcaccgagcattaaacatttacttaggtctcatgctttatattagatattgaagcaattaaaattaagtgtttgtgagtcagattctctgttttagaggtcagcaaactatggtccaggtaccaaatctggcctgttgcctatttttaaaataagttctattggaacacagtcatgctcatttgtttacgtgttatctatggctggttttgcactacagcagtagcattgattagttgcaatagaaactctgtaactcacaaagcctgaaatatttactatctaactttttctgggaaaagtttgctgacccctgttctatttaataaacattataatgcttttaagtttaacataaaaaggtacttagatttatagaatattaaaattacaaataattcattccaggtcagttttagatgtttttgatcctttgatattttacattttaaggtttatcaaccttctctacatatccactgtgatattcatgcaatgtttatgtaaatgtatctatactatattccaatatatttttgttatgctattttttgtatgtaaattatatcacaagtgaaaaatctgaatgctcattaaagtcctctgtatagatgacttttcaacctcac

SEQ ID NO: 173174 - DNA, 1769 bp, Homo sapiens
taatttaatactgtcttttattcctttctagtgagatctcaaaaactttaatttctttttacttaacacttatgatagaaatgaaaattgtttcctaatgcaaacttgaaagtcccaccttttcatcaacaaattctaatgaagctcccagtataactcaagtgttttgatagattttctcaattcaaattgtgattccaatgaaggagattctaatgtagggtttgattttgattgagtcaatgctgattttttttttttaccatgtaaattcattatgtggaatccgcagtttgtgcatattttgtgttttattcttgtcagtgctccagcagttgttctggaggtcttcagcatagggctgtggtctgccaggatgaaaatggacaaagtgctagttactgcgatgcagcctccaagcctccagagttacagcaatgtggtccagggccttgtccacagtggaactacggaaattggggagaatgttcacaaacatgtggaggaggaataaaatcaagacttgtaatatgtcaatttcccaatggccaaatattagaagatcacaactgtgaaattgtaaacaagccacctagcgtaatacagtgtcatatgcatgcttgccctgctgatgtgtcatggcatcaggaaccatggacatcggaggatcttaaagtgaaattgctgcctcaaaggaccatcatcttgtgggaactaatgaaaaacatattttgccatggaaagcactcacatatgtatttaataaatgtcgttactgaccatctactatatcctaggcactgtgatccagagacaattgaaacatatttcttatccctatggagtttacagtttacttggggagatttgaaatactataagaactcactataaaaagatatttttattagctatcttagattggaaatccactttctgcttactgtgtctctgttccatcttctttcattttattggttttagtttgcaagcctagttcttaagaagactgtggattactttcttggaattttttcccaattaggagagcagaatcctaactgctaatgagattgaattgtaatggcatttgtttctgagcatagacgttttattttccctacccattcatgacttcaattcaccgagcattaaacatttacttaggtctcatgctttatattagatattgaagcaattaaaattaagtgtttgtgagtcagattctctgttttagaggtcagcaaactatggtccaggtaccaaatctggcctgttgcctatttttaaaataagttctattggaacacagtcatgctcatttgtttacgtgttatctatggctggttttgcactacagcagtagcattgattagttgcaatagaaactctgtaactcacaaagcctgaaatatttactatctaactttttctgggaaaagtttgctgacccctgttctatttaataaacattataatgcttttaagtttaacataaaaaggtacttagatttatagaatattaaaattacaaataattcattccaggtcagttttagatgtttttgatcctttgatattttacattttaaggtttatcaaccttctctacatatccactgtgatattcatgcaatgtttatgtaaatgtatctatactatattccaatatatttttgttatgctattttttgtatgtaaattatatcacaagtgaaaaatctgaatgctcattaaagtcctctgtatagatgacttttcaacctcac

SEQ ID NO: 173175 - DNA, 218 bp, Homo sapiens
agacggcccacgactccggccctgttcaggtactgaggtaatgcatgttcaggctggaatatttgaatgctgtctagaggcacaagaaggaaatcaaagccacctgtggtcacattgcctcgagatggtttttgttgctactctggactattttttaggctcttcctccatgcacctattttaaagcacattcttccccatgatggagccatgcacct

SEQ ID NO: 173176 - DNA, 452 bp, Homo sapiens
ctagcagcgaccttccttctgcaaccccagggactaagacgatacacgaattcctgattcatctcaggacagactaactcagggcctcagcttacccacccctaaaatggattcgcaaagcccactaatacacagaagacacaggaagctggggaagggagtgtttcccggggacctagactgaggatccttgaatctgaaaagttttgaaggtaggagcaaacggaagtggtgggagcgagccggacaggcggctgcctgcacaccccgaggcggggactgtgtagaaatctggggctttaacaggggtaggagcccggcttggcgtctcctctgtaatctgtcccctccaggcctccgtattcagtgagccctgcagtccggctgcccgtcctccgcaggtttctttctgggccccatgccccagtgtcttagccctcattcccgagccc

SEQ ID NO: 173177 - DNA, 319 bp, Homo sapiens
gcctcttctgtggcaacgaggccaccatctccccctgccttgagcctccctgttccagctgccagtgtgttccaaactctgcccctctatcctctctcaggcaggcccatcctccttcaagatcccctcaccaggcccagctctggtctgaggcactgagaatggagccagcatgggaggcgagaggtgtggggttgtttcatctctcagggagcgtatacagccttccccggctccaggactgaactgcagacctggccgcactggaagtgggtggtccttctctgctggctctagggggctggaatggggtcacatc

SEQ ID NO: 173178 - DNA, 326 bp, Homo sapiens
aataattccacctcaatatgacaatcattactgaaaagtgctttttctaagatattcatgaagtagtcttctggctaaaagataatagtgctgtcattgttgatccaaataacttattatagtttatggcattttgttgcttgaaatattagtcaacaatatttatataacagtttatgtaacttttatgtaaaataaatcctatatagtattttaattaaaaataaaaatacccattcagaaaaaaaagttctaaattttattgttgttatataccagaataaactcataacaattttgcattgttatttttcattatatttttc

SEQ ID NO: 173179 - DNA, 310 bp, Homo sapiens
gtcctgggacaatattttagaaaaaccttatttcaacccaacactcctttaaataaactggcatttaaaacgtgtcttccacacgcagggcagttagagctgcacatgggagaggcctcctgggcagacagtggagagcccatggcgccgcctcagggcagggggcacttgctggggaacggcatctccatttgccgtcttaagtctaactgggatttgcctacacaggaaatactgacttgcagttcctgatgtgctgaacaaaaatgccagatttatgaatctacaaatgcatttctgttcactatcg

SEQ ID NO: 173180 - DNA, 421 bp, Homo sapiens
ggacaacagagaaggaaagctctggccccctcagactcatcgcttcacttctccccaaacgctcttgattcggttttgcacatagctggaaatgtgttcggcatcttaacactgggacgggccatcgaagtcagaatgtccttctagtagttgctctctagcacttaaactgggctctgacattctcttgagaattcagacatcagagaagaagtccccttcagtggaccccagtcatcaccgtgatcccgtcctgactcccgtcctcaccgtgatcccgtcctgactcccgtcctcaccgtgatcccgtcctgactcccgtcctcaccgtgatcccgtcctcactcccgtcctcaccgtgatcccgtcctcactcccgtcctcaccgtgatcccgtcctcactcccgtcctcaccgtgat

SEQ ID NO: 173181 - DNA, 926 bp, Homo sapiens
  misc_feature (22)..(22): n is a, c, g, or t
aggctagtagagccgggtgttnatcggcgaggaaatggacgctccacttaaggaggcgccgggaggcccaaagacatctccaggatgtaactgcccaccaggacctcctggtcccactggaagacccggactcccagggacaaaggtgccattgggatgcctggacgtgtggggtcccccggagacgctgggctgtccatcattggtccccgcggccccctggtcaaccaggaactagaggtttccctggatttccgggtcccattgggctggacggcaaaccgggccacccaggaccaaagggcgacatgggtctgacgggtcccccaggacagccgggaccccagggacaaaaaggagaaaagggtcagtgtggagagtacccacaccgggagtgcctaagcagcatgccagcagctctgcgctccagccaaataattgccctgaagggcgaacagagccaggccagcatccaaggtccaccagggcccccaggcccccctggaccaagtggacctctggggcacccaggactgccagggcctatggggccacctggcttacctgggcctcctggaccaaagggagacccaggataccaggctacacggcggaagggagaacggggcatgccagggatgcaggcgagcatggagccaagggggcgcccggaattgcggatggctggatgaagggtgagcccaggtaatcccagggaaccaagggtgagaagggggctgaaggctcccctgggcttctgggctctgggggcagcaggggcgaggacaggcgatgctggcccactcaattggaggaaggagaggggaactggcctcagggtcctgggccccaggcaaaggagaaccggggtcgtggcagttggccccagggagcagaaaagggacgggacgcagtggaaaagggac

SEQ ID NO: 173182 - DNA, 606 bp, Homo sapiens
agtggaattattctgcattttatagatgaagaaatggacttggaataattaagttatttacagctaacccgcaccccagatctcttgacctagccccctgcatcctgcctttgccccagagtgcttttaatgttctgcattgcatggtctttttgttcattttattttatgtatcatagttaatactaaactgaacgtttgctgctaagacctatattattttatattcccaatgaatatgacttctgcataaaaacatttaactagggtaatcattttatagtatgtgcctgttgtctctgctatatctatcaccttcatgtgaagacagagaaaatagaatatgctgtgtattcgaaataatttcttctttacaatgatgtattctagattctaacatttacatatgagagaagcttcataaatgttacgttttctgtggccgctatttctgtcttatctgtgctgtctacacagtgaggacagctgcagagacactgccagtctcatgaagtgtccattgtgaaggcccatgtgtcagtgctgctgatggcatgcaggagttggtcagtaggatggttaagaacatgggctctggagtggacg

SEQ ID NO: 173183 - DNA, 290 bp, Homo sapiens
tggagtcttattatcgaattctaagagttctttgtatattctgaatacaagttctttatcaggtacatgatttgtaagtatattctcccattccatggcttgtcttctacttttcttaatgggccgggcgcggtggctcacagctgtaatcccagcactttgggaggccaaggcaggtggatcacctgaggtcaggagttcaggaccagcctggccaacctggcgaaaccctgtctctactaaaaatacagaaattagctgggtgtggtggcggtgcgtgtaatcccagc

SEQ ID NO: 173184 - DNA, 884 bp, Homo sapiens
  misc_feature (867)..(868): n is a, c, g, or t
ccgggttcccgctcccgcttctcccaccacacttccctgcaagctgagagaagcggctctggccttgggcagcccagaaaggggctccctcagtgcagcggtgggctgaagggctcctcaagtgccgccaaagtgggagcccaggcagaggaggcgcccagagcgagcgagggctgtgaggactgccagcacgctgtcacctctcagaactatttactcagaatgagtgaagagacagtcttgctctgttgcccaggccggagtggagtggcacagtcataattccctgtacccttgaaatcctgagctcaagccatctccataccttagcctcccaagtggctactacagatatttattccaaatcaatcctgcaccagaagctccatttctgcattcgcttccagaaaacacagcagccgtatgtgaatttgggagtggtcccacgaaccggttatgagacgaggttttggagctggatcacacctgacacaactggcattgaaaaccttattaccaagagcctctggcacaaggctgctatgaagaaatacccaagactgggtactttctcaactttcaaattgagctgttcagaatgtgtgaacatttaagatgagtccaagatactgaagcagagcggattgagagcggatataaccattaagcagatgcgacctatgaagatctcataagaccggtcgggttagggtcttggtttaacagccaggtttgcaggcccgaaactgagtattaagtgtggatctgggcggtaaaggcggcagtttcccaagcggttggttgggaaaaaaaaatgggcgccgtttaagggggaaatattgagtaggtacggcatgtttagtaagnngggtgatttgacggta

SEQ ID NO: 173185 - DNA, 1050 bp, Homo sapiens
agcgggttccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtgcgcggtcctcctcagccccgcgccccatccagcccaggcgaggccttcgaagcccgtgatagcctcggaaggggtccctggcaggggctcagaactactgtagagtacttaaagtaaataagtagaagctcagcgcagttacaattccaagtaccttaggagcaaacctgagttcaggttacttgatttaaatcaatgtctcgcggctggcgtgaattgaacttaagtactgtggctacattgtcttcattctcacttgacctaacatcccattggcagtaggcgcatttactgtagatcacatttgagtttattaaaatgctggacttgagtcagaatcccatctctgctattcactgggtgtgtgaacttatataccgagtctcagttccccattaaatgagaatgatagctcacagtagtaaaggtgaagtaaaacaaacaattttac

SEQ ID NO: 173186 - DNA, 3368 bp, Homo sapiens
agcgggttccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgattctgaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaagatccagattcttctgcaacaaatgaggaaaaggatttgaactcagaggatcaaaaagccttcagtgttgaacatacaagctgcaatgaggaagaaaatttcgcaaatatgaaaaagaaggccaaaataggcattcatcacaaaaatagtccccccaaagtcactgttccaactagtggaaatactatagagtctcctcttcatgaaaacatctctaattcaacatcatttaaagatgagaaaatcatggagactgatagtgaaccagaggaaggtgaaattacagactctcagactgaggatagttatgacgaagccattaccagtgaaggcaatgtaactgcagaagatagtgaggatgaagatgaagacaaaatttggcccccatgtattagagtaattgtcattagatcacctgtgttgcagataggatcactctttatcattactgctgtaaaccctgctacaattggaagagaaaaggatatggaacatactctccgaatccctgaagttggtgtcagtaagtttcatgcagaaatttattttgaccatgacttacaaagttatgtccttgtggatcaaggcagtcaaaatggcacaattgttaatggaaaacagattcttcagccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaagaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatacgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatg

SEQ ID NO: 173187 - DNA, 2639 bp, Homo sapiens
tgggtcatagctgactctagaggataaaaccgatgaagatgccgctttctatcgaaacttctattttgaattctaaagaccatttacaagtagaaaatgatgcttaccctggtaccgatagaacagaaaatgttaaatatagacaagtggaccattttgcctcaaattcacaggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgattctgaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaagatccagattcttctgcaacaaatgaggaaaaggatttgaactcagaggatcaaaaagccttcagtgttgaacatacaagctgcaatgaggaagaaaatttcgcaaatatgaaaaagaaggccaaaataggcattcatcacaaaaatagtccccccaaagtcactgttccaactagtggaaatactatagagtctcctcttcatgaaaacatctctaattcaacatcatttaaagatgagaaaatcatggagactgatagtgaaccagaggaaggtgaaattacagactctcagactgaggatagttatgacgaagccattaccagtgaaggcaatgtaactgcagaagatagtgaggatgaagatgaagacaaaatttggcccccatgtattagagtaattgtcattagatcacctgtgttgcagataggatcactctttatcattactgctgtaaaccctgctacaattggaagagaaaaggatatggaacatactctccgaatccctgaagttggtgtcagtaagtttcatgcagaaatttattttgaccatgacttacaaagttatgtccttgtggatcaaggcagtcaaaatggcacaattgttaatggaaaacagattcttcagccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaagaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatacgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatg

SEQ ID NO: 173188 - DNA, 501 bp, Homo sapiens
gtttttaatgatatgtacaaatacttacattaggtcaaaatttttcaaattataatctctagtaccaaaggagaagaggtaggacatattctaaatttttcatggtaattaaaggtagatttatagatgacattttcttctatagcctctgtttctaccagaagcatataatagtttgtgtttctaaaaaagtattaagtataataaaatttaaattatcaaaggctcaagttaacatcatcatatcatacagaaaacttgtccatagttttgaaaagtataataattaataattgcttgatttcactttctaagtttcatgcagaaatttattttgaccatgacttacaaagttatgtccttgtggatcaaggcagtcaaaatggcacaattgttaatggaaaacagattcttcaggtgagtgtatatgtgttaatttgttacctgcacattatttttaaactgatttttttttatttctgaagggcataatctttatca

SEQ ID NO: 173189 - DNA, 1219 bp, Homo sapiens
agcgggttccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtgagtttcagggcgtcatggccaggggccaccgcggccagccgggtgtgaggctgcctttcgctgcccgcgcgctccagtggtctctgggtccgccggcgtccgtttcggcctgaacgcagcccctccgcggcgacgagcagtctcgcgccggagctcatggcctcggaggcgccgtccccgccgcggtcgccgccgccgcccacctcccccgagcctgagctggcccagctaaggcggaaggtggagaagttggaacgtgaactgcggagctgcaagcggcaggtgcgggagatcgagaagctgctgcatcacacagaacggctgtaccagaacgcagaaagcaacaaccaggagctccgcacgcaggtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggtaataaaatgctaaacatgaaactgttgatgcccaagaacctgtccttctttgttgttattatgtggaaagatagacttctttggtccgtcacagcatatataagggttataaacattcttatgtgtaattatgcaaagaatgttgtagtttttccaaaaccagaattagaacttcttcatatatgtagtggttttcctactacattgtgttccaaaattttgtgatctacataaactaaaacaaaatttgtccagatattttgactgaacaaaagaactgtggacaacaataccacatttacacctaaaaaaaaa

SEQ ID NO: 173190 - DNA, 2999 bp, Homo sapiens
agcgggttccgcctgccgctggcgccgttgtttccggctcaactggggagctgctggagctcttctggcctctggttttccgactgcttatccgacgctcctccctctgtctctgtagctggagaaggtagtttccaggaaagttttccggtttgcaggccgcgcacatcgggcaggggccatcctcggtccccttgctcgttgctcgcagccccgttcggctacaagtggaagaactcagtaaaatactccaacgtgggagaaatgaagataataaaaagtctgatgtagaagtacaaacagagaaccatgctccttggtcaatctcagattatttttatcagacgtactacaatgacgttagtcttccaaataaagtgactgaactgtcagatcaacaagatcaagctatcgaaacttctattttgaattctaaagaccatttacaagtagaaaatgatgcttaccctggtaccgatagaacagaaaatgttaaatatagacaagtggaccattttgcctcaaattcacaggagccagcatctgcattagcaacagaagatacctccttagaaggctcatcattagctgaaagtttgagagctgcagcagaagcggctgtatcacagactggatttagttatgatgaaaatactggactgtattttgaccacagcactggtttctattatgattctgaaaatcaactctattatgatccttccactggaatttattactattgtgatgtggaaagtggtcgttatcagtttcattctcgagtagatttgcaaccttatccgacttctagcacaaaacaaagtaaagataaaaaattgaagaagaaaagaaaagatccagattcttctgcaacaaatgaggaaaaggatttgaactcagaggatcaaaaagccttcagtgttgaacatacaagctgcaatgaggaagaaaatttcgcaaatatgaaaaagaaggccaaaataggcattcatcacaaaaatagtccccccaaagtcactgttccaactagtggaaatactatagagtctcctcttcatgaaaacatctctaattcaacatcatttaaagatgagaaaatcatggagactgatagtgaaccagaggaaggtgaaattacagactctcagactgaggatagttatgacgaagccattaccagtgaaggcaatgtaactgcagaagatagtgaggatgaagatgaagacaaaatttggcccccatgtattagagtaattgtcattagatcacctgtgttgcagataggatcactctttatcattactgctgtaaaccctgctacaattggaagagaaaaggatatggaacatactctccgaatccctgaagttggtgtcagtaagtttcatgcagaaatttattttgaccatgacttacaaagttatgtccttgtggatcaaggcagtcaaaatggcacaattgttaatggaaaacagattcttcagccgaaaactaaatgtgacccttacgtacttgagcatggagatgaagtcaaaattggagaaactgtcttatcctttcacattcatcctggcagtgatacctgtgatggctgtgaaccagggcaggttagagcccaccttcgccttgataagaaagatgaatcttttgttggtccaacactaagtaaggaggaaaaagagttggaaagaagaaaagaattaaagaaaatacgagtaaaatatggtttacagaatacagaatacgaagatgaaaagacattgaagaatccaaaatataaagatagagctggaaaacgtagggagcaggttggaagtgaaggaactttccaaagagatgatgctcctgcatctgttcattctgaaattactgatagcaacaaaggtcggaagatgttggagaagatgggttggaagaaaggagagggcctggggaaggatggtggaggaatgaaaacgccgatccagcttcagcttcggcgaacacatgcaggcttggggacaggcaaaccatcctcatttgaagatgttcaccttctccaaaacaagaacaaaaaaaactgggacaaagcacgagagcggtttactgaaaacttcccagaaactaagcctcaaaaagatgacccagggaccatgccttgggtaaaagggactttagagtgaaggctaatcatagaaagaaaacctctagtttttttaaaaatagaatttggaaacttattttttctccccaaaagaatcagcagcacaggggaactatgtcacagtttacctcttcctgattcagaaatgtgtatggtttgcagcttttaaaaaccatttttttaaaactaataaatagtgactgaaccaatttatgcagtaaatagactaaagttcacagggcacggatgagtttatcaaacttcgttattttatcttcatttacaacatccatataagcaactagccatataagcaaaattcatagaactactaatgacttaagtgtacatctgttcttgtctccatatattcatgtaagatgcacaacaaaagaaacatcagaagtttataaaaataaatctgactatacgcatcctcatttattccctttagaacctaggtaaaaaatgttgcgaaaacatgggtagtggcgcatacattttgttatccttgaaatagcctaagtaatgttattgaagaactaatgaacaggtaacatattgtagaaaattagtctttcattgttttcttctgtgaagaatctgttgctatgtactgtatattcagcatttatatttggtttgtttcatagctaatgaggtatttagatatgaacaactgaatacatattgaaatagtgtgctggcttttgtagttttgataaagaccattgcaggcaatggaattgtgccagagaaatctgatttctagtacaaaaggaatacttagccagggcctcaagctcaagatacttattgaaaacatcctcaattgcaataaaaacattataacatg

SEQ ID NO: 173191 - DNA, 531 bp, Homo sapiens
cattttaacaaataattagccaggcatgccaggtgcggtggctcacgcctgtaatcccagcacttgggaggccaaggcgggtgaatcacctaaggtcgggagttcgacaccagcctgaccaacatggagaaaccccgtctctactaaaaatacaaaattagctgggcttggtagtgcatgcctgtaatcccagctacttgggaggctgaggcaggaggaaccgcttgaacccaggaggcggaggttgaggtgagtcgagatcatgccattgtactccagcctgggcaacaaaagcaaaactgtctcaaaaaataaataaataaataaataaataaaaattagccaggcatggtttgtccacctgtagtcctaactcctcttgaggctgaggtcagaagctcacttaatggcaggagttcgaggttacagtgaactataattgcaccactgtactccatcctgagcaacagagcgagaccatctgaaaagaaaaaaaattgtaagtaaggaccaggtagccactcagaaata

SEQ ID NO: 173192 - DNA, 246 bp, Homo sapiens
gatcatgtgaacctaggagtttgaggcttcagtgagctatgatcacagtgttgcactccaacctggctgacagacactctgcctcaaaatcaatcaatcaataaattttaaataagaaaaaacataggctatagagagtttgttcataaaaatacgatatttcaaaacgtgggatacaattaaagcaggacttagaaatttataaacttaggccaggtgtggttgctcatgcctgtaatcccagca

SEQ ID NO: 173193 - DNA, 117 bp, Homo sapiens
tgaggtcatggagtaactggaaccgtggtgcagccactctggaaagcagtatggagcttcttcaaaaaattaaactggactttatagatttgctgtttcatccagcaattccacttg

SEQ ID NO: 173194 - DNA, 496 bp, Homo sapiens
cgtatgacctgattcctgtgctgtcaacattcatcagttctcttctttctctgctagtcaacctcacccactcaggtgtgaccacgaggaccagagccgaggtctgggcaagagtgctcacagctgaagggcttatgacacacaccggctcaacgggacagacatgggacaagtgtgcctgatcatggtggcgttgccaagaagcagctgtcgcactgccatgggttctacgtgtttcttgggcagaggacgcatgggaccagaatgggcaccaggaatggtggtgaacaaaggccccatggttctgcatgtttaggtgtctcttgtataaaggcacattgtgaattgaacatttagtgcccaggagcctcatgcatattaagtatctcttggcccttgtgtctcttccttcccacatgtaacatacctgttctctgtaactatctattctgaacgtatctaaaaaccatgtcttgcctgtgttatacaaaccaca

SEQ ID NO: 173195 - DNA, 472 bp, Homo sapiens
  misc_feature (452)..(453): n is a, c, g, or t
  misc_feature (460)..(460): n is a, c, g, or t
atttacaatcatgaacagaactgttctctggccttatagattacatatccttagcaaaaactgctgcatttggagtctaaggaaaggagaagatgcattagttagagaaaaccaggtgtaatttcagaattcactgtctccatttgtattgcattcactggagctgaccctctaaacctacaaattctggggttcccatgtattttttggatgtgcagaagactccttggctgtgtggaggattcttgtaattggtctgagttttctgtgtctgagatttctgtataaaccttcatttcttgtggcgactaccactaattctctccagcagcctgggagagaaagaaatggttggagtattttaccaggattcctagcacttctgcattttgcacttgctttttttttttttttttgggaaagggattccaaccccggcgggggaagggaanntttgttnaaaaaaaaagaa

SEQ ID NO: 173196 - DNA, 995 bp, Homo sapiens
aaaatagagctaggtacagaggccttgtggtgaatcgaccgaggcggcccgtggtgtcgacatgaccagtgagctggacatcttcgtggtggaacactgacccttatctgacgaggacgtgtatcgcctctggctcgatgtgttactcgtgtgacctgacgcggtggccctgcgtggtgcgctcgtgtgaatcctggagcagactggcgccacggcagcggtgctgcagagcgacaccatggaccattaccgcaccttccacatgctcgagcggctgctgcatgcgccgcccaagctactgcaccagctcatcttccagattccgccctcccggcaggcactactcatcgagaggtactatgcctttgatgaggcctttgttcgggaggtgctgggcaagaagctgtccaaaggcaccaagaaagacctggatgacatcagcaccaaaacaggcatcaccctcaagagctgccggagacagtttgacaactttaaacgggtcttcaaggtggtagaggaaatgcggggctccctggtggacaatattcagcaacacttcctcctctctgaccggttggccagggactatgcagccatcgtcttctttgctaacaaccgctttgagacagggaagaaaaaactgcagtatctgagcttcggtgactttgccttctgcgctgagctcatgatccaaaactggacccttggagccgtcggtgaggcccccactgacccagactcacagatggatgacatggacatggacttagacaaggaatttctccaggacttgaaggagctcaaggtgctagtggctgacaaggaccttctggacctgcacaagagcctggtgtgcactgctctccggggaaagctgggcgtcttctctgagatggaagccaacttcaagaacctgtcccgggggctggtgaacgtggccgccaagctgacccacaataaagatgtcagagacctgtttgtggacctcgtggaga

SEQ ID NO: 173197 - DNA, 787 bp, Homo sapiens
aaccaggcgtggtggtgggcacctgtagtcccagctacttgggaggctgaggcaggagaatggtgtgaacccgggaggtggagcttgcagtgagctgagatggcaccactgcactccagcctgggcgacagagcgagactccgcctcaaaaacaaaaacaaaaacaaaaacaaaaaaaacccataacacttatcacagatgacactatcagccaaagctatttcactgcttactcattaaacagacccaacactgaaacaatgccaaggattcatccattcaaatagaaggcacccaacatatcattttagggttaaaaagcacacaattgattaattagaaatcttagttaggaggagtttgtatcctagacttgacaggtaaaacaagctgttatcaacaatttattttttaagcccctccagtgaggccatttcagtcatatactgtgatcagtccatagttagattaatcttccgcaccttcatttgttgcggtaggtgttcaatacatattgttgctcagaatagtgatgcaaaagtgctgccaactaagcacaatcaaagaaaggctcaaggatccatgagtccagagagtaaacaaagtggaatacccattatatgagcatctcacttgatgaagaggtcaaattcgttgattgttttcctttagaccaggtgaagtgaaaattttgcagatttccaagcaataaacatcttagccaagagccactggactcatttagattatgtatctacgctgatttaattcatcaactaaatgccag

SEQ ID NO: 173198 - DNA, 236 bp, Homo sapiens
tggagggttatgtactctcagagcttcacctgttacattcgcatggacagcccctctccggctcagccccgactcctcccctatactcccttgtcagttgtgcctagaggtcccgtcagcatttaaaacagcattttaaaactaaattcatcatcattcatgagagcggttcccatcttcttcttttttttttttttttttttgccaccttagacttctctttatgaatttctact

SEQ ID NO: 173199 - DNA, 624 bp, Homo sapiens
aagctctcagtgggccagctgagatcacgtgaccagcctgaaccaatcactgtgcctgtggagacacggtggctctgattggcctggcttatatgtgttgcttggatctagaggtaggataaagcccactcaggccacatggacagaaagaaggaagagagagagggctgaaggcaggggcaaggcaaatgggtgctgtgtagagacaggcaaacccagcagatgccctgagcctagacctctggtatgctgaatgctggaagccattgggtttacttatatatatttcacggtgctgagaaacatctgtttgcattatttatttgtgaatcattcctaatataaattgtgttgctgttttaaatttcctatgaaatacgtttttaagtatcacgatattgcgtagtcaaatgtaatattgtttttgcacatggttctgtatacatcatagattctaaattaaaacttttgatagaaattacaaaatttgtgttaccttactgtatgggcatatttaaaagctaacatcctagtttctggagattctgatctaccaatatttcccatgctgaatcataagcttcagcatttctttaacaatatctcggcgtttggtataaaacc

SEQ ID NO: 173200 - DNA, 264 bp, Homo sapiens
aatgcaaagcgggggggccagacctcagtgcttcactgtggcatttgccgccagtcccatcggagccccaagtggctcattctggcctccctgctagcacttcattctttgcctttggtcctcgcctgagtggggagttcctgacagctgttccccagggctgcctaccccagaagccttcgtgtggcagagaggataaggagccacccacatataatgaagagttggcagtgaaactctggggggaaaggtattggcgagaag

SEQ ID NO: 173201 - DNA, 251 bp, Homo sapiens
aacaaaacatagaaaagtcaattttttcctcagttagttaaggaaaataggtgagaattaaacccaagccttctagtatttaacctgggattgagtttgtattttggttattataaagataagcatattgatttttgtaactatgttaaaagcttctgtgggctaagcacatctataaaattaacgccactttgttacaagtaatggaaagtttttcatttaaaagagtgtaggtctactcaaatccaact

SEQ ID NO: 173202 - DNA, 313 bp, Homo sapiens
agcctggccaacatggtgaaaccccatctttactaaaaataaaaaattttaaaaatgagccagtcatggtggtgcatacctgtaatttcagctactccagaggctgaggcaggagaattgcttgaactcaggaggcagaggttgcagtgagccaagatcgcaccactgcactccagcctgggcaacagagtaaaactctgtctcaaattaaaaaaaaaagtatttttactattttttaaactgtcgctggaatagaaatagaatttatttttatgttgtcatttgtatttctataaagttaatcatgttactt

SEQ ID NO: 173203 - DNA, 187 bp, Homo sapiens
tgctgggattacaggcgtgagccaccacgcccacccccacagtcttaactcattacagcattttggtcacaaccatcgaacaagtctctaagaagttccaaactttccctcatcttactgtcttcttccatgccccccaaacgcttccaagctctgaccgttggggccctagatctcctcaaccagc

SEQ ID NO: 173204 - DNA, 825 bp, Homo sapiens
atctgccaagtcttctttgccatgaaaggtaacatattcacagtctccagtgatcaggacatggacatctttgtggggccatcattccgcctagcacagtcaattatacattcctatgtaaaaaataggaaacatttctctatctctcaccacacacaaaaatcagttccagatggactgtaactctcaatgtgagagtgaaaaataaaggtttagaagatatagaaggatgtcttcatgatattggggtagtgaagaatttcatagccagaatacaaaaaacaaaaacaaaaaacaaaaaaaaccccttaagattgagaaaatgacctagattaaaattaagaacatctttttattaaaagattctattaaaaagtgaaatgaaagccacagagtgagagaaggcatatggagcaaatgtccacgtaggcattcaccccagcaaggtggttatcactaggctaaaactggacaaagaccgcaaaaagatcctcgaacggaaagccaaatctcgccaagtaggaaaggacacagggcacatacaaggaagaaaccctggagcaagatgcaggaataaggtaaccttatgtacaagcttgattaaaacttggaacaaaaaaaaaaaagaaaagacgtaggtaacagaacagaagcagaaataaaaaagagtggggaagaacaagaaaaaaaaggtgtggtggggacgacaaaaagataaaaaagtggtgggggcgccaaagaagaaagatattcaaaaagacgggaagagtgggccacaaaaacgggggaggtcaaaaagagatggatggtaaagaagggtaaagg

SEQ ID NO: 173205 - DNA, 480 bp, Homo sapiens
atatagtgaaagcttaatattgtttagattagaaatataaaataattttgattattagacaatagtactattgagaaactatatgaaatttaaaacactaaaaggtaagcctgttttcttaacatccaataacctttaaatattttggttactctgaatacacaagtatcttacatactacaaagtgtgcaaaggtagcgtgtatttgatgagggcatttactgaaccttccaggtggtggttatatattcatacttgaagaaactcatcataatttcaggcactagtcaggacagtctttaattttatgtgccaattttttttgcattttatttttttgtagagacagggcctgctgtgttgcccaggctggtctcaaactcctggtgtcaagcagtctttctgcctcagcctcgcaaagtgctgcgcgattacaggcatgagccaacatgcccagccttgtatgccgtttcttttttt

SEQ ID NO: 173206 - DNA, 391 bp, Homo sapiens
ttcgtgaggtttgggaacataaatggttaaagtgcatgggccctttaagaaacaaggtgcagggctgtaagaaaatattcctagacaaggtcagacggaagtggaaggtactggagctgttgtttctctgcatgtggtgaaggagtattttgtggatccaaagtagacagggcataagcagaaaatgcaggtgaccccagcagccgctgagccggcctggattcgggcaaagaaagcagcgtcctcctggtgcaaacagacacagccacaagtgcaggacacgcagtctagaaagtccggaaggtaaaataaggtcttttaaaaaatacagcttgggtgtatatttaaggcacaaatatgagatacattacatatttgtaattacaaagag

SEQ ID NO: 173207 - DNA, 247 bp, Homo sapiens
attctgtgttactggctatgttgtaggtatttcacaagctgcctaacttgttgctggaggcagagagatggatgtggaagggaaagctgattctttcaaaaataggagggtaaagactattctctgtgcatatgagcctcaactacaacaatccaaacttttggttcatattgcatttttctttgttatcctccagagaataaagttaaaattgaaccccagagacaccagagagccaaggcactag

SEQ ID NO: 173208 - DNA, 162 bp, Homo sapiens
gggaagctgaggcgggcatgggagaattgcctgagtccagcagcttgaggttattgtccactgcactccagcctgggtgacaaacagagactctgtccctaaaaagtatgcaatatttaacctgctaatcattaagaatcatataaatgcattcttttgaca

SEQ ID NO: 173209 - DNA, 492 bp, Homo sapiens
tcaggtggacacacaggtctgagtgtgttaaacactattacctacaggcacagggtgaggtgttccagacagaggtacttgcctaagccagagccagctgctgagctgcagtatcttgggaattttatttccttaacatttcttggtttagcaaggtccatggcttgatacttttaatctccacgaaatcatcaggtacaggagggattcatgatcatcatggtggcagaatcacagggagttctatgacaacagggaatcctacacaaaaagaactgggtcctctagaaggaaaaccagtgcctgttgcgataaaaaccagcaacacctgcagggcatcatcatcactcgccactcccaaaggccgcttcctggtctgcattttcttgataaagctaattcctataaaataaagagggaaacaatccacgtgtgcttatgtgatgaattttatttttgtcaagaggccctaagtccgtataagtacaacca

SEQ ID NO: 173210 - DNA, 236 bp, Homo sapiens
ccttaaaatctctgccttaaactgcaccagcccccaaaaaatccaaggggggaaagcaggcggggggagagcagattcccccctccccctctcctctcccatccctcctccttcctcctccctttgagttaacaaggccccgctcactatatctctttatattaaatatatatatatattagagaagagcgagggagagggagaaccacctccacccccctctttaaattcttttt

SEQ ID NO: 173211 - DNA, 766 bp, Homo sapiens
aaaccatacatcttctcagatgctcaaaggccttcttcctttgggtccaaaggaacttttccccaccatgacattgctacctctgtggctgccgtttgtatttctctgccagtgagaacagatcacatagcccaggaaattcacagtgctgaatcacgagaccacagccagactgcagggaggactctgacatcaagctccccagacagcaaagtcacagaagagggcagagcacagaccctcttgccagggagaccttcatctggacaaagaatttcagattcggttccactggagtcaactgaaaaaactcatcttgaaataccagcttcaggaccaagttcagctagttcacaccacaaggaagggagacacaagacgttttttccttccagaggccagtatgggtgtggggaaatgactgtcccctgcccctctttaggaagtgacggtaggaaacgtcaggtatctggattaatcactcggaaagattctgtggttccttctaagccagagcagcccatagaaattcctgaagccccttctaaatccctcaagaagaggagtctggaaggaatgagaaagcaaactcgagtagagttcagtgacaccagcagcgacgatgaagaccgattagttatagaaatatgaagcttccagagaaacatggtgtctggtcaaaaagactgttgacgcttcacaagtaaatgttgtcaggctggcggaagaactaaactctatctgtgaaacacctacagattaggaa

SEQ ID NO: 173212 - DNA, 337 bp, Homo sapiens
gctaaacttaattagtccaacgatcctacacatcaaaccctactgtttgatgtattctgcgagatgtccaagccgcctacagctggctaagggtcacaatgaaaaggcagccaggcttaggtctgggaactgaaatgagctgttctaagtggagcttttcttccattttctgaggctgcactgctctgaccttctccaaatcaatcctttgcggattaacatgtaaagcagtgtcgaattaatttcagaaagggaatatgagatcagcctaggatcatacaaaacatctaactcctaaatacactaatgcttctagccattcaatgagaagctgtca

SEQ ID NO: 173213 - DNA, 183 bp, Homo sapiens
tagtataataagcaatttagtgcaagttgagaagcaacagggaataaagctggaaaatctggaaaaagataaatcatacagagtaaagcaataccatgctatgaaagttggtgtccatattggaggtaatgggaaataatgaatgattttttgtaatataagacatatgtaataactcactgt

SEQ ID NO: 173214 - DNA, 601 bp, Homo sapiens
ggaaaagccaaatagagtatcttaattatgccaaatattctggcacagtctcagattcatgtatttggtcttgttgtctccagatccacatgtatttgttctagttttaggatctaaaaatttgggaatctaaaaatgtggccccaataactatgctacactcattttacataaagttatcttaagggaacaaaacacctacatggattactccaaatctttatgttaatttgaagccagcaagaggttgtatttgtacctgtaggtgttacctgacctcaagtgagtctatgtatgttctggttctgcagtatcttcttgttttaagttatttttttaaaattcttcttaaattttaatttaaaaaaatttctcatccaagctttaaccaacatggaaaatttcaatggaatcattgttctggttaaatactaaacttacttaagtgaaaatgctcaaataaagattaacttttgttttttggctgggcatgtggctcacacctgtgatcccagcactttgggaggatgaggcaggtggatcacctgaagtcgggagttctagatcagcctggccaatgcggtgaaaccccatctctact

SEQ ID NO: 173215 - DNA, 152 bp, Homo sapiens
atcaatattgaattacactgtgggtaggtaacttgtgctgaatcctgtcatcagatcttttcctgaaaagttttaatgactgaagaggcaaaagaattcaaagctgctgctcctaaaatgcagtgggagcacagagtgatgtaaatggcccc

SEQ ID NO: 173216 - DNA, 443 bp, Homo sapiens
cttttccattaaaaagaaggaggaaaagagaaggagagcaagagaaaaaaaaattaccttatatgtctgtcttcttatataagaaagtgacaccatacaaagaaacaactattcaggctggtgctagagggttggggagccgaggaatccctggggagcagtcacagggaattccatccaaaagtccaacatgcagtgaatatcccacaaatgttagtggtgcctctgcagaggtagcaatgttgaacgcctcgagtattcccggatgattttgattaatttcctcattccttttctcctgagtccagatatccccagcatagattgcttcccacatagtatctccaattttaagtaatatatagtctaatatctgtttctttattggctaagtgtctttctctgcgtctcctctatatcatcaatagtcctctgtcatcttt

SEQ ID NO: 173217 - DNA, 504 bp, Homo sapiens
aactccgcaactccagctctgtgcacctgcggaaactgaagctcgggagaccgagaccggacccagagtcacacaaacgggcaaaacaggaggacgtggggctgggcccggcccgctgacctccaactccgagtctgcgccctcccttacctctgcccccagccaggcccactgacccccaaccctgagccctaggcctccgcccagaacacagcggcgagcgaagtgtggagtaatgcgcacagtccctttaagaggcacaaggccctgatcgcgcggccccgacaacaacaattccattggctggagcgtgatctctggccacgcccccacactaaatatttggagtcctactggtccagagcccgggccccgcctccctcgccctctgagcccgggcgccgcgccaggttcgctgacgcaaacgcgttgccccggcaacctctccccgtccccggggcaaaggggccccggcactggagccagtgcgcaggcgcgcggccg

SEQ ID NO: 173218 - DNA, 379 bp, Homo sapiens
gtcccaagtcctgctcctggtttgctggcttgctcgtgtaaaccaccttatattatttttttttctaaaaatactccaaagcaattgaaagagtcccttctcccaccagccagccctggccccagccccagccccggggagcgggcgggtaggcggggaggtgggccactgctttattaaacacagggaaaactaatatttacggaataaaatttatggagcagccacgagaattcgacccttttatgtgcatgtagagtgggggttgggccaggctgggggcctcagggaggggcccaagccagggggcagggctggaatacagcctggctaggccaatttgtcaaagcagggatttccctggagttgccttaggatg

SEQ ID NO: 173219 - DNA, 337 bp, Homo sapiens
tcttgaagccaatggcaggaagagcaataagaacacatacttggaatgcatctgccctgcaaacatcttggtgttttccacctcagttaggctgtacatccaaatatgcacacaggaagacctcacacatgcttaatgttaagggcatgtgaaaaatgtcaaatacaagttaactcttgcaatgcttacccaacatacagctaataagttaaattctaatattctaaaagaattaggcaaacatttagaacaagcctaatttatttttctgtgttccattctgaattaaacagtgggcactacaattgtaaaccatctaataatttttgtttatttg

SEQ ID NO: 173220 - DNA, 213 bp, Homo sapiens
ggctatctgtacaactcccaataaacccttttatgtagagctctcgaaggccagtctgtggcaccactctcaaagactgcttcacacatcttttttcttcttgcagggaactggcaagtcacacatcttattcttgactccctcctttggaagcctgtttgtttaatgtaagccttttgtgtgcgtgtgctttttttttttttcgggagggac

SEQ ID NO: 173221 - DNA, 1279 bp, Homo sapiens
ggcactcactccttcccgccgcttatgaagaagatgcctgctcctctttgccttctaccgtgtttataagtttcctgaggcctctccagccatgcagaactatagggtttcactgtgttgaccaggctgcacttgaacctctgacctcaagcaatccttctgccttggcctcccaaagtgctggaattatagtcatgagccaccacacccagcccctaagtggacatttaatccatgtacattcaaggttattattgtctatatttgatataatcaaatacttagtcatttttaaattattttaatagtttcaaatatatttgttaaatttgctctatttgaatcaggatctaaagaagtttcaaagttgcatcagctaatatatctttttagtttttaaaaatatatatgaattcctttctcctgctttttagctctgtgtatttgctgaataatccaggatattcatcctgttgaatattccataccttgtgattatcttattaaatcctacggtgttcttgcatgtttctctcctcgacatatttcctgtatgtgccataaaatagagaatatttaccaattaggctcatttctagttggttctatgtgctccatattatactttatgtgtattcacttcatgtgatataaaaattgatcagtaggttcaggtattttcagctgattcattccatatatgttttcttctgaaacagttattcgtcattttagcttctattggttgttatcttaggcccattaattcattgggttccaaatgaatttgtctgtatgttagtgtcccatgaaacaattcttttctccgatgttttataacttaattaaaaagccagatcttgatttttagcagttgtaatttttttctgttaatttaattacatttttatattacataaaacagctacatgatttcaaagtcaaaaatataaaataagatgtattcagaataacttttatccctgtgccttgccctgtttcctcctcctgccataagaaaattatatatgtattatgtttttgccattttaagtatgcttatttaaacatttataaaatatatacttatatatgcatgtaaatccaatgtatttatccctgttttaacataaaaatagcattctggtggcaaaaaaaaaaaaaaaaaaaaaatgtggggggggggcgaaaaatttataacttgtggcggggccaggagaaagggaaaggtccagaacggcggaaggtgggtccaaaaaaacgggggggtgaacaaggg

SEQ ID NO: 173222 - DNA, 394 bp, Homo sapiens
actacaggcgcccaccaccacccccagctaatttttgtatttttagtagagacggggtttcatcatgttagccaggatggtctcgatctcctgacctcatgatctgcccacctcggcctcccaaagtgctgggattacaggcgtgaaccaccgtgcccagccaagatggagtttcactcttcttgcccaggctggaatgcagtggtgaggtttcagctcactgcatcctacacctcccaggttcaagcgattctcctacctcagcttcccaagtagctggggttacaggcatgcaccaccacacccaactaattttttgtgtttttagtagagatgaggttttgccatgttggccaggctggtctcgaacccctgacctcaggtgatccaccca

SEQ ID NO: 173223 - DNA, 468 bp, Homo sapiens
cagagtcaacacacattttattgatttaaatgtgagtcaacacacatttaattgatttaaaatagaattatgaagtggcctatttgacttgagacctttaacctgggcttgtagtgtaagcagttggaacatgaagatgctggtagacagggtatctctcttaattatttgctcttaaagcagcagctacttcctttagagaacattgtttctagtgaaacattaacttctggaatagtatctattgctgtctggaaccataaaggaagttgttaaatttcctgcatactataggaataaaactttagggctagtgaagtgattgcaaagagtataaggttttggtgtgatgtgaagcagtgtatatataacagtagtggttaagggcaagggttttggagttggacaaaaccaggctctaattgcgatgacaaggtcaagctgatgacattgggcaagttacttaac

SEQ ID NO: 173224 - DNA, 548 bp, Homo sapiens
atcaattaaatatgatgtcaatggtacagagaaaggggctgggaagagaaggggagcaaagaaacaggagcaaaggagtgctggacaacatcacaaggaagtggttcatttaacaactgggcagcttccctgtgcaaaagcacactgaggactgagactaaccaggtgcctgctttcctggagcttcagttccaaataacttgcactgtgttttgtaactaaacattgtagacagccgatgcatggtttcaagctgtaaaactacagctaatcatttacatattgtttattagactcactgtaaacaacatcccattaaaatgaatatagaactgaaaaatgcttttaactttgagcggttatggatagcactatggggccagctataatattagtaaaatatcacatggtttggttaggaaattcttgtagcacgatggtgagcctcaagtctatgataatcagcctggaagataaagcagttctattttttgcacttgtttgatcatattttccacatatcttcaaagacaggcatttgcatggtg

SEQ ID NO: 173225 - DNA, 146 bp, Homo sapiens
gaaaaattagccaggtgtggtggtgctcacctatagacccagctactagggaggctggggtggtaggattgtttgagcctgggaatttgaggctgcagtaagccatgagtgtcactgcactccaacctgggtgatggagcaagagc

SEQ ID NO: 173226 - DNA, 254 bp, Homo sapiens
tgaaggttgcactcaccctgatgttgagctgtctcttaaaggggaaaaagaaacattaagggccggtgcgtctgtggatttaatgcgcaaaggtgacaaaaaccaaattattaatgcctgggcagtgaaggtgatggcaaccaaacggacaatgtgcaatagacttcagaatgtagagcgttgttaattgtgaagaaaaagccatacactcagtcccacaaaggagagagggtacaaggacgccagcatcacct

SEQ ID NO: 173227 - DNA, 713 bp, Homo sapiens
ctctaatctcttggaagactctggctaaaacaaattcatttttggatcagtacccagtgcctttttcataacaggtattcaatgggcatttgttgaaccaactaatgagaaagtatttattcaacaagtatttattgagcactgaggagatgtattactataaaataagttcacagtatatagtgttattaatactatggtcattaattaataataatttcaccaccacaacactgtaatgcagcctccagaaagccagtgacataaactggaagtttgggtgacagagtttacagcttctgattatttagacttaaagcaattagccttgctgttcccactgttaaccacagagaaggacatgttcccaagtttccacctattcacttcttgattaataactttaaagtcattccaaacctatcaagactcagagatagcgctgggcctttcctgtagtgtggggtttgtcttcaggaacaaaatcccacttctgcagcctgcagtgtgacccatctgttttgtatcccctgtcattttgggaacagtgtaacactgtggaggccaggctatacccgaggttagagaccccacctttaaaattattactctggggaaagcaggaaatattgtttcaatcataaggataaaatatggacaactatgaaccacttaagaagtttcatagcagttgccttcaaccacaaaaccaa

SEQ ID NO: 173228 - DNA, 489 bp, Homo sapiens
taacagttcaaagaatgttatgtattgtggaagtgaagaaacaaatcagtctgacctgggtttgtctcagaagcttcacagaagaagcaaagatttaagccaggccttgatgcaaggtgacagaaagacatgggctgctactatgcctcaggcacacggctgggtgttaaactgttaatccttatgataccctgtgaagtaggtgatgacatgtccattttacaaccaaggtaactgaagacaggtgaggctaagtgtgccattcaaggtcaaacagctagtaagcaacaaagctagcatttgaacccaggtctgctttactttactccagagcctgtgtactctcatgatctgccttacttattacacagcaacatgaaagaagaccagaaaaactaaagttctttctaacctcaaaattcaatcattgaacgggggatgtggagggagtgggggttgtgtgctcactgctgctatgtcttctccgta

SEQ ID NO: 173229 - DNA, 424 bp, Homo sapiens
gagaaatacgagggagactaaatgaatactatgtcaaacaaaagtgtcttgtggagtcaaaaatatgcagaattaaaataaatgacaataatgacaaaaaaggtacgtgattggtaaatgaagcctaaatatccaaaggtccacgcactgacagaaaagtgatacaactattaatttatattagagttcaataaaccaaggatgcatggtataacctgcagggtaatgatttaaaagaaatgaggtggctcatgcctgtaatcacagcacgttgggaggccaaggttgaagaatccccgaggccaggagtttgaaaccagcctgggtaacaccgtgagacccgtctctaaaaaaaattttttttttttttggagatggagtctcgctctgtcgcccaggctggagtgcagtggcttgatctccg

SEQ ID NO: 173230 - DNA, 618 bp, Homo sapiens
gtcccaaaagttaaataaaatataaaatataaccaaagtgcactgtatggctcagctctaaatagtatttatacaatcggattaatattaatactgaaaattgatttaatgaaaattatgatagaatttctctccgtgttgagagaatgagggaagggaaatacatactgatggtgggaggaggccagggacagggagaagtagaagggagttcagtgcttatcttcataaaagtgagtcgactataactgagaatgaaaaatcaagcttcaggagtatgaacatcgccgggcacggtggctcacgcctgtaatcccagcactttgggaggccgaggcaggcagatcacctgaggttgggagttcgagaccagcccggccaacatggagaaactccgtctctactaaaaatacaaaattagccgggtgtggtggtgggcgcctgtagccccagctactcaggaggctgaggcaggagagtcgcttgaacccaggaggtggaggttgtggtgagccgagatcacaccattgcactctagcctgggcatcaagagtgaaactctgtctcaaaaaaagaaaaagagtataaacatgttattttgaagaagctgctacaagt

SEQ ID NO: 173231 - DNA, 304 bp, Homo sapiens
gtgccgtagacttgtgttatctatctcaataagcttaatatcaaaccatgcatgcgcacacacatccgcgaagccacagaagtatcagcagtgctttttaatggttgctgcttttaacgtggttaaggtttctttgatttaatgttggaaaaaagtcacatgccaaaaatgaaaattgcattcgattaaaatgtgattaatgccccagagcagccacgacagctcaatttctttaagaggaacctgagtcaactcacttaactcacttaccacgagacttttcatactcctcggcaaaaacgaa

SEQ ID NO: 173232 - DNA, 330 bp, Homo sapiens
ccagactctgtgtggcatgggggtgataactgtagaccctccacctctggggattaaatgagctcatacatgtaaaggcacagaggaggcactcactgaatgatgattgtttcattagtgtctttagaccctcagcacccagcaccataggtggatgccagtcattattggttagaccaaacagaacttcaaggcagctgggcatggtggctcacacctgtaataccagcactttgggaggccaaggtgggagggtcacctgaggtcaggcatttgagatcaacctgggcaacgtagtgagacccagtgtctatttatttaaaaaaataa

SEQ ID NO: 173233 - DNA, 394 bp, Homo sapiens
aacagtgcagccttcagtctgtgactgaaggcccaagagtgcctggcaaatcactggtgtaagttcgagtccaaaagctgaagaacttggagtctgatgtttgagatcaggaagcatacagcacgggaaaaagatgaaggcgaggactcagcaagtctcctcattccactttcttctacctgttttattctagccacgctggcagctggttagatgatatccactcagattgagggtgggtttgcctctcctagtctactgactcaatgttaatctcctttggcaacaccttcacagacacacccagcaacaatactttgtatctttcaatccaatcaagttgacactcaatattaacaatcatgccacatgattcgattagttttttattttg

SEQ ID NO: 173234 - DNA, 141 bp, Homo sapiens
tagaattctattttgatgtgtctatactgttttttgagtgaatcgctttgtataccttttttagtcatttctgtagatagtacatgataccagtaccattagcacggtctcctagaatggaaattgttccaattagagtta

SEQ ID NO: 173235 - DNA, 596 bp, Homo sapiens
gtttgccagaatacaaaagacattctgttcagaaagttcaagaagaaaaactgaagaaccaggacagcagctgttccctcatcccacagagaaaccaaaggcatttgcaaagttccctgaggccaagaagtgaatttaagacataacatggctcaagtggaagcacaacccctgatgggtctccgttgcaggaagtgtttgctgcattcatcctcctcataatattactgacaaccccactaccctatcacctataaaactgcctttctgggagggtctcctttccaaggccacacagctcaccatgtaccactcctctaggtcagaacaagttttaccaaaacttaggacaatcagtgtaggagtgcacagcgtggacactgcgtgccctgagatttggtcaaaatgtaaccaaaggaatccacccggcacaactacagtgcctcatgttccccagctcttagcagctgctgctgagagctcactctgggacatctggatgagaaacctgtttgcaggccccccaaccccagcagacgctgtaccgagacgctcttacgcggaagacggctcagctagtcccttactataaatac

SEQ ID NO: 173236 - DNA, 637 bp, Homo sapiens
aaaaaaaaaaaattacaggaatacatttagcaaagaggcaccaaaattgagataagagccactgtcccacctgtgacatcttctgacatctttcattcttgagtcatgggggttgcaagccagggaacagagtcttctgcctggaagctaaaaccaggttttggggtaggttcagagagactgttcagactgaatatgcatgttgccaggtcaaaaatatcccgattgcaagagcatttgcaaagacaatggtgctcagggaaagataatgctgtgtgtttaaaagggaaaaaaattaaaagaatggaaacaaagaagaaaaagtgaccggagggtagggtgaccatatgttctggtttgcaaggtacagctaaagttatgtctgctgtcctcgtgcaattattatagtgcccctttcactctcttaagtgtctggatttggatgataaagcatatgatcaccctaccaaagacaggaagttagccagaagacccatgtatccattttaaacggtgcggcctgatctgtagtcacgctcatgctgctgcgcagctgagcgctctgcaccacctctgcctcgccctaccacgccctgcctgggtctcctggaaggctggagcggaacccacgatcctg

SEQ ID NO: 173237 - DNA, 545 bp, Homo sapiens
ggggtctaatatggcaaaaccctcagctcccccaacccatctctttaaggaacgtccctccccaacaccgggcccaggccgcatggatccaaggactagtacgtcatctcttaccaacacagagagatcagcttctagtgatagaggccttttatgctgacttgaaaaacagaaaaagagagaaaaaagaaacccatttacaaaaataaaaatcccatgctgttaatttcatgccagcataatcagaaattcccctttctactgtttccccttaaaagccccggtgtccttattatgctggtgcagtctggaaaaactatggttgggttttgcctacgtgaggcttatctctgcagctgcaaggaggggatccggtactttattgtcagcatggaaacttccgctaaatacttagaaaaaccttaattctaaattcctagctcactttcaactgtgtcctcgggacctgattttcttcggtgtgaacagattgtgttcagcattgcagtagaaagggtccaagttaggtaagagaaaggacttcc

SEQ ID NO: 173238 - DNA, 685 bp, Homo sapiens
aaaaagctacatgacatggtgtgacggggctgagaatgccagaaagtccaagctatcgccttggtttctggttataacccctgattccagagtgatctttataaaattgctcagtcagcaatgcctcctgcagtggaggctgtagggcttccttgcaagccttgccggcaggttcaagggcctcctgctgagtctcttcccaggaactgctcagcctaaggaaggcctctctcaaggtcacacccgctcctggggcagctgtatccaatgactagttggtgtgggggtacaaagacctgacccccttgtctggactggggacaactctggagagctattcccaggggatgtactgaggcctctgttgtgagtatatcacagctcaacttctctctctgtccagttctgcatccctgagttaaccccaaagacaatccccaataagtttccttcgggcacctcttagagtctcttttccaggaaactcaacctacgacacctgccaagatgcacttagggaacaaagaaacccaaccagggtctccattctgggccaatgccactggctctctcagctaacctatttttccttctgctgatatttgaggaggcttcttgctcctcgttagaaatggtcacatactggttaacgacattgttggctgtggagccaggctgcttgagt

SEQ ID NO: 173239 - DNA, 609 bp, Homo sapiens
gggttgagttcttgatttggttctcagcttggtggctgttggtatacagcagagctactcatctgtgtacatcaattttgtatcctaaaactttgccgaattcatttaccagttataggagctttttggatgagtttttagggttttctaggtatatgatcatatcatcagcaaactgcaacactttgacttcatctttaccactttggatgctcttgatttctttctcttgtctgattgttctggctaggacttccagtagtgtgttgaatagaagtggtgaaagtggacatccttgtcttgttctagttctcagggggaatgctttaaacttttctctgttcagtgtaatgttggctgtgggtttgtcatagagggcttttattatcttaaggtatgtcccttctatgccgatgttgcagacggttttaatcataaagggatctgaattttgtcatgctttttctgcgtctgttgagatgatgtggtttttgtttttaattctgtttatatggtgtattacatttattgacttccatttgttaagccaaccctgcatccctggtataaaacccacttgttcatggtgtattttctttttgacatgct

SEQ ID NO: 173240 - DNA, 142 bp, Homo sapiens
cacactgggccagatggatcaaaaacatctcccttaccactctgtcatggtccaaaagtgtcaaccatgataagctgcagcctattcaagaagtacaaatcagaatgtggttgatctagaagctataacatgtgaggcactg

SEQ ID NO: 173241 - DNA, 340 bp, Homo sapiens
cccagctgagaccagaagaaccacctgcctagattgctgacccacagaatcatgagctacataacttttttaagccactaaattgtgtggtcactttttatccagccatgggtaactgacaacataagacaatgtgtaaaatcactgaagaggatcaggctatatggctcgtaggacagaaaaggaagcgatagattctaattgcagcaacctgggaagacttccctggagtaagtgctgttttacttaaggattatggagttgtaagtactagaaacttgatcgcaacttgctcagagttcaacggacttcattgctttactaaatggaaagctccaaa

SEQ ID NO: 173242 - DNA, 844 bp, Homo sapiens
  misc_feature (588)..(588): n is a, c, g, or t
  misc_feature (594)..(594): n is a, c, g, or t
  misc_feature (599)..(599): n is a, c, g, or t
  misc_feature (641)..(641): n is a, c, g, or t
  misc_feature (654)..(654): n is a, c, g, or t
agccgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaatttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggccttactcagggacccttgaaattcatggatgtggcatagagttctctcaggaagagtggaaatggctggacctgcgcagaggactttatacagggacgtgatgttggacgatttataggaacccggtctccctgggaatctggcttcctgacctgagngtaccntccangttagaggcaaaaggagagatcctggactctgcagagtggangagaaaatagacnacgatcagaaggcaggcttggatcacggtgtgaccaagaaccttttgtcacgtcccaaaggccaagctcggaagcccttgtcacatccggagcctcctctgggaacaatggccacgtccaactggggcgacacagggggacatggatcacggacagaagcctcatgcaattgacggaccgctaaatatcc

SEQ ID NO: 173243 - DNA, 448 bp, Homo sapiens
aatagtttcagggggtccccctacacctagttggccagagacaatccttatttatgcctgtggtcgcattcagtgtaataactaatagcaatccctttcatgttcaaaggtatgcctgttaggaaaataaattataaggtaacactagttctgggtagcacactgtcgtagctagtctcagtgtgaaataacatggatgcagagggacaggtaaaaaattgctaggtgctatacgagataagttgttacagagttcagactcaaggtcaggttcacctattcagaatgcttcctacaatccaggctgttttgaaatgtatattaagagctggcagaaactatcatcagagtgagcaggcaacctacagaatgggagaaaatttttgcaatctatccatctgacaaagggctaatatccaggatctacaaggaacttaaataaatttac

SEQ ID NO: 173244 - DNA, 695 bp, Homo sapiens
tggcctcccaaagtgtcaaacctattcttaattactgtgtttgacttcaggacttccctccaggtcttactggaaacaaagcttttgcagtcagaaggtgcaatgacataggtataagttgcttttggttccactagtagctgaagtaattttaactataagttgtatatatgcgggcaatgtaggcaagagctattgggaaatacaccttttgcgataatgctgttggttctgtgaaagggaaacggtgtggggaagaaagaggtgaggctaaaagcggtcctaaagagcagaattaggagtatctgaaaagcaactggaagaaagtttagctactttacctatacattattagaagacatttgtgacttttttttttttaggatggcataacgaggataaagtagatcttaaattgcttcccacaattgatacaaagtacagttgatcaattattgcttagctatagatttcataactaggctctctaataggaatgaaccttatattttgaagagttactaggtagaagcctgagtggttgatgttacctgtaccagaacatagaactattcatattttcagttaggaagttgaatgagcctctgcaactgagaataaggggaaaagagaacacattataagttggtactgcattgtatagggtgaagaaacacataaaccatataattgga

SEQ ID NO: 173245 - DNA, 722 bp, Homo sapiens
tggcctcccaaagtgtcaaacctattcttaattactgtgtttgacttcaggacttccctccaggtcttactggaaacaaagcttttgcagtcagaaggtgcaatgacataggtataagttgcttttggttccactagtagctgaagtaattttaactataagttgtatatatgcgggcaatgtaggcaagagctattgggaaatacaccttttgcgataatgctgttggttctgtgaaagggaaacggtgtggggaagaaagaggtgaggctaaaagcggtcctaaagagcagaattaggagtatctgaaaagcaactggaagaaagtttagctactttacctatacattattagaagacatttgtgacttttttttttttaggatggcataacgaggataaagtagatcttaaattgcttcccacaattgatacaaagtacagttgatcaatcagcatatgtgtaatttctaatccaagtattgcttagctatagatttcataactaggctctctaataggaatgaaccttatattttgaagagttactaggtagaagcctgagtggttgatgttacctgtaccagaacatagaactattcatattttcagttaggaagttgaatgagcctctgcaactgagaataaggggaaaagagaacacattataagttggtactgcattgtatagggtgaagaaacacataaaccatataattgga

SEQ ID NO: 173246 - DNA, 694 bp, Homo sapiens
aatcttacactttctggtcatagatggtactttctaattgtgtcctcacatggtgccttagtccgtcttttcactgctataaataaataaccaagactgcgtaatttataaaggaaagaggtttaattgactcacagttccgtatggctggggaggcctcaggaaacacaatcatggcagaaggggaagcaggcaccttcttcacaaggcagcaggagcgagaggagcaagcaaaggaggagcttgccaaacacttataaaataaccagatctcgtgagaactcactcactatcatgagaacagcatgggggaaactgcctccatgatctaatcatcttccactaggttcctcccttccacatgtgtttatcccttataaacatcctgcctgccagaccccaccttggtggccacttctggaggattcaacctgggacagcctgagagaccttgatctttccataattaccagccagaagaatttacctcattctaccctctggagactctcctccctgatactcatctgccacaagagacacactcagggccttagtgcatttatactgcaatgatttatttaaatttacacaaagtcagatgtgggacaagcacccctctctcatcttgtagctatgtcttatgaacacaaattcttagtggatcacagtagtgagactgacaattatttct

SEQ ID NO: 173247 - DNA, 618 bp, Homo sapiens
tcatagcgtttacagatgtcatgaggaggtcccagaccaattaaataacagtctatggggggtggaaccgcaggcttcaaaagtctttaaagctcccctggtgattcctgtgtgcagccaaggttgagagccacacctctataaaaaatcttaaaactgagcctttccgtgcatttactttacttgtttggccccagagacacttgaatttattatctgagtatgtgattaaaagcagactggtttctagactgtaattcagttctagttctacaaccttttgtgtgaaccttgacgtttttcttatttataaaatggagattagaataacctattttatagaggtattgtgaggattaatgaagatgatagactgtagagctcttagcacatacttggcatatagtaggtactgctcgttaaaagttagctgttatcagaatccctctttgaggtaagctgctttatcccttttactcttgccaggtttgtcatgggtaatttcaaattttgaaattggcagaatttgtttatgtagctaaccacctccttttattgtaccttaaatgaacatcaaggaatatgcaaacatccagtgtactttaatcagaagaaagg

SEQ ID NO: 173248 - DNA, 378 bp, Homo sapiens
gactctgtctcacaaaaaaataaaaaattaaaaaaaaaggtctgctcagaaataggggaaacacgggatcaagaccattagagatttataggctgggatgcacaccatgtcttcagagctagccggctgtgtcttctccccgtttctttcactggtgaataacctttcgtttgaaccagcattgattgttctctccatgttccactgtggctccccatggacactgctaggtggaatctctgagaaaacaggcacttcgcagtcggcgcatctttctctgccagcttagggatgccgtcaaggtggaggaagggtattttggccatgttcggagtcgttgtttttactcactcttcttgggatagctttcccaccctg

SEQ ID NO: 173249 - DNA, 310 bp, Homo sapiens
aattatttatgcaatagtcaaaattgaagctacttgaacaaggtcacacagcctattattgttaagctacatacaattagaatctaggtctcataatttctagctcaatgcccttgatactatgattattattcctatttaatatgggttttagaatatttattaagtaataaatctagtggtagggttaaatcatatttactattagtatagtcgaggctaagttggagaaaataacttagtaattgtcagatacaatagcgtgtctatactaaaactgtacatggtaataaaaactaacagacaaata

SEQ ID NO: 173250 - DNA, 975 bp, Homo sapiens
gcctgtctgaccggaacaccgaggccttctcagctcacgggtgagcctgggtcacactacagcactggctgctgccctttagacctgaggtcaccaggtcgaggggagccgtgtctggtgcctgcgggaacctgagcctccaggcccctgttgctctgtggctagatgcccccactgcatgaagcgtgtttagagagctttggcattgctctgttgtgtgccgtgggttttggaagcttctgagacttcctaggaggctccgggtttgacccacaggactcactagctctgtcactgactagctggctcatcttgcagctatgacttaagctccatgagctttagttttacctaaaaaggggacacagtgctagggtgtctgtgagaatttcattaaatacatgtgaacacatatgtaccgtaaagtcctagacgaatactgcggaagttcattgcttgacttggggcagggtgacaaatcctgccttgtctctgtgtgccctcgggatctgtggcagggagggggtgctggggtagaagcacaggtccgtggctgtctgaggacccccagccctgccccttgagaggagtggacagctgggggaacaggggaaccccgactactctgggaactctgagctcatacccaggggagggagaccaaaacctgaccaccgggaggattatccccagcttagtttcacagtcttgtccggccccctcacatctgcaggggatgaggtgagtcaggtccagcagaagagaggtccggacacagagagatctcttccctcacagacaccctccctcacctgggaggagcccggaagacttggtcatctaggaggtctaggggttgccttgcacccaccagatggacagacatgaaaggttgacactaataagggctaacatagacacggagctgtcagagcacacatatgctgctgctgggactgcaaactggtagacggc

SEQ ID NO: 173251 - DNA, 203 bp, Homo sapiens
cgacagaggcaggattctgcgtgatagttcttcaggttcacttcacagattagctgacacttaactgttctggaagctgggccaaggagtgctaacatggaaattgagtaactatagttttttgcccaaggtacaggagaataaatatgagtagatagaatctcttaaattaaaaatttctccagtaaatttttcctaagtct

SEQ ID NO: 173252 - DNA, 657 bp, Homo sapiens
gtcacccacatttgataggtcagaattttgctttttgccagtctcatgggggtgatgccatttctggtagttcccctgattgccagggggatgagcagcctgccctcaactgccccatgctgaaggccctccaaaggcagcatgaatcctcacagttcccagcctgtgccctgacaacctaggaggacacgctggtctggtccattgcttatctgaaacgattccctttccctgttccttttgttgccttgagtgtcagttttggacctcccactgagcagttttttctgtcacgtagccatagacaggactgagttctttggaaaataatcacatcccactgttgttcccattcgttcattttttccttcaactaaccaacattattcagcactttactcagcacaggatgtggaaccgaaggcctggcttttgggacactcaccgtccccagtcagctctgtgtcctagggagagacccatgagctctctgggcctccttttgtttctctgtaataaaggactaaagctaccagcctcgctgcgggttggaaaaaagaaagagttagtgtaacacatgtgaatgtgtacgaaggggtttagagacagacaaaacattgcaccaaggcagggctcgctggagtgcagacccaggaa

SEQ ID NO: 173253 - DNA, 285 bp, Homo sapiens
cactgtttacagctgagttgtgtaatcacccaagattactttactttcttgaataataatggagttaataattatccattgcttgctgccttagttctgtctgtacttatcattaattcaaccctaaatatcctcttaattggtagttcttatcagagagtctatcaattatttttcatgaagaactctttcctggaaacttctgacctgctcctgtctcaggtaagtcagaaagccctgcaaacatcctgggatccccttccccatattcctttgtagctgtcc

SEQ ID NO: 173254 - DNA, 591 bp, Homo sapiens
taggaacccccacatattttctatggatgtgattaagatgttaatcatttttctatttacagattacattataatggataatcaaattgctgaataggaaataaatcttgaagttatggtatacccatgaaataaaatatcctacagctgtctaaaaagcaaaatatttaatatgggaacatattgacaatatatagagcagactacaaagcaatgtacattatgatttcatttttgagaatataaatgcataactatgcatagaaaaataagcaaaaacacaacatcaaaatgttaacagagtttatctccctagatgcatagaaaatatctgattttctatggatccctagtgcttaatacaattcctaccaaatattatgcaagtaataaaattgcagtgtcattgaacattttcagatatgcatttatttctactaattaatcttagtagtattagcagccttgactaaatattatttctaaattgatcaacatgcgatgcaaagcatgctacagaattgaattaagaaaagaatttccatgagagatatgcatttacaattttgtagatttaatctttgcatagac

SEQ ID NO: 173255 - DNA, 880 bp, Homo sapiens
gcgtttagcccaaggcacctgtgaaggagaaaaatctgatttagaatacaagctaccccaacataattggcctcaagattgtggctgttttcaaaaaactcttccatcttgtgtagaactcacctactctggggccttggggaggggggtctgtgaacatggaggccatggtgttcgttggccacctccttttagattaactgcgcagcctgtgtcttcacttctgctctgtacatggagaagacagggaaggcaaggctgctgcttacctgaaggagttcaaagtgtaaataagacaagcccattagatctatcaggggaaagccgtttaggtttgtttgagacaagatatatggtgtagaccacagaccttacgtttagggaaagcgtacttcttcagtgggctgagtttcttgtaacagaaggtgtggtcggatgattacagctggggttgaattagatgatttatggaacagcttctgccctgaaattttctgattgagagatggatgtggtctggagtatgtgaaaatgggatagatggagggaaggttaggggagaggtgaacagggcctcttccagggtcttgtggaagaccctgttcgacgtttcctcacgtagactgtctgatgaggctcttccagggtgtggtatggccaggtgtgtaaaatgtagggagcacaaggcaagaaagggctgcaccgagctgcttcctgcctcagggcctttgcacttgctgtcccatctgcctggaatggccttgcctcacatcttcatatgaccttggctccttgtcatctattgactcacctgtcacttcagaaaagcccttgctaccatctggtctgccagtcactctttatcctattttcatgtttt

SEQ ID NO: 173256 - DNA, 555 bp, Homo sapiens
ccattgacctcccagcacacctgggctgccctatctgcatccttggctattgctaaaacctctgctttctggagtgagcctgctctgaagttgatagataccactccttcctccttcccattcccttaagtgtcaaccaaatccttgtgactttgctgtgtctccttccaaagccacgcgttctgtgtttcaatcctctagggcctattaagtgaccagatagtttttgtgcatacaaaattaactgattttgcattgtatttacattttgataggctgaaaatatgtcttaatgttgcagcgcctggggggcctcttcttatctttactttcacccccttggtgatctcatccagttccaaggctttgaatacatctatgaatagatgactctcaaagttatattccattgtagactaccctgtctgcctatttgatttttccactggacagtctaatagacatcccagaatgagcatcgggtaagtccaaatcctggtttccatctgcagccttcttcatctaagtaaatggcaacttcatttgtccagctgc

SEQ ID NO: 173257 - DNA, 459 bp, Homo sapiens
ctattcatgatcatgactggaattgctgcatgttttgtgccagccacttcattcctgccaaacatcctcccaatttgcaaggattcttgggtttcattttgaaaataaagcagtaaaatgcttcttaagctcaacttatgtggggtcttattcttcattagtacttacttaagctatactgattagagtaacatcttaactcttttgaaatgcttattttgattgacaaagtgacatggaatttctaaagtgacaaattgaccaaggagcacagaaacaagtcaatagaattgtgatgttagcttgagttctgaacactcaacacttggaaagaacctcataccaccttttgtgccagagacaccgagaacctgaaaggctgtcagtcagatatttctattagctgaagcaagaaaacttcctcatcctggtggctcctaggccaaaatttgcagggga

SEQ ID NO: 173258 - DNA, 211 bp, Homo sapiens
tcaacggctattataacccagtttgctgtcgcagattactagtcgaaagaaatgttttaattgtcttcaagtgactattttaactttgcagatgcaaagcaacaggtataatgtactaaatcataacttaattaaaaactgtcacataaacaatgtagcaaggatataccttctaaaggcaatcaccatttaagactttactttctcctta

SEQ ID NO: 173259 - DNA, 420 bp, Homo sapiens
gcttacttggcttgctcttggggagaaatcccctgacatttggtcatagaagtcatcttctacggtgatgattgttgtgagagcacaggaaaaatgatttgagttttttccaaagagtactaatacctagtatttaagtttttttttttcttttattgagacgcagtctccctctgtcgcccaggctggagtgtagtggtgcaaaatcagctcactgcaacctccgcttcctgggttcaagcaattctcctgtctaagcttcccaagtagctgggattacaggtgtgtgccacgaagcctggctaatatttgtatttttagtagagacagcattttgcgtgatggccaggctggtctggaactcctgacctcaagtgatccgcccaccccggcctcccaaaatgctaggattatatgcat

SEQ ID NO: 173260 - DNA, 374 bp, Homo sapiens
cagctggtgaatgtaagcttctgacgtacttgggctaggactgtgaacttagcctctgatgccaaggagcaaacatggaatgaaagcaggccaaaggccttttgcataatatggcagtaaggcaggaagggaagttcattccactttagagaggcagtgtttgaagcatgaggaagtttgccagccagagaaaatgggaataccttctgtgcagagtgaatacaaagatacaagggtgtgaatgtgcagttagggaatggggaagctttagtaatgagactgttaaggtggattgtgtcccttgtgaagggactcagacgacataaatcagttaaaaaaaacaaaactaacttcagtttttgaataggtatagg

SEQ ID NO: 173261 - DNA, 529 bp, Homo sapiens
aaaaatgaccattcaagttctttgccccacccccacgtgtttttttttgtttttgagatggagtcttgctctgtcgcccaggctggagtgcagtggcgcaatcttggctcactgcaacatctgcctcccaggttcaagtgattctcatgcctcagcctcctgagtagctgagattacaggcgtgcaccaccacgcctggctaattttttgaatttttaatagatacagagttttgccatgttggccaggctggtctcgaactcctgacctcaagtgatccctccgcccgctttggcctcccaaagtattgggattacaggcgtgagccactgcgcccagcccctatttttaattttatcttttttttcccctccaccttaagactgagactttgcccatttttttaattgggttgtttattgagatgtaggagctgtttatatattttgtatgttaaccctttatcagatacatgatttacaaatattttctcctattctgtgagttgtctttcactctcttgaagtgt

SEQ ID NO: 173262 - DNA, 536 bp, Homo sapiens
tcagccctggggttcagggttaggagttaggagcggggaaggagtcccagctgggggatggggccgatctgtagtgactttgagcacctcctaatgttctcggttgcccgtccaccaagacctcagattcctggtgggcttgcctgggccccattagtggctcaaggtcccgtttcccagttttctccctcctgggcttcccagacctgcacagagtgggtgctcaataaatgttatttgagagaataacagtgattccatttactaggcagggggccataagccaagcttgaatctcatagcaggaaaccccatttacagagggagaaactgaggttcatggggctggtttgtcctttctacccatcgtttattgactgattgattgatgcattgattgagataaggtcttgctgtgtcgcccaggctggagtttagtggtgagcctcgcttgcaccactgcactccaacctgggcaacagagcgagacgagaccctgcctcaaaaaataaataaataaataaataaataaattt

SEQ ID NO: 173263 - DNA, 232 bp, Homo sapiens
ttcatacccaaggttgttagaattggacttgattggagatttataagagaaaatcattagcagcatgggacaaatatgaagcccctttattttattttattttattttattttattttatttgtattgtatttattttgaggcggaatctcactctgttgcccaggctggaatccagtggcacaatcttggctcactgcaacttctgcctcccgggttcaagcaattctcct

SEQ ID NO: 173264 - DNA, 740 bp, Homo sapiens
cctcgaaggcccaggcccttatggctggatcctgaaacgtctcatgggggccaccctcatgggaacatgcctgggctcgaccgacccctgagcaggcaaaacccacatgacggtgtggtcaccccagcagcatccccttccctccctcagcctggtctgcagatgccaggacagtgggggccagtgcagggaggcccacagccctcggggcaacatcgttcaccctgccctgaaggacctgttcccagcggggtgccctgtgccaccagcgttcctcatttccccaccccgtccatcctacatcagggccctggtcatgagcaacacagccctctggtggctcccccagcagccttgcccagtgacggaagagacgaggtgagccacttgcaaagtggaagccacctggccaataactctgatcctgaaagtacattcaggcaaaatcccagaattgtgaatcactgggcaagcccagagctcaggcagaatccaggagtgaagaatgagcaccggcccgcctctgctcttgtgaaccccctcgcccggggagatagcccagaaaaccgtacgcaccacccactgggggctggggccgggtctggctgtgccccgctagaagcagactcaggagcttcaggagctctggcgatgtttttccaagggggagagacagaaaatgaggagaatctctcatctgaaaaagcaggcttatctggtcaagcggactttgacgattt

SEQ ID NO: 173265 - DNA, 217 bp, Homo sapiens
cagttcagagcctgaagttcagactctgccatatcttcctcactacattccaggagtggatcctgaaacgtctcatgggggccaccctcatgggaacatgcctgggctcgaccgacccctgagcaggcaaaacccacatgacggtgtggtcaccccagcagcatccccttccctccctcagcctggtctgcagatgccaggacagtgggggccagtg

SEQ ID NO: 173266 - DNA, 259 bp, Homo sapiens
gtcctgccatgccagcatgcccgtcgcccacgggccggcggtcggcggcgcggggttggggatggcgccgctcgggcttgccttcggctgtggcttggcggtagctttccagccaggagccgggtccgcgctgccaagtgaagctggggaggggggcggggaggcggggcggggagagcgccgcggggggctgcgcgccgattggcaccggcgcagcccgggccagcctcgggactatcaggcgctgtgccgcggccgc

SEQ ID NO: 173267 - DNA, 321 bp, Homo sapiens
agatgagcacactgaggaacagggaggaaaagtgacttgctcaaggtcacaagatcttcttgagcctgcactgtccatgtcctctgctgcacagtaccttccaatctccatgcactacatatctcactgggctctacaacatcttcaagtgagacaaatcactagctccattttaaagctgaatgaattgaacccaaggctaagcctttcacctctaagaggatggtgtgtttaataacctagctgttactattggctgggttgtgcgacctgtggaagtcaccctgcagctagatttctgcggaacctcaaaggcggggg

SEQ ID NO: 173268 - DNA, 365 bp, Homo sapiens
ctcacacccatcctttttccatgtgctccttggagaataggacaaattcctcactccagaggactaatacccaagcccagtggtctcctaaagcaatgctgctcatacttaatcatctgaggaccttgttaaaatgcagattctggctcagaagttccctggtggggctgagagtctgcatttttaacaagctcccagggaccactccagtggacaccaactcttagccctcacccctagttcctcagccccctccccacactcagcctaagggcaactcacactgtgtctctagaagttctctagtagcctttgaagaaagggtgttacagctcttttaaaacacaaacccaccccctcagcag

SEQ ID NO: 173269 - DNA, 455 bp, Homo sapiens
cctgtaagaatgtatcttataccatttcattcccagctctgaatcctccagtggttacctatcacaattaacaaagaaatccaagctctttactatggtctgtgtttatctgctccttggactgtgtgtattctcgtttcctcctcccagtgcctgcagcgtgactggtctttgtggtgatctttgggctcatcaagcgctgtctgtattcagactctgcacagtgtctcttctctctgccctctagacattcacttaactcattccatcataccattctgacctgctcaagtgtcacctcttcaaaaagattgttccagagctccctatctaaagtagcagtccctgtctccctgaatgtgattaccctaccttatgtttctttgtattattatgcttttttatttagacaaggtctcaccctagcctgggtgacaaagtgagactccatctca

SEQ ID NO: 173270 - DNA, 516 bp, Homo sapiens
cctgtaagaatgtatcttataccatttcattcccagctctgaatcctccagtggttacctatcacaattaacaaagaaatccaagctctttactatggtctgtgtttatctgctccttggactgtgtgtattctcgtttcctcctcccagtgcctgcagcgtgactggtctttgtggtgatctttgggctcatcaagcgctgtctgtattcagactctgcacagtgtctcttctctctgccctctagacattcacttaactcattccatcataccattctgacctgctcaagtgtcacctcttcaaaaagattgttccagagctccctatctaaagtagcagtccctgtctccctgaatgtgattaccctaccttatgtttctttgtattattatgcttttttatttagacaaggtctcactctgtcaccaaggctggagtgcagtggcacaatcatggatcactgcagcctcaaactctggggctcaagcagtcctcctgcctcagcctctcaag

SEQ ID NO: 173271 - DNA, 619 bp, Homo sapiens
cacattaacaatacttagttgattgttgcttctgtgaaatgctcttttctgctacattggtctaccttgtctttatatgcctttaacactttagtatgtataacacaatctaacacttcatacaatttattatttccctagttaaatttttgaaaagttttgagtataaaattgtgtgttatatatcttgtactgaacatgtagaaaagactcagaatatgcttgtgattgattgtcaggttattaagaactatccagcatgtatgaattttgtaaatatgctcacaggaagagttacttcaaatctgactgtgccagaaaccactgactcatgaccaggtgtggtggctcacacctgtaaccccagcactctgggaagctgaggcaggagcatcacgtgagcccaggtggccgagatctccctgggcaatgaagcaagaccttgtttctacaaaaaatgtaaaaattagccaagcgtggtggcatgcgcctgtaatcctagctacagaggaggctcgggtgggaggatcacttgagccccagagttcctggctgcagtgagctatgatcatgccaccgcactccagcatggatgacagagcgagaccctgtctctaaa

SEQ ID NO: 173272 - DNA, 248 bp, Homo sapiens
atcccaaaatgataacagggttattgctgggtggtctgattacagctgatttctattttcttccttttgtttattcatctactctaatttttctatgattaacatgtattaattgtgtaatattttcccattttggaacaactgattcaagttcatgttttaaatcccatctcaacagtatgattaaaacactagatatcagagtgtcattccttggagcaggagaccaagcggctcttaattatttt

SEQ ID NO: 173273 - DNA, 386 bp, Homo sapiens
tccagagtgatcctttgaaaatctcatttctctgctcaaaaccctcctgaggtttcccatcaccaaggatattaaggataaaaaccacatccttcataccattgtctacctgtgattccctaatcgtgtccctttgctcactccctctggcctcttgctgttccctgaacagcagtctgttccagccacagcagcccctttgccctatgtgcccatccccgtcagccttggcactggctgtcctctctgctgggagtgccctttcttcagatgctctcatgcttcgcttctttgccttgttgacatttggtcaatgtcaccttctcagtgaggcctaccctgacctccctgtaggaaaatgcaactcacctcactcccatgccccg

SEQ ID NO: 173274 - DNA, 529 bp, Homo sapiens
ttacttgaacagctttgtggaatcctgagatgctctcagctcattaaattccaaacaagttctgctgcctggcgtgatttggagaatgttctatgttggtttaagcaattctcctgtgtgttgtattgtctgtgatttaagtgtggactcttatttgatgtgttcccattttcccaccatccttggcaatatgacctcttcagtcacgttggtgagttgtcctttttactttagtatgtgttgcaagccctgcctgctgcctgagagtgagctgtgtagctttctgatttattctgcacgcctttgtttatctcagcccagcccaagactgtgcatggtcacggcactaatcagccaacatcacgctgcgttaggagcattagtctttatcaagaggactttggggcatatgtgagcatagctcctggtttctagttacatgaagaagaaaatggacatcttgcataggctcgctgaataagcagaaatgctgtgaacggtcttcatgatttgatcattaaagaaaccc

SEQ ID NO: 173275 - DNA, 245 bp, Homo sapiens
ttaagatctagtttcagaaaataattttcagttccttgttttcataaaaatattagaattagaagtaatgttaaattgtttttcaccactcatctggttttattaatcagaaaaggtactgtttcctaacagaaaggctgatgtgatgtactgacttgtttggaaccagccatggcctaatttctgattagatatagcatttatcttgagattatctgataatttaagtctttgtatttttttag

SEQ ID NO: 173276 - DNA, 968 bp, Homo sapiens
ctttcaccttgttggtcaggctggtcttgaactcctgatctcaattgatccacccgccttggtctcccaaagtgctgggattacaggcttgagccactgtgcccagccttttaaatttattttattttatttttattttttggagacagtctcactctcacccaagctggagtgcagtggagcgatcacagctcactgcagtcttcacttcctgggttcaagtgattcttatgcctcagcttcctgagtagctgggactacaggcacacaccaccatgcccagctattttttttttttttgtattttagtagagatgggatttcaccatgttttgcaggctgctctcgaactcctgagctcaggcaatctcccaccttgggctcccaaagtgatgggatttcaggcgtgagccactgcacccagccctctgcttctttttctcatatttcttgagtattacaagggatgggattcagcaaaaatgttggggggaagaaacccaacataaatgcttcctgtatcaaccatgagtggcaggtcccctacccctttcccatccccacaagctaaattggaggactggggagtcataattcccgttacgtgttcttgttgctgattggggaaattttttacttcaccccccttggtatcattagctcaggaaaaagttaaatttgtttcttctatatttgcctataggaagaggaatatttgtctcttctgtcgacttgaggaacgacacattaatcaaaggaagaataatttgatataactatatgcatctagttatccagcttggaccttgtatgataggggtataatagttggaaattttgaaaaaggatgtagtcctgccatatgagggacagctgcatcagaccttctctctcttttttttttcttttttttttgagatggaatcttgctctgtcgcctaggctggagcgcagtggcgcaatctcgg

SEQ ID NO: 173277 - DNA, 749 bp, Homo sapiens
tccataggtagtattctgataattttggactcatactcaaattcacaaagttttgaaaagtcattgtgaatacattaagagaaataacagaatctgacctgcaaagactgcagattttggaattactggattagagtattcaaagacacacaaaattttttttaacaactctaaaattcggatgacagtgcagcattaaattgacacaaaatgatgtgtttttcagtacttgatggcttagatttattgaaatacagtatgtgtaaggaatgaaagaatatccaaagattgagaaggaacaagacaaaaaatggtgggggtggaggataagcaagagcatatgacaagaaaaataagatttggaaacagtgaaacatctagacatgaaaagcaaaacagataaaatgagccagaagaccaagatgaagaaattatgtagaatgtatgaaaactcaacaccagggacattttgaaaggtcaatgaacatctaatagactaccagaaagagatgatagaatggtttgggatgatatttgagggtattttagctgagaaattttccaatttgatgaaagtcatccttgcatttgaggaatcaagaaaataatctgtagacccattgagctaatttgtagatgacagacaacgtgggaaaccagagtggtgaaactcttgataagcaaaccactaaaaatagtctctaaaagagcaagagaaagaaagcattatctacaaagtaacagcagtt

SEQ ID NO: 173278 - DNA, 923 bp, Homo sapiens
tgggcctccgggaaggggactgccctcctctgccttgtctggcagggtgcatgctgccagctaccggtgtgctgtggggccctgcctcccagagtctttcacagcaggcttggagctctctcctttacctgtttggggtggatggggagacagaatcccaaatctaagctttgcttgaggcctgcactctgtttccaaggctctgaattcctctggaaagagctgacattagattcctggctgattgtttggtgaaaaatcccatcagaggcagggcatggtggttcacacctgtaattccagcgctttgagaggctgaggtgggaggatcgcttgagcccaggagttagagaccagcctaggtaacatggcgaaaccctgtgtctacaaaaaatttttaaagattagctgggcattgtggcgtgtctgtatttccagctactggggtggctgaggcaggaggattgcttgaacccaggagtttgaggctacagtgagctatgattgcaccagttcactccagcctgggcaatagactgagaccctgtctcaaaaacaaaaattcccatcagaagccggccctgtcctcctcatcccctcagcagctgggcaaggagtgagggccccaagcccagctagcatcctgcttcatagcagcaggtgattctcgctggcagatgcatagaaggcagatgttgtgggtgctgaaaggagctgttcggtatttgctctagggctcattcattcccaagacctctatgcccagccgtgaggaagggagaagagttgggagggcgttcagtcttgaccgagactctgcaatgaaggcctgggcgtgaacagggaatagggggcaggctcacgacctgaacgtgggctgcttgctctgctccagagcctgcgttttctgacatccccccttg

SEQ ID NO: 173279 - DNA, 309 bp, Homo sapiens
ttcctctctttcaaagttccgctcctacttctttaggaccttccctggtcttccctctgagaactccatctctctagcctatgtacaacgttcttgatactgcatatcactcgactctctgtcttgcattttagttatactggtccacgtttcttatcttgcctattagagcatgaaattctaagggaagggggttgtagacttatccttacatcaatcctagtaactcacagcgcagagcattccctgaaatgatccttggcaaaaggcatcaaatactctacctgatagatgtggtgtagaaatgaa

SEQ ID NO: 173280 - DNA, 165 bp, Homo sapiens
atcccgaggattcctgcccggatagcctgatccaagatcttgccactgcactccagcctggttgccacagtgagaccctgtctcaaaaaacaaaaaagaccagtgtaaattaactagactaaggaggaaagtggcaaaagatatggtaaaataggtaaccaaagg

SEQ ID NO: 173281 - DNA, 367 bp, Homo sapiens
tgtaggaggggtgttgggagttggcaattcggtctgggagagaaggttttaatccgagtgaagagccctttgcactagcctgggaggaggctgaactgtcatcctgccttgactcaacacagccattcccctagaagttacagcacttctagggtcacctgtgttcagagatctaccctgtgtgcacacatggagaagaggcttaggttgttaaagtcagcatgttaaatcatttcctgaaatgcgactgtaactagaacccagctgacttcccccacagccgttcttacctattttattactgtctggcataattaccagcatgtaaactccaagaaggtgcttcatcttattttagtgcctggca

SEQ ID NO: 173282 - DNA, 483 bp, Homo sapiens
tgaaccccaagaatggagtcgccgctcttgtagtcgccggccttgttttcttcttgcacgcaaatcccggaacgaccggaaccgccatccccgcctgcgtcccaggggcgccccattacgcatggcgggggggcccgcggggctactccgggaggggatccgtgaggccgaggccggggagggctgcgaggtggctcgcgggggtgcaagccggagcggggctacacaccacacaaacagcctccctttcccccggaagagcgggcgagggaagacgcgggctagctctgggggctccccaggactgtgggagccaggcgaggaccgcaaggcggaagggagtgctgcagacaaaccatcggccccacctggaagacattggtggcctcgtggccggtggtgaacggtctcacgcttccccaaagtggcgtgcgctactctagcgtgggagggaaaggacacaaacttggccatctgccagaa

SEQ ID NO: 173283 - DNA, 219 bp, Homo sapiens
cagggtgtgcagggctgcatctgtcacaggtcactggctgcgtggccggaggtgccaggcaggacagggagcccaatcagagatgcccaggcctggtgcgaggagcccactctgtccatcctgccgtccgcggctgtcatgcaccacctcatcccctccttcagggccagggacagtccctaggactcagcctccccccgcattccccggtcctgcccc

SEQ ID NO: 173284 - DNA, 436 bp, Homo sapiens
cttgttcaactgcggttgcacaaaggagtgggactaggccatctagctaccaaacaaaagtggagatagaaaggatcaagttcactttctgggggcctggtgatgggaagtcactctatcctttctctataattcagaagaagagccttagcccagcctcctatattggagatgttttcatagctgcccacttataggaggaatcacctggctaaattctatgcagtgtttcaaaattatagctatcgctacattgtgaacatggtgataatgttattttaattatccagccattcctccaagaaatcagaattcctttgttccacctcactaggggtaagcaaggattataaatcatagctaggaaatttaaagcaacggattatttaagaacaccatgggccaggcgccgtggctcacgcctgtaatcccagca

SEQ ID NO: 173285 - DNA, 416 bp, Homo sapiens
catctacaacaatgcctgaggctgccagaatcaagagcagaggcgtggaacagactccccctcacagccttcagaaggaaccaaccctgatgcctagatcctgaacttcacatttctgtcttttagccccctagtttgtggtacgttgttactaggcagccctgggaaattaatgcggtgaggggtggggaggacaccaagcggaacattagcacagccagggaatggtatctgggtggcaatagggagcggtggggactctggcaaactggagagcccatagcccagtggaagccggctccagctggttgttgccgcgtgggattgcaagcctgagcttcagactctctaaagaacctggaaatctagatttgtatgtgaaatcatgaaatcacctcatcttttaatgttggcta

SEQ ID NO: 173286 - DNA, 617 bp, Homo sapiens
aagtagttcatgttagttcatgtgaaatcagacatctaaaagtgctctgcgaagcaggcaggaagcaccggctgtgccctgccttcactgggatcactctgcccccaccacagggacttgggaaactgcttggttttaccatccaagagacctgggggtgggagataaggagcaaaccctctacttcttcaagccctcactccagcaaatcctccaggcagccaggcaatgctgaagtccctgtccaagggggtctaggctgagcccgggtggagtgggttcttgggccaaggtgcctggaggggactgaaggcctctacccaaagtcctcatgagaactgggtgggggagcctgtgttcaggtgaggggtacggaggcacctctgtggcacagcctttgcgaggagggctgtggagggagacctccggggccggggtcgaaggacatcgtgtgggcgcgaccgcagtgctgggcggggggcgggcgcttgggcttgggccctgcgtcctgtgcgtgttggtttcctgtgggcacgtggggccctcggaagaggggaggagggtgagcacgtcctcagagggcagacccagcgaggcgtcgtggcagctgcggccgc

SEQ ID NO: 173287 - DNA, 117 bp, Homo sapiens
tgctggagttacaggtgtgagccaccttgctttgcccctattctcagtgttcacagggaaaaatgccaggaaggttttgtgcacccagccttcctccctctcactctttagtccctt

SEQ ID NO: 173288 - DNA, 371 bp, Homo sapiens
tgagactacaggtgcgcgtcaccatgtgcagctaatttttgaatttttttgtagagcgggggtctccttacgttgctcatgttggtcttgaactcttgggctcaagtgatcctccttcctcagcttcccaaagtgctgggattacaagtgtagccaacatgcctggccttaccaaggttttaagcctttcttgataaagttttatgttttcttcataaaatgatgatatttcttttgtggaatttatccctgggtaacttacgttcgtttttgttataaattatatttttgttataaattatatttttgttttcttttttcttcaaccctggcaaatggatatattttctttttttttttttttgagacag

SEQ ID NO: 173289 - DNA, 117 bp, Homo sapiens
ctgctgagaacaaatatatactaaaatatggcaaaatctagggaagtttggattttaccgtcacccaataattccagtcccagaaacgtaacctaaaacagtaattttcaaattgtg

SEQ ID NO: 173290 - DNA, 393 bp, Homo sapiens
agaatgagggacattagatagaattcagtgtaaaaacaaagtttatcttcagggtcaagtgcttaagaaagccactataatatagtaaaaagggtatgatttgtagacagcaatgctgggtacgaatcagacatctgttacttcacagttgtgagattttgggcaactaaaccattctctcatggaaatttctttattaaaaatgcaggaataataaaaattacttcatcagattcttgtgtgaattaaatggtcaaatattgtaatagtgcctatcatagattaggctctgaaaacaaacaagcaaaccgaacaaactggatccagaaaattttcaataggttcacgtttcccagtgtaaaataggatagtcttggttgatgttcccttttc

SEQ ID NO: 173291 - DNA, 121 bp, Homo sapiens
atcccagaggttggggagggatgagcagggaagaggggactccaaaatggagtcctataggcttagtaggggttggttaactgaggaagatatggagtgaccagttaaaggacagtgttgg

SEQ ID NO: 173292 - DNA, 322 bp, Homo sapiens
cgcaatgatgtcatgtgacaatgttagaccatttgtgataaaatgaaaggaaaacgcagtggcatatgcctgtaatcccagtactttgggaggccaaggagtattgcttgagctcaggagttcgagaccaacctcggcaacatggcaaaacctcatctctacaaaaattagctgagtgtagtggcatatgcctctagtctgagctactcagggccctgaggtgggaggattatttgggcccaggaggttaaggctgcaagtgagctgtgatcatgccactgcactccagcctgggcgagagtgaaaccctgcctcaaaaatt

SEQ ID NO: 173293 - DNA, 430 bp, Homo sapiens
ggaagcatctccattgtgcggatgggtaaactgaggcccagagcgcgcggttgggctggccacggaggcagggccgccggatgctgtgcggggatggggccctgcaccccttgcgcctctcaccatggggcctcaggcccctgttgcccggcagcgtctctggagtgggcattttgaacgagctccctcctgattttcacacagacttaagcctgacgaccgtgctggggcggatgtctgcccctctggtgaccaggtcacagctcccttgggaagacgattgactggggaatggggaccctggggagggggccttcagggtgccatctgtctgtttacgccagaaaacagagatttctgttttctttcgctgggctcacagcaggtgcttaataaacagatcttgtggcgggagcagaggacagcgagg

SEQ ID NO: 173294 - DNA, 363 bp, Homo sapiens
cttgtgaagaaggtgcttgcttctccttcaccttccaccctgattttaagtttcctgaggcctccccagccatgtagaactgtgagtcaattaaaccaattttatttataaattatccggtctcaggtagttctttatagcagtgtgagaatgaactaatacacactgatttattgacccactgtgagacagtaccctttaaatcttatcatgtctttaaaatgctaacattcagggaattagctaagcagcattccagatgagatcagatctaagacaagataaaatccttaaatgcttaaactgcctgctttggattccctgcaaaatttaccaaaaaacaaacacacaaacaaaaaaatg

SEQ ID NO: 173295 - DNA, 292 bp, Homo sapiens
aaaagccaagaaaaacttccacctggcaggtgtcatgaaccagtttaagccagtttggagcaaataaacattgctactcttactcctgccggttgacctcagatgacctctcaccagtactgggtgtagaccatcacccattagctggcctggggagttttacagtgcatatgagggtcctggatgtcgtcttggacatttgatgatgtttctgcacagaataatagttctgcagctaatacataggaaaatccaaaaatttctgctttagagtagggagcttgggccacag

SEQ ID NO: 173296 - DNA, 562 bp, Homo sapiens
ccaggctcaagtggaagaaatgaggttgatgatgaatcagttggaagaggatcttgtctcagcaagaagacggagtgatctctacgaatctgagctgagagagtctcggcttgctgctgaagaattcaagcggaaagcgacagaatgtcagcataaactgttgaaggctaaggatcaagggaagcctgaagtgggagaatatgcgaaactggagaagatcaatgctgagcagcagctcaaaattcaggagctccaagagaaactggagaaggctgtaaaagccagcacggaggccaccgagctgctgcagaatatccgccaggcaaaggagcgagccgagagggagctggagaagctgcagaaccgagaggattcttctgaaggcatcagaaagaagctggtggaagctgaggagctcgaagagaaacatcgggaggcccaagtctcagcccagcacctagaagtgcacctgaaacagaaagagcagcactatgaggaaaagattaaagtgttggacatcagataaagaaagacctggctgacaggagacacttgcatccac

SEQ ID NO: 173297 - DNA, 477 bp, Homo sapiens
aaaacacctcccattatgcaacaaagtccaattacagaaagatatttaattaagcctgtactaagaaagttctaaatacccttaataatgaacccaaacctaaggaggattttataagttagcaagagtgtaatttgcttcacagtgcagttatcagattgatgtaatctcagcactctgggaggccgaggtgggcagatcaactgaagtcaggagttcgagaccagcctgaccaacatggagaaaccccgtctctattaaaaatacaaaattagccaggcatggtggcgcatgcctataatcccagatactcaggaggctgaggcaagagaatctcttggacccgggaggcagagatagcggtgagctgagatcatgccattgcactccagcctgggcaacaagtgcgaaactgcatctcaaaacaaaaaaacaaaatgtttgatgaaaaaatgttcatctcaaagcaaaaaattc

SEQ ID NO: 173298 - DNA, 175 bp, Homo sapiens
cagctactgttatggtgcagggccacaggctctcccttttaaagggcttcacagaagacaaaagggtacacaaaaagaggctgtgtatcctcacaaatttctccttttctgtccatttttaaatcacttagaatagtgcctcctttacacttaaaatcccaggccttacttagat

SEQ ID NO: 173299 - DNA, 313 bp, Homo sapiens
cattctttagtgtcagaaccatttgtgattatagtggttttacccctgccctactgagcgcatttgttgtaacccttagcgtgcatcttcactctgtggtacactcagatgtaaatcttccagaggctgatgggtgcttgatagtggcctttccttcaccaggaattgctctgatttctagtgaagtaaaataaccttccataaaagcatgaaaagtgtctggtcccaggtttcagtcctaactcagttttcaccttccaggttctaagtgcacattgaattttcttcctagacagtactcaaaaggctgggg

SEQ ID NO: 173300 - DNA, 625 bp, Homo sapiens
gggaaggtgagacaggaaaatcacttgaacccgggaggcagaggttgcagtgagccaagatcaagccactacactccagcctgggtgacaagagtaaaactccgtctcaaaaaaaaaaggaacaattgtataatcccacttatgtgatatatctagaaaaggtaaattcacacagacagaaaatagaataaaggcaactagagatcaggagaaggggatatggagagttagcgtttaatgggtaaagagtttctgtttggggccgggcgcagtggtttacatctataatcccaacattttgggaggctgaggcaggtggatcacttgaggtcagaagttcaaaaccagcctggccaacatggcgaaacccgtctctattaaaaaaaaaaaaaaaagaaaagaaaaagaaaaaatttgagactctgtctcaaaaaaataaataattaatttttttaaaaatacaaaaattagccaggcctggtggcacatgcttgtaatcccagctaatggagaggttgaggcatgagaattgcttgaccctgggaggtagagtttacagtgagctgagattgagccattgtactccagcctgggcaagagagcaagacttcatctcaaaaaaaaa

SEQ ID NO: 173301 - DNA, 196 bp, Homo sapiens
tgtcttttttttcagtctatgaaacttattgtttcattgtgcttccatacacacacttacacgtacaatcaatctgatgccttcttttttttatattaaatggcagtgagccatgaaagactacagagaattataagcagagtctgccttaaaaaaaaaacctcctccagtgacagtaattggataaatgctattt

SEQ ID NO: 173302 - DNA, 567 bp, Homo sapiens
tcatgggagctgaaaggcatttttctaggtattgggcctacaagagtgttacagtttagcagaagaaacagaaaaataggcaggtgtgatgttactgatgcaggaggcacggattgctctgagtacacccgaggagcacctaatagtgaaacagctaccatttgttgaacactagtgatgtctcagacagtcacccacatgctttgttttctgttttctcccttagcaatgccctataagccccgccccttacccaaggcctttactcacactcactgtgtcctcacaacaacataagcaaggggtaaaaattcacagcctgtggagtgcagagccatgctctttcccctttatcacgcagggcaccattaatattttaaggcacttcagaaaaagacctgtctcggagaaagagagtccaaaagaacatctgtctcctcacctcacgctactttgcacctggccatatttccaaatcaattccacaccctgtttgaaagcagctcaccttggggatggattagaaaaatcgcaagccccaggcctgggtatgtgagtgagtttcgg

SEQ ID NO: 173303 - DNA, 433 bp, Homo sapiens
cttctggaattttgtttgttttcggctgagatgagttgttcattaaacagaggtcatccaaggcgtggcaggaaccacaaggccctggttttctgtgcactagaggacaagaaagttatagctcgatccactgggccaaagcagccctgaccacatattttgacaagctcagtctgcagaaagcaaaagcattctgacaagccagtcactgaaacaaggagatctttcacttaacccttggcaattattagcttgataatgggcatctgctaggtgtagctgaatagtgaacaagacattactaggcagaaaaaaataaccttacagcggggtagaaatatttaggtccccctgcaaacactgattgagcacttattccgtggcaggaacgttcacacgcattaactcagccctgggtgactcgggaatggca

SEQ ID NO: 173304 - DNA, 504 bp, Homo sapiens
ctctaagacacagagaacaatagcagagcccctgcccaggggcgctggggtatctccctcctcctttacaaagtgagtaggggagagaaatttggctgggccctccatccagcctagaccaacaaccaggaagaccgcctgtgccccagcttctattgaagaggaggctgagctcagcactggacaggacctgagtgttcagcatcaggaagaaaactgggctggagcccctgctcccctctgcacactctcgcctgctcggttgctcttcctggctctctggagaactcagggagccgctggctgaggacgccccacccccaagcagaaataagaatgaagtgcctgacctcctaccctgacccggggcagtgccagccgccgcgtcctcaacccctgacccacctgctgcagctcgtggcagcggccctgtatgtggagcccccgctgagcccaggccggctctcctgttatgctgcactattaatatttaaaactatctta

SEQ ID NO: 173305 - DNA, 256 bp, Homo sapiens
tgatctttctctcttgttctttgggaaacagtcacagagttctggcgctaataaatactataaaaagtaggaaatacagtctaaagaagcagaatattctgtttaaagttgatgtggtgctttttgtgcaccaagcattggctcaaaagcctgaaaattaggcagcaatacttcctaagctcatcttcaaccataaggcagaaaagccaaacatatctgaaaatataatatcactggtaccttataccagcactaa

SEQ ID NO: 173306 - DNA, 609 bp, Homo sapiens
tggtaaaaggaaaatggcagctctatgttactaccagtagtgaaggtgaatgatggattgttacatacagagtaagacttaaatgttgtgaagtttcctacagtttgacaaccaaaacatctaaaaaattcaaataaattttaaggtaatcttgatcttggttgtgagttgcaccagagaggacagtttatttttagttaacttgtacttaacctgcacaataagagtggtgactgactcaaatgtaggtagtactttattgtattccaatttaaaaaaacaaaattaagtctatattttaaaaactctgacaatagcaagatatttaatgaactctacttcatatctagttcattttttttttctggtttgaaaaaaagatcagctttccctgaataaacaaaaatgaatgtaaataaacatgaaaatacaaaaccataatttccaaaaacgaaatgaatgggccaacagtaaaatgcacaatgagccacaactgccctggtatttaagaaaataaaggtcaactgtgggtcataaagaagtatcaacttttaaaaatatatgtatgtattgctactcatagcatactctgacctaaaagaggcagat

SEQ ID NO: 173307 - DNA, 466 bp, Homo sapiens
cagcctctgaagtcagcagtgaatacatgtgacacaggatttcctccataatgctatgtgccacgaatgcatgaaggaatgaatgaaaagaaagcaaatgtgtgggaataatctacaagagttggtaagtcattggaggtggagatgtatatctaatgggtgggaatgcacaaatttgtaaatatgtgtcaagtgtaccattgggtacatgcggacaaggaatgtggagggaacaggagctgatacgtgagaaggagcacatttcagaatcaaaactattctgctttctaatactggctttgccacttatcaatcttgtgacttaaggaagttttctactctgagtctcagcttcatctctaaaatgaggataatgataactgtttgtgaaaaatattaagttggataaaataaaacaatgtaaatgactcaatttttttttctgagacaaagtcttcctatgtct

SEQ ID NO: 173308 - DNA, 135 bp, Homo sapiens
cccagagaggagagaagggtacagagactcagagagagagatctcgagagacaagagacagagatgggaaggggcggagaatgcaggaggaagggagaggaagagctctctaggtttacttcaggccccaaagcc

SEQ ID NO: 173309 - DNA, 311 bp, Homo sapiens
ttatttgtagttgaatatttacaatttcaaacgggttttctcttttcaataaaaagaaatgtgcctaaaaaaatacacacacacacacacagaaaacattttggggatcttggagtcacagagtagagagtagctggtttcctccaaaacttttagactttttagctgatctataatacttaaataaccagagcaataaactcttctcatttttacagtaatagaaatgtcaatattgtccattgattatctgtcctggtgggcctagtttggaggaagggagcacacccaacaattaatcagctgtcatt

SEQ ID NO: 173310 - DNA, 199 bp, Homo sapiens
ccacatgtaaaataatgaagttagacctctgcattcatacaatatacaaaaattaaaatagatcaaagacataaatgcaggccagacatggtggcttatgcctgtaatcccaacactttgggagactgaggtgggagatcatttgaggcaaggaattcaagaccagcctgggcaacatagcaagacccccatttgtatt

SEQ ID NO: 173311 - DNA, 588 bp, Homo sapiens
catatttacagtggccatataaactgtccctgtaggagttcctcaaattagaaacagtaagccatggagaaacttcactgtgctcattctttttctaaggtgaaagtcaaatgccattagtagtatgtaatttttcatccataacaaacttaagaattcatctcttctatagttttcttccttttcagaccataggaaaacgtgataccaatggcggaaaagatgacaacgtgtgaagttgctttgcaaattatggcagtgggccactctacataagggttatttcactgtggctgatcttgccttttgtgcctccttttcttgagcataacccaaagattttaaataaagactaatccaaaatgtcaacaataaaacagttttgctgtggattttaaacactagtatggatgagttagggttatctgttattctctggacttattgctccatcccagggatctccatttgttcacttgagtagccattgctcctctatgcactaattataccttgggattcctttttatttgagatgggggtctcgctctgtcactcaggctggagtgcagtagcacaatcacggct

SEQ ID NO: 173312 - DNA, 279 bp, Homo sapiens
ctgggtatagtggctcacacctgtaatctcagcactttgggaggctgcttgaggctaggaggtcaacaccaacctgtgcctgtagtcttatctactcgggaggctgagacaggaggactgcttgagcctcctgagtagctagaacaacaggtatgctctaccatatctggctaatttttttttaaagctacatatgtcatgaacgcataaaatttatgtagatcctagtctattttatcatttactaccataaaatatatatgtcttttttttttttct

SEQ ID NO: 173313 - DNA, 480 bp, Homo sapiens
tcagttctgggaaatccctgcccctttcctggaaacctcacaaataatccaccctttgtttagcatagaatcaagaaataatcataagaacactcagttaagcagcccatgtcgctgctctatggagtagccatttttctgtttcttctttaataaaattgctttcactttactgggtggactcgtctcgaactctttcttatgcaaggtccaagaaccctctcctggggtctggatcaggacccctttccagttacactacctccttaagccttctgacctcttcctcaatagtatgttgagaaagttctggcactatcctcctcattttactctaggccaagttcaatcctgaccatctgttaggactagctctgggatctcctgctatagcactggatcttgagttgtgggtaaaggccctcaaacgggaaaaactccccagggccaggcttatattccaccccacccccagtccaa

SEQ ID NO: 173314 - DNA, 156 bp, Homo sapiens
ttgatcaacagagcggcatttctggtctcagattcctggattgcaccaaatgacctctgaggggataacagaggactccacgcaggaagggttcaggcagtcatgttgcccaacatgtgcggtgacagcataaacaccagggtgacttgtcccagg

SEQ ID NO: 173315 - DNA, 800 bp, Homo sapiens
tcacctggcagcctcgcggcgctaaagccggcggagcctgagacagcgcgcggcgaggcggtcacgctccacccccgcgtggcggcaggactcggatttcgcccctggttttaaaattgtgccggtggagcccgggacgctgggaagagcgttctgcgcccctccagtcgcggtctccgccctaaaccgacttccagagccgcctctgctccctggaggggcgcagtggcggacaccggcgtcccacgaagtcgcaggtcctcagtctgagggctgccccgcacgctcggaatgcaggagggtctccgcctcgctgcgctgcccctgggggcggaggcgtgcgctgcaggcgagagaggcggcccggtatcgatggagaagcacagagggctttgaggtcgcaacgtcccggttgctgagcggagtcgggagtcaggttccaaagggacagcgctcagggttgtaatcaccacccggcccaccgcttccgcagctgcgagtctagggcggagctgttgggtggaccgagcaggcgaggcgcaggcaggcagcggctccgcctcggaatccgcctcgaccggggcccaggtgcccgccccacctgtccctcggtcaccccaaccctgtttcctcgacccccagcactcctccaggcctagttcgcttcagaagcgcaagacccggaaaacaaggaagaagcgagctcagcctcaatccccgtccccaccccactttcgggaccgctaagctggagaattgaagggggcggaccccggattaaagccgctcccttcccagcc

SEQ ID NO: 173316 - DNA, 145 bp, Homo sapiens
caccagaaaatgccaccatattccctttctgttaatctccaacattctggtttctaaacaaaaaattaatgatctgctcttaaactttcaagaaatggaatcacactatgtactctttcaggtctgtctggtttcttttgcttca

SEQ ID NO: 173317 - DNA, 316 bp, Homo sapiens
ggaaaactctagcctgatgtaaaaatctacattcattctgcagcactatggtaataggtgttttatgattctctcctttgatcaacgtgtctggttatccaacttgtgaagctcttgtgagggcttctaaagtatgaagatgagaacaacaggttagttaatcttggcattgcatgaccctagatacccagtcattatttgcatttaacgtgggatatcagaagtgtccttatgcgaatgctgtgtgcgtctattcctaatgaactgcttagtgtgatgtaggtagtgcctacgacacttcttctttgctcctcta

SEQ ID NO: 173318 - DNA, 334 bp, Homo sapiens
acaacacagagaaagatctgaatctttggccaaacatgatagaaaggccttcataacagtttacagagacaatcttcaattttgtatgcttcatacattttacagaatctgtaacagtgtgagaaacaagaccaaagctcatcaacataaaaatttccacagccaatttataaagtttatgaagagaattctattagtgaccaaacagtacatttttatgctatccagctgttttacttcaatggccaaagaggacgtgtgagaataaatcatcatcatttgtaaaaagtccttgggggactcacatgatagtctaactgtcagtataatctct

SEQ ID NO: 173319 - DNA, 476 bp, Homo sapiens
tgtcatggaggaagctgggatgcagttgtggatgagtgaatttatgatggggaaatttaacacagggctgattcatggcttttcatcccaggcctgggggaagctcagacccctgtactccggctgccttcatttatttcagactcgtgtgtgaagaggccgggggtgggagaagggtgaagaaaaggttgaacaccaggcatggggcgagagcgccttcacccaccaggctcctcaggaacccagtcctgggaaatggccttgcagagggaacagtcgcagctgggttccattctccagtttctaaaaggaggcaggaaaaaaatcattctgcacatttgcagtcgtctccctgcctggcttttttttttctttcctgcaagcacagaggacgtggtccctgtgtcctgccacagcgcgtgggggctcgttaattaaagagccgagcagatgtcactgttcattaagcgcggccg

SEQ ID NO: 173320 - DNA, 309 bp, Homo sapiens
cagtgtttgcaaaaaagaaggtgttaccactttttacccctagctgtgtcaatggaacagccaatgccttggcctactgtgactggacacgcattctgacttgcagctgcagtttcccttcttatggctgctcccagataagaccgctgcacagaacccagtcctggcaactgctgcctggtcctctccagcggcctgtgcagagttccacactagctccttgtttatatcagtcccgtaattaagccagggccaggaagagaagtcccaaagagggcaacgaaagtgcaaggcaaagaactggctttc

SEQ ID NO: 173321 - DNA, 323 bp, Homo sapiens
agggcaatggggtctgacagggtacactttaaggcaggagtaggtgagagaaaaataattgttttggccaggcgcggtggctcaggcctgtaatcccagcactttgggaggccgaggcggatggatcatgaggtcaggagatcgagatcatcctggctaacacggtgaaacccctgtctctactaaaaaatacaaaaaattagccgggcgtggtggcaggcgcctgtagtcccagctactcggggattacaggcatgaaaccatgcccagccgatttctctcattttttgttttttttttttaagagacaaggtctcgctgtg

SEQ ID NO: 173322 - DNA, 512 bp, Homo sapiens
ccttgtaccatccttgcaccttctctgaactcctctgtatcaatagttttacttcttaacattattttctactctagaaaaacttcaaaatggatacattttgctcaaataataggcaacgttccctgtttgggcatttctgttctttcctgcaggcactcatttactcattccacaagtgtctgccaaaggcctgctagccccacgcactgtgcaggctgtgcagacggattgcagacgcagccacaggtcagcacaggagagtgagaagtgacttcaggacaccaggcacatccgtcagcgaccaagcaggaaatcgtccaaaggaagagactctagagaaaggattctttacggaggtatgggtagggctgggggaccacacaggagatggcggggaaccccgagacttctcacagtgggcagtgccaccttccctacgactaaaggagcaaggaaaggcaggtgagagctggaacctagaggagaaggctgtcgtcatgaagggtcag

SEQ ID NO: 173323 - DNA, 276 bp, Homo sapiens
ttagtacacacaggccaaaacaggcacctaatttgctcaccctgagtcacctaaaagctgagctgcagatgggcctcaggtaccctgaccctaccacgactcatctccatctttctctgcatgttggttttattccttttcctggctggaaaaatggtcaccagcagcttgcaggccccacactccctgcctacccttcccagaggatctgagcatgaaagcggtaatgttagatccatgggcttaggaataatgcctagctgtgctgactggggc

SEQ ID NO: 173324 - DNA, 849 bp, Homo sapiens
aatgacacgtaaaggtttaaaattcagggatgtgaaaccatacagcaggcaaatgaaatttaaaaagtaggtatagcagtatcacaatagacaaaaaagtaatcaagaagcaaatctttagaagggaaaaagaaatatttttaccaccaaaaagaataaccttccacaagtggataacaatcaccaattatctatatacttaacaatatagctttgaaatatataaagaaaaaaagacaaaacccataacacaacttgacaatcacaatcagattagaacacctctctctgaaaataagagacaaatcaaaagaaaaataagtaatactatgaaggctaggaataacaaattctaatcaacctaagagacataatattaacctgataacgaatatatgtactcaggaccccacataaaaagaactcacttcacagagaatggctgcacagcagccaacaaagaaagtattaacaaatttctaaatactgctaacctgcagatcatactcactaacctaaatacagtaacataagaaataatgaaataacagacaaaaaaaattaatgggaaattttaaaccacattttaaaataatgtatgggtttgagaataaatgaatggttaaattttaaaatcaaattgaatgacaatcactacactacctgagaaaactgtgagatactaccaaaatggtactcataggaaacagtacatcaaatggcatttcagagaataaaagagtttaaaaataaatgacttatttcaaaacaagcactagaaaaatgaacaaagtaaaaagaacaaaaatagtagaattgattaggataaaagaatgtaataaatacatg

SEQ ID NO: 173325 - DNA, 211 bp, Homo sapiens
tgacagactcgaaatactggttttctgatttctaatacaatatgtcatattattccccaaaagtaaataaatatatttgtacaagtgaaaaatgaaaagaaaatgtctcgtgtagatatgattcttaaagagggtatttgctatggattgcatcctaatgggggcctctttaggcagtggtttgtttgtttgtttgtttgtttgttttttg

SEQ ID NO: 173326 - DNA, 463 bp, Homo sapiens
agttagggcctcagtatcctcagctgtgctacatccaaggtagatcctccatcccatgaataggggctgggtggaagaagggacccccacctcttgactatactgacccaatactcagccccagcaataggcagctggggactggatgagaaatgctgtcatcccacccctcctaggaagatagctctctgagtggaagcttggaaaacagggagcctcgtactcttggctgcaccagtctggagtggagtttccatcttgctgagctgggattgggaaggaagggactatgccctggttcagacaccacagactcactattcttactgagcagtagtaggttttcttgaataaatgtttcttcatatgctgtatgtccccaggaccatttgcagagactttaaatagttgtccttttatgattttcaccagttttgccaaggagtttgtccacagagctctt

SEQ ID NO: 173327 - DNA, 450 bp, Homo sapiens
tctagtcagacataaagctggagaggttggttctgcccctgaagatcgaaggtttggcagtctttcctattgccaaaagaacgatgtcggaggccacatccatctccctaggtgtcgatgtgacgctgtctccacgaactggtttgtgggggagcagactttgccacaggccctgtttgagttccttactctttacacattctcagaactctttctccccctgtcttcctgccacttccttttctaccgttttcatcctggatgtgttgatgcgagatccacacagtgccctggctcaaattttacccaggacactctcaggacagggtttaaatacgaccccaatcttcacaatcccaactctgctgggctgagttgccaagtagaggttggcattgtggcttccgaggacttgaactgaattgagcctctgtctccgctcccctggca

SEQ ID NO: 173328 - DNA, 285 bp, Homo sapiens
catctgaaagctagatctcggagaaaatgtgacatgaaagcgaacagatggggtaattgaggaccaaaaaaaaaaagaaaatgctgcagggctttctgtgatactaatatcttctgtttagctgagcagcacctgataaattagggcataatttcatctgtataaaatgatataaatccttggaagggaggcatgagaattatctagtaaatatgaagatttccaaaataaggagtacttattttgcaacaggtaatattaggcaagttctaggtcatcaaattg

SEQ ID NO: 173329 - DNA, 212 bp, Homo sapiens
tggtgttctcttagcttcctgaatttgtagtttggtgtctgacattaatttggggaaaattctccatcattattgcttcaaatactacttttccattttttctcctctgttattccagttacatgcatgttacaccttttatggttgcacggttcttcaatattctgttctttttttttttttttttgagatggggtctcactctgttgccc

SEQ ID NO: 173330 - DNA, 484 bp, Homo sapiens
caaaacacgccacttccttttccagcaccaactgggtgctaccagcactaactcgtcttctaagcactaagtagtgcccagtgggccatggcagcctataagaagggctgactaccagctgtgtgaccctgggcttaaggccatgaggcagggctgggcagtgactcttcgctaacctgggagtgggagacctttactgtagctgcaccacttacctgccggtgaccttgctcaagctgcgtcttccctgggccgtggtttctgcatctgtaaaatcggagaaatgcactaggacagtggttcttaaggtgtggccccttcagcatcagcatcatttgagaacttgttagaaatactaattctaggctgggcatggtggttcatacctatgatcccaacaatttggaaggcccaagcaggaggagtacttgaggccaggagtttaggaccagtctgggcaacagagcgagacctcgtctgcaca

SEQ ID NO: 173331 - DNA, 643 bp, Homo sapiens
ggcgcggtggttcatgcctgtaatcccagcactttgggaggccgaggtggtggatcacctgaggtcagcagttcaagacaagcctggataacatagtgaaaccctgtttctactaaaaaatacataaaattagccgggtgtggtggcacgcgcctgtaatcccagccactcaggaggctgaggtggaagaatcgcttgaaccaggaggagaaggttgcagtgggccgagatcgcgccattgcactccagcttgggcaacaactaaccatcaaccacagaaaaatgccaaggaaaaactcagacagcttttcatgatcttccaatcataatgatgaaaaattaaagggatatgatgcataatttaaaatacgctgtctgggcgtggtgcttcacacctgtaatcccaacacttcgtaaggcttaagcaggaggatcgcttgagcccaggagttcgagaccagccagggcaacatagtgagaccactgtctctacaaaaggtttaaaaattagccaggcgtggtggtgtgcgcctgtggtcccagctaccccggaggctgaggcaggacgatggcctgagcccaagaggtggaggctgcagggaaccgtgtttgtgccactgtactccagcctgggcaaccaagc

SEQ ID NO: 173332 - DNA, 692 bp, Homo sapiens
aatgtgccggcacataatagtggataaataagtatttgatgcatgaatgaaaattacatactgttactcattattagaggataaagtaggcgggacacaaagtgagtctggaaagaataggcattatataataaagacgttatattcgtttttcaagctcttcatcaattcaacaaatatgtgtcaagctaccactgtgttccaggtatgctattcaaaatgaggatatgttggaaagctttcttatgagaggatgaaaagttttcacttctgataacttttaggctgttaaggaataaaataagataggaccctccacagatccctaatgagttttttttgcacgaatagcaagtcatttatgcattctttcatacattcattctataaacatttaattgatactgtgaaatagatattttgaaaggtcctggaaatacaataatgaagaaacaaaaagactccctcaagttgctcgatttaggtgatgacacagaaagatccttgctgtaatggagtatgtcaagagtagtggaaacatggcagagtagtttaaactgaaacttgaaaggattagaacagctagtctgatgctattgggataaagaaattttaagctaagaagcaatcccaacaaaagtccagagacttgagagaacaggactttaagggaattgcaagtaggttcgtat

SEQ ID NO: 173333 - DNA, 495 bp, Homo sapiens
tggctgaatgccagaagaaacatttggcttggcttgcattttacacaaacacacacacacacacacacacacgcaaatttttttgagagacaaggtcttgtgctgttgcccaggctagagtgcagtggtgtgatcatactcgctgtaccctcaacctcctgggctcaagctatcctccctcctcagcctcccaagtagctgagactgcaggcacatgccaacactccagctaattttttaaattttttgtagagatgaggtctcattatgttgcccaggctgtctcgaactcctggtcttaaatgatcctcccactttagcctcccaaagtgctggaattacaggtgtaagccacctcacctggactgcattttttttaaaataaaaaagtatattaaatataagaatcacacttggtataacagacacaaacttaccatctctactcctcatggaacatgttcactgtgtgaaatggcatacagaacagactgc

SEQ ID NO: 173334 - DNA, 319 bp, Homo sapiens
ggagctatactatgaaaagaaaattgcttaattttaggagtgaaattacaaatgagaaatactgcagcaaagacctgcccttctaaaagttcttgaatctacctcaaatttctccagacaacaggtttatctcagcatcttctaattcacctttcttttcctctaaaaccagccttgaagttaagatttttaaaaaattgtacttggcagatttaattatcaatgtggcaagcttatgtgtgcctgtgtgtgttggctgattgtagaaaaccgtaaacatgaaaaggtagacagagtgacccagtgagcccccacacat

SEQ ID NO: 173335 - DNA, 381 bp, Homo sapiens
tcaaacacattcagctatttggttgtgggttttcaggaagccaggcctttgcatagtgcagatgctgtaaaatggtatcttgaataaagaaacttaaatattgctttaagtgagccacacctgtgtcatgcatcctttaccaggaaacctatactgctgggagtccatacaaggagtcctttcttgttgtctacttgacaagacatggctctccactaggctgcattatttaagggccaaggtaatgggatggggtttttcttctgtctttttcaaatgaaggagctcttgaagacttatgataaattatgctggaagttatcaaaatattctattccaagtgcttttagaaatgattttttttaaatgatttttttttct

SEQ ID NO: 173336 - DNA, 155 bp, Homo sapiens
cccaggctaagccggcatgttcagcagtggggggtcgcagctcaggggtcaccccatgaagccactggtcttcaccgtggatccgcacaggggtctaaagctgcctgggtcctgacctggcactctgggtccacccagctacccccagcgaaacc

SEQ ID NO: 173337 - DNA, 544 bp, Homo sapiens
agaagtctgcttgttgctctaccctctgtagctgagctaatacctgaggtgcaagacagagagtctcctttattttccccctgcttttctcaaacaggagtctttcactgtagccctcacagctgggaatgtgctgggtcacacctgaagccagcatgtctcagagcccagtgcctatggtatactacctggatagtgctgttgataattcagggccttggcgctctttagtcagcagggggtaaatcctgccaggtttcctctgtgacagggcagcactgagttaagttaaagtgccccagtcactgcattctccctctactaaatgcacagatttctccccaccacgcagccactgctggggatgggggaggcatggcagaagcactcccttagtcaccctggctggtgtcttagtaggttgtgtgcctcctactctagtccactggctctgggcccagcttagcactagggcttgcctaggaattgcagtccttgtggcctaacctgcccctcaagaccacttagggccccagagcactct

SEQ ID NO: 173338 - DNA, 379 bp, Homo sapiens
tttctatccaaccccatccatcttaagagtgaagagatgacagagcccagttaactctctccctcactaggcccccgctcaccctgttccctatatccaaaccaccaaggcctaccaacccacccagttcaatctgcaagaaacagtcctatagaatgactggttctatctaatgggcttcccaaagctcaggtatgcccaagtatcagctttcatcacattactttaatagggttagcatcactggtccaggccttttctaatcatcttcaaaaacgaccacttagttacccatggctgacaacattctacaaaggaggaggcgggaagacttaaggcagcaggaaaaagtcaacaaaccaaccaacaatccagaatg

SEQ ID NO: 173339 - DNA, 191 bp, Homo sapiens
ccaacccacttctgtctccccagggtttctcacatgttttactgtactttttcagatcattaactttctcttttttcaagcaaggttgatgttgtgcaaggttaggattcagaaggagttggcaacttgtgttcctttataatgaagattaacaataaaacttcacgttggggaaaaatgagctcagtaca

SEQ ID NO: 173340 - DNA, 367 bp, Homo sapiens
cttcggacatgataagtgcgcgatcgaatatttggtactaccacctagatcagcagctgcgagtggaattacccgggtgccgcgccctaggcttaagggatcaccggagcggaccacctggcccgcgcggacatccgctcggacctcaatcaggtaggtaccaactaggtaaccttaggcaagttgctaatctctctaagcttgtatttccttgtttgtaaagtggggataataccactgaccattgcaagctttggaggaaaattaggtgaaatgatgtctgcaaagcactgggcatgtttatggacacttagtgtcagtatgcttccctattctctctttcgtggtctagagtgcagattttgag

SEQ ID NO: 173341 - DNA, 578 bp, Homo sapiens
taggtcacacagctattaagtagcaggacaaggatttgattggctttatagcctatgtcctttctattacactaaactgcctctccatatgacaatttaaagaaacattacacccttggaaagtatcagcaatagtagtgtgtttagcattcaaacgtttgttagaaaaaaagagagtggtggtttatgaaaagtaggtacagggcgagcataccttcatttctgctactttctgctgcagtggttaactgtgtgccttctgcctcccctcagtcctctggctggttatgtttattacatgttctgacagttgaggcctgtggtgaaaaatgataacagatttgtattctcaagatcatctccagatgctgactagaagcacctctggattcatgatatatttatctttagtatttcttgaagatgaatgattgaaaaaaaagttctaggagcacttcagcataaatcacagagaattcctttctgtggcaatatggaatgtgtttctctatttctttaagaagaataatgtgtgtattaataacttggttggaatggggactgggccaagatgagat

SEQ ID NO: 173342 - DNA, 468 bp, Homo sapiens
gctacctaatatttctttgattaatacaattcatttaaccagtatttgctatagataagtacagtttgcagtttgagacttgccaaaaagtaaaaaagtaccctggtgaacaaattttattatctttgtgtgctttgaatctatctgaagtttaaattactagtatggaacttgatgggtaaagggtagccgaatttttgatattatgaaattgctctccaaagagaccatgccagtttatactctaataaatagatacataggtaaggggtggtgtatgtttctccacacttcggccaacacacttttcatcacacttttaaatctttgccaaactgataagtaaaaaatagtatctattttaatttgcatttccttaatagagcgaggttgaatctattcagacacttcctgttcttagctccagtattaatttttccactgagttatttgtctttttattcttgg

SEQ ID NO: 173343 - DNA, 585 bp, Homo sapiens
ttagaaagaatttggggtagatttcatattattttagtttgtaatgattttgtactttatattgaactaatttacctgggattaattttggtgtctggtgtggtttaaggatttccacattgaagatggggagatgggctgaggggatatgttagtattccacacaggaaggaacaaaggaaggtacaaaggaaaaggaagggaagctaagagttttaggaaaatgtgagagggagaagcagcttaactgatgtgacttaatgggatgtggggtgggaaggactataggaggaatcttgggtttcttgttttgctgatgctgctagcttcactataaacatttccattatcttcctgtgttaattccttattttgtctggttgttttctggaacttctactaataataattataatggtagctactaccagttattaagcaactgcaggtccacaaagctttctctagaacccttggagcaagatgtgtttcagaattcagaatggtgcagattttagaaaggtgaacaggtcatatactatgtgtggcataacatacccagcaggggctggagcagtaccccaa

SEQ ID NO: 173344 - DNA, 674 bp, Homo sapiens
gtgtgaaagcagacatgactacatataaaattcacagtatggctgtgttccataaagctttatttacaaaaatagatggtgggctgaatttgatttgaggggctggagtttgctggctcctggtctagataactctaggcatgtgtaaatttctgtatatctcaaaatgtcattgttgtttttaaagccaaacaccgtgtcttagaactgtatcattagtctcagcagcacggtgctttgcatggagtacctgtcagtagattttagttaaattattaaatatacttgactttgtcaaagcatataaagagagaaagcaatactaatacactagaatgtaagttccatgaaggcagaaacttccatctgtgttatttacagctctattttcagcttttagatgagggcttggcacataattggtgctcaataaatatttctcagtaaataaatgaaagcctgactttggaagaattaaaacgtaagagctaggtggaacaactgtatgaatggaatgtctaaaacaggttttttccaaacttttcttcggtgaaattacagttgagtgagactgtaatttcaccagtgtttctttggtcacatctcttcagggtgaccaacgaatcagaatagatgttgctataagatgggatcatctgtgccagctgggtcga

SEQ ID NO: 173345 - DNA, 204 bp, Homo sapiens
ggccttttcgccctggggaggatagatgtctgtgcactcctatgcaaattctgggaataaagtgcatatttaaagatttgctgaagtcatgtgttttggggtaggtgttaaataccaagataagaatcagttattaaatttactcagggctgggggtgcaatggcttgcgcctgtaatcctagcactttgggaggctggggtgg

SEQ ID NO: 173346 - DNA, 273 bp, Homo sapiens
ttttgcatccctctccctgtctctttatcctccttcttcccctccctcccactccacctccccttctcttccctcttttctctcttctccacttttccagaaacagaccccccacttcatgttctttgcctcagcctaaacaaatggaggaacggccagcaagggtcacatgttcatgcaggagaaaacagtggagaaggagagacgcagaacagcatgccgaggtccccagtgagcgagggcaagagatgtgggctgtaactgtgcccatgg

SEQ ID NO: 173347 - DNA, 175 bp, Homo sapiens
catattccagtccattacatcttcagtgttttctctttcatgtaatcccaatggtgtaaagattaaaaaataagagtattttgtctattccacatgacaacaaatagatgcaatcattcccaagcccttacccttccttctaagactttatctaccttcacccctcctctgactc

SEQ ID NO: 173348 - DNA, 144 bp, Homo sapiens
gagcagcaagtcaactgctagggctacgcgaggcaaagttggttggcaaccaggttcctcaatagctgtcatgctccagaaaagagccacttctacagcaggttccagaaaaaataaaggggatagattaacgtaaacattcaa

SEQ ID NO: 173349 - DNA, 463 bp, Homo sapiens
agtaaaatctctcttctagctgacaaacatttcagtatttgaagcagtctgtctagcatcaatccaataggtttttaatctacgagttccccaagtgtggtgccccaatcggcagcatgagtatcacgtatggacatatcagaaatgcaaattctgaagtcccagcacatacccacagaatcagaaactctgggggtggaacccagcaagctctggtttaacctgtcctccagatgatcctgatgcacactgaaggccagcgagctggaaaatcattaaaagtgaaagaggagaagtcgagaaacccttgggatgtggaatcagaatgtgttcattaaggtatctcggagatgttaggtaaaaagctacgtccagtgctcagggaactgcagttctataatcaagaggtgaaaaaaaaaaagatgcatcagtcttaatctacacagaaaaagactaattttca

SEQ ID NO: 173350 - DNA, 629 bp, Homo sapiens
tactggctgtttggacttactatccttgccatctagagttaacgtagccatgatggagtgttctcctggatccaacttgctaatatattatttagaatttctggtctatattcctgagacagaaactcagttttgacaaaaataaaaataacataaacaaactgtcataaagagaaatacatcactgctcatatctatgtttttgtgtcaatttaattccatgcgagatattaagatattattgttgatgtctaaatcatttaaaatactcaaaccataaggtattaaaaaattatcatctatatctaaatcatttaaaatactcaaaccatgttctaagttccatagcatttgctatacaagggttcctagtatattaaaaattttaaaaatatgctaaataaaatatttcacttaatattaaaatgcaaactacttaaacattaacaataattgtacttgccttcttagaatttagaaaggttgtttgttatatgatgatttcagggccaaagactctttcaaacacatctaagaaaatataatttgatacttttttccttataaatttcccagtagtaacaaaggaaatccaaaatcttccataattgttacagtaaccacaagtt

SEQ ID NO: 173351 - DNA, 291 bp, Homo sapiens
gtgttctctgtagcttctgcaggcctacttgtggatcaaagcttttgatcttactcaggaaataccccatcaacaagacgcttcctggttgtgtgtcctttaagccggatgtcagaagtggctccgtgcccctcgttgtatgtcaccacgcgttgaggccctcctaaactagatccttcgggacagctacagtggcatggacctctcacttcctgttctccttctgattcttcttcctcttcctcctcctacccctcttctttaattcttctccttctcctccttctcctc

SEQ ID NO: 173352 - DNA, 378 bp, Homo sapiens
ggctgctgttctagaggatccctggaatgatcactgatagcagtaaatggagaatcccgttggcaagactccatctcaaaacaaaaaaaaaacaacaaaaaaagaagtcaccatttggacagggttaatgtccttgttcatgtggaggaggtagggctgtgttccacagtggagcatggaggtttggcacacaggtgatctataaggtgtctcttggtacttccttgtccagtgtttgtggtaaatggacacgagaaaggcccagtgaccaccccatgaagtcagccacctggaccaacagaaatactagccatagattaaaggaatctagaatggctagtagagaagagttgttgatatcaattttaccgtctgtag

SEQ ID NO: 173353 - DNA, 542 bp, Homo sapiens
tagaggatcccctcctacgagcgcatattcagagatggaaacaagaagttttaaaataactcccagactcccaactgtacatgtatttacaaatgtatgacttgatcattgatttttagagggtaaacagaaccagacaagttcatatttttaactaggttatagcctgaatattgtattcggaaggaccatgttatttattaaactgtgtgaggctgccatgattatgctgtagataggcagaggtctccagagtcaattggggttgttgaatcacattcagcgaatgtccttccatctcaattgaagaagcttgctattgagggactcccctgaagtaatcaattaaaagcagtagcattaagcagctaatggtgctgagaaatcaatactggtatggggaaggaacaattccctgcaatgatttctatgcaaattctgattcttatacctaatgacattaggattcactaatgacacataactcaaggaattgcttctttcccagttaagcatgaagcacatttttgcccctacaacct

SEQ ID NO: 173354 - DNA, 205 bp, Homo sapiens
tacaggtaaatgggcccagcccctgagtttctgatctatcgactgtggggtgggacctgagaaactgcatttctaacaagctcccaggtaatgttgatgctgctggtcccccacagtttgacaaccactgagttggacaaggaaggagaggaagaggagcagagatttccaagcaacaggacagcttgcgtgatggcctgaggtg

SEQ ID NO: 173355 - DNA, 408 bp, Homo sapiens
atttatatgtatgtatttaaactgtgcctactaggaatacaatcctacccgtccacatgatgagctatacctgataggaggcaagttgaagccccaagttgatctaaaaatgagaaatactatgaattactgaaggcaacagggtatgtgagataggaaggcagggtgtgggaaatggtagaatgagcaagggggctcgggagtgtggtagatgcattacaccaagtgtttattactttgatgattggtggtaatgagagaagatgagagaagaggagtgggatatggagaaaacaatttcctagtcatctgtatgccccgtgacagtacacagcaatagcccagcaggagtgcacaggcaatatgtgattatgtcaacaaacaaaagttgaattctttatgtcaaca

SEQ ID NO: 173356 - DNA, 378 bp, Homo sapiens
ctggtgagcaggagccaagcccatgagtcatgggccttctccatgttcttcctcaacattggaaacaactttgttttggaatattgctcgtgaggaatccaaacacatagtgttgaatggtgaagggagataaaagatgagatagcacagtaggctgccttcccattcacttgcctaggccagtgatgtaggcgttgatcaatgctgtgtgagtgttctgtggggaaagtccggcaactccctctaaccatagtagcagactttgatcctcctgaaaaggttccctttgacctggttgttaagcattgtggatggtagtgcttgattatttccccccaccctggaagtacttgctagtataagagaatatgctgtctt

SEQ ID NO: 173357 - DNA, 692 bp, Homo sapiens
attctcgtttctttttgggtcctctagggtgttttaaaatttttttcatacaggtttggacacttcttactaagtttatttctggatgttttgttttatgttgctatgaatggagtcattgttggcatatatgaagctgttgatttctacatactaatattattccctgctttccttagttatttgtaattagattatataattgaggcagtaggcatccttgtctgtttagaatctaatagaaatgcctttagtgtttttctattacttttattatcatgatttgcttttcagtgtttttacattagataagatactggcttttgtggtcagatacagattatgattatataaatatagattacccatgctgcctgggtcagtgggagtgtgagcagaaagactgaggacactgctaatagccaaggtgcaacaaccaggaaaatctgttgattgaggaaacaacaatccctcaaaatttcgttattgcatccttaaacaaaaaatcaaatgggacaaaaataagatgtctattcctattcttctgttttctgtcgattcccttcttttgggtgactgtttctttactcatttcctctgtttatcttttgtggtctatttatagctttgcttccttcttaaaagttttgtgtcttaagttcattttgttatgtttcagttttcatctgctt

SEQ ID NO: 173358 - DNA, 809 bp, Homo sapiens
ctttgtagattttaatttgggatagctttatattacagtgttgactaaagttaaaccgccttgatttgttatgattgtctaataaagaaacttctgatggtgtgctaaagaaatgaagttgaactttcagctgtgtgccctcaagtaaatggttcttttttttttttttttgagatagagtctcactctgtcgcccaggctggagtgcagtggcacaatctcggctcactgcaacctccgcctcccaggttcaagcatttctctctgcctcggcctcccgagtagctgggattacaggcacccgccaccacatctggctaatttttgtattctttagtagagaagaggtttcaccatgttggccaggctgatcttgaactcctgacctcaggtgatccgcccacctccgcctcccaaaatgctgggattacaggcgtgagccaccgcacccagacaagtatatgtttctttactgcaattatggattgcctgggtgcactagcataaaacttcagcctcacacatgccaattctcaagtatatgggtctatgacaattttctaaaatgaatcaagtatcaattgaacattagagtataggaatcattcaaaaggctgattctgaaaaatgaaaaagaatagcttcatgttgatttccagctttttgcaatatcatttacgataactagaaaacactgaatcattctaaaattattatgggaatttgcttaacttcatttaagttggaaaacagatcttacacagccttaacaaggcttctaagtcttgccctttaatgacgtaattgtt

SEQ ID NO: 173359 - DNA, 474 bp, Homo sapiens
cgcactctggaagcaacacataatatttttgtttagtataagtatgccccatgctatatttgggaatacttacactaaaaggatatttattgtttacctgaaattcagacctactcagtgtctcgcatttgatcctgcaagcctgctccgtgggccgctggggctctccctttctaagggaggcacctgaaagtgtgaggatcaagagcagtaggaggtgtcagtaataaacctaataagcactgtccagggcatgacacgtcacctcagccccagagcctgctgaatccccaactcctgcttttctgtacctccccttcctcccactggcttctctgcttctgagctgcctgcctctggactttctcttttagtctgtgactttcccctaccctcacctctcctctttttttcctcattttgctctcactgatccgtaacacgtaattaaagtttacatatttgagtgttggt

SEQ ID NO: 173360 - DNA, 250 bp, Homo sapiens
gcccaaccacttacccatttaaatgcttatggactgtgactattttgaaaagagtgcaacactctttcgaaagttactcaccccattccgaatctgtcacctttggtggtcagcatgcttagatgaacagcgcttcacacaaggagtgtaaaggaggctctataactcttggagtgacacctttttgtgaaactgtcctttctcctatcatcttccatctgagtgagttcctgtttttactgacctgtaa

SEQ ID NO: 173361 - DNA, 298 bp, Homo sapiens
atgtgataaagaatctctgcttgaccaaagtgaattttacctacttatcttgggccttaaataagaatagataaattttgagtaaaagttcaacataacaaaggcacaggagtgaccctgttctatttcaggttataccatcagaggcacaaatgctaatgggaggaaggctggcagattccaaaggcaccactaagagattgcttaaagataaaacaatttaccttcattggaagcagaaaatgtgggttggagaattacaagattttttccatataactttaaacttttctcagta

SEQ ID NO: 173362 - DNA, 460 bp, Homo sapiens
caggaataatacgcgatgtcttttgaaaacaacagtcttgtctttcatgcaatgcttctgcacagaaacagccgtgagctgtcagtgtacagtgaatgggagaaagactaacaaaatgagcttccaagtatttttgagagatgggtttggcaccctaaaaacccccatggccagcaccataaaagaaactagaaaccccggagagaggcagaaagcggtccgcactgggcgggacctccactccaggggcaggcaggcacatcagtctggcaggaaggagcaagcgctgctgctcgtctctcagcacacgtggcaagcccaaggcagcaggtggtagagaaacagccgcttggcacaggctcgaggatggcgggagccgccaccctggcaccagaaggagttcagctacagtggcatcaagttcctgcttttataccagacaggacatgcctatatcctt

SEQ ID NO: 173363 - DNA, 244 bp, Homo sapiens
cgactggctcgctcgtcctgccgcgcccggggcgggctccagggagccgcggcttcacccgcgcaggggccgggcccgcatggagccgcggcgggtgcgggccggggttcccacggtgcctgtcgccgcgcgccggcgcgattggggcggcgagggtgggacgggcgccgcccggggccccctcccccgggccggctcctgcagaactagggggcgaggctgccgggaacgggggtggcggccg

SEQ ID NO: 173364 - DNA, 519 bp, Homo sapiens
agactgctggtgaggagtcagatgagacatgatgctagcttggacctgtattggagccgagaacaaagtggtttaattcttgggtgtatttcctaaatagagctgttggaatttgctggtggaatagaattcttttctttttctttgaggcaggatctcgatttgttgcccagcaggagttcagtggcacaaacatggctcaccacagcctcgaacccctgggctcaagcctcagcttccccagtagctgggaccataggcatgcaccactgcgcctgactaatgtttaacattttttgtagaaatggggtctcactttgttgtccagcctggcctcctaaaatgctgggattacaggtatgagctactgcgcctggcctagaaggaacacaatatttgaagggtagagtgtgtgagagaatgtgtcaaggatgatttcagggtttttggcctgaacatctgaaaggatggagttgacattaactgaaatggaaaagaaagacgcagggtctaggagag

SEQ ID NO: 173365 - DNA, 547 bp, Homo sapiens
agacagagtcagtgagatgggaagagcctgttgcccaggctggagtgtagtggcgcaatcttggctcactgcaacctccgcctcccaggttcaagcaattctcatgcctcagcctccagagtagctgggattacaggaacgtgccaccacgcccagctaattttttatatttttagtagagacagggtttcaccatgttgcccaggcttgtctcgaactcctgagctcaggcaatctgcccacctcagctctccaaagtcttaggattacaggcatgagccacggtgcccagccgagactccatttcctacagaaaatttaaaaattagccaggcatggtggtacgtgcttatagttccaactactcaggaggccaagatggcaggataacttgaacccaggaggtcaaggctgcagtgagccatgaaaaaaaaggaaggaagaaagaaatacccagctcttctgagtcccaattatagatgggaaaccctgggtgtgaccttctattcctcatgggcaagacaggacactgttcccagggtcacgg

SEQ ID NO: 173366 - DNA, 625 bp, Homo sapiens
tacctgtgctcctctggctaccttagtgctggcccctgaaatcccaaagtctgtgccctcaccctctcttcccccagctgggactcctccaggtacaaaaaaggttgatggtatttctcatacttcagcattggcacctgttgcttcctctcccaaagagtgcccaactgaggactctggtgcttctgctactgcatcttccaaaggaactctgacttacctagctgattccccatctcctttaggggttagtgtgtctcctcagactaaaagacctccaaccaagaagggttctgctggccctgatactcctattggaaatctctcatcccctgtttctccagttgaagcttcatttcttccagagaatagtctttctttccaaggctctaaagactcaccagccacgacgcattctcccactcctccatcccccaaaggggcccctactccctcagctgtgactcctctgtctcccaaaggagtaacactaccccccaaagagacccccactccttcagtggtgaatctgcccttccccaaagagggtccagctactccagcacccaaacaggctcctgctctatccatgacttcttcctcccccaaaaaggcccgagcaact

SEQ ID NO: 173367 - DNA, 638 bp, Homo sapiens
aattgaaaggctctggcatccagcagagctgggttcatacccagccttgataccaggcatctccgtttctgcctcagcctggctgtggcctttgtctctctgagtctctttggtttctttgagactcgtccagtggaccaccggaccctccaaggccgcgggggaggcctccagtggggctgtccttgaggggcccctcctgggatgcaggctggcaccaagccgctcacagtcacatccccacgcgtgtgccggctctggcacccgctccacgcgtgggctgccacgtggctccgaaagagccaggaaggagacggccaccgtccaacagggaggacaggcagatggagagggtgactcagcacgggggccagatgtggccagatgagaagagtaaacacgaaggccagacctgctgaggccccctcagagctgggcagggatggtgggggccgagcggtgacagacggacgggagatggggctgggggagatggatggcaccagcaggctcagccgagtgaggaaagccagacagatggtctcgttaaagaagccagcccgcgtgagggaacagggctccgcgcaggagtgggggacaaggcaggctcctccttgagaggggctcctccggcctgg

SEQ ID NO: 173368 - DNA, 363 bp, Homo sapiens
tgtactaagtccctgctattttacacagacaatggtcctaaagaagacactctggcactcctctgagaaatgtcaccagtgcctcctacacagaaaagctctcaaatgtggttttcttatggaaaataccacaggagggaaatgaagagttaagagtccttacagactcatatacagaacagcaattctaaaaagtagtgggaaaagcaatcattcaaaattgtgcatctctgtaacttaaaaaaaaaaatcaccattaaacagaacataggcaactttctcttaagtgtccaaaataaattattaatgataactggagataaatactacagatgagggatggtggggtgcgggggcaggagg

SEQ ID NO: 173369 - DNA, 467 bp, Homo sapiens
cgtgtgttcttgtgctggtggttcttgtgctggtcgagctgccgcagtgtgagattaagtgcaagcctatctcgctccagaccacttagtcgtgtggttctttgctggcaggactatggtgaatctccttaagcactctctaatcagacatcctgagtcgtcccaattcttagaccttttatacctgtttttctccttctgttattcatttagtttctcaattcatccaaaaccatatccaggccatcaccaatccttctatacgacaaatgtttcttctaacaaccccacaatatcaccccttaccacaagacctcccttcagcttaatctctcccactctaggttcccacgccgccccaatcccgcttgaagcagccctgagaaacatcgcccattctctctccatatcaccccccaaaaattttcaccgccccaacacttcaacaccattttgttttatttttc

SEQ ID NO: 173370 - DNA, 643 bp, Homo sapiens
atgtgtattcttggttagtgaatcctcactataacccccatgaagttggaccgttcctgtccccatctcacaggaaacaggcacagagaaattagttaacttgcctaaggtcatctgggtagcaagtgacagaacagggatttgaagccagaactttggactctagagcccacgcttttagtgaccaggcagacctgggaagtcttggagtccccaggggacagagcttccaggaacaggggagggcggagcagacctcatctccatccctcatcaattgtgcccatgctggctctcctgccgccagccttgccaaggggtcctgcagccctgacgtcaggatcaaccacaaataagccagagggaaagctgcacagagccccagggcctctgctggccaggcttcccaaacctccctggactgtggctgctggtaagccagactcgacatcccaaccaagcaacccctggggttgcttggttgaaactgcctttgcaaaattatgactgagacggtgaaagagatctaacttaaccaacgctagctatcttgcctctaacctccaagctgtccttgttcattcctgggcataggctgaactaactttgggagacatttagtttatagtttgaaacaaagatg

SEQ ID NO: 173371 - DNA, 780 bp, Homo sapiens
atgtgtattcttggttagtgaatcctcactataacccccatgaagttggaccgttcctgtccccatctcacaggaaacaggcacagagaaattagttaacttgcctaaggtcatctgggtagcaagtgacagaacagggatttgaagccagaactttggactctagagcccacgcttttagtgaccaggcagacctgggaagtcttggagtccccaggggacagagcttccaggaacaggggagggcggagcagacctcatctccatccctcatcaattgtgcccatgctggctctcctgccgccagccttgccaaggggtcctgcagccctgacgtcaggatcaaccacaaataagccagagggaaagctgcacagagccccagggcctctgctggccaggcttcccaaacctccctggactgtggctgctggtaagccagactcgacatcccaaccaagcgcagaccggccctgcacaaagtactccgattttatcatctattcccttttatcctgtctttgttcagcattgatcacagcccacctggtggattttgacatgtctcaacccagggtttgaaaaccagtgatctgtacagaagttctcacagaaagaatgatgtctggaatttgctgtaaaatacttcagtaaaacaacaacaacaaaatgctgtggggcacagggaggcgtcaccatgagagcagcgggatgctgtttactgttgagactgggagataggagagcatgacatactggtgtgtttgtttgaaaagtaat

SEQ ID NO: 173372 - DNA, 414 bp, Homo sapiens
ttaaatgccaccaacaaatatctttttcacagttaagtgggcacctggtctttgagaatcttctctggagacagctctctttggttccacaactcttccatccaccttgtgtggccttgcattcatagctgcatccacctcctccacagtggcatatgtgacaaacccaaagcccctggagcgcttggtgtttggatgtctcaacccagggtttgaaaaccagtgatctgtacagaagttctcacagaaagaatgatgtctggaatttgctgtaaaatacttcagtaaaacaacaacaacaaaatgctgtggggcacagggaggcgtcaccatgagagcagcgggatgctgtttactgttgagactgggagataggagagcatgacatactggtgtgtttgtttgaaaagtaat

SEQ ID NO: 173373 - DNA, 1281 bp, Homo sapiens
attcacaaaattggcatgtgtaaactttattaaactttaagctatttcctaagatgaagatgacaaacttggagggaaacttcattcatttggtttatttttatttttatttttatctggtttgagacagaatctcactgtgtcccccaagttggagtgcggtggtgcgatctcggctcactgaaacctctgcctcctgggttcaagcgattctcctgcttcaccctccgagtagctgggattacaggtgtgcaccaccacacccagctaatttttgtatttttagtagagacggtttcgccacattggccaggttggtgtcaaactcctggcctcaaagtgatccgcccaccttggcctcccaaagtggagcccccgtgccccttgtttgtgacctgtcaatataaatatgctcagtagcggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttgctgttatagtctactaacatagaactttggagtaataagatgggaatttgtctctcttttgccaagacaagtattcgtaatctaacacagtattgttgccacgagtacgagtatgtgatagactgttgagaataaagaaagcaggcacagttggtcagtcctaagataaaggagatgttttttcttatatgtttgtgcattaaagaaaaaaaaatcttgaatctgaccaatgatgttttttttccttgtaagaaaatttaacaaatgtttggcaagcttctggaatctaaatttgaaattatacatttgtcattttctttaaatatttcttcaccttagctttgattatgagaaatcactgtcctctgctgttctttttttttttttcttttgaggcggagtctcactctgtgccaggctggagtgcagtggtgcaatctcggctcactgcaacctccacttcctgggttcaaatgattctcctgccgcagcctcccgagtagctgggactacaggtgcatgccaccacacccagctaatttttgtatttttggtagagacagggtttcaccacgttgtccatggccaggatggtcttgatcttgaccttgtgatccgcccgcctcggcctcccaaagtgctgggattgcaggcatgagccaccgtgcccggcctgtcctctgtggttttctgggcttatg

SEQ ID NO: 173374 - DNA, 705 bp, Homo sapiens
aatgcaggtaaagagaatgtggtcatatgctggcaatattttgaaggtagagtcagaaagatgtgtttgtggactggatgttgggtgtaagaagacaagagagaagtcaaggatgattcaagattttaggcctgagtaattggaaggagggagtcgccacaaactgatttggggaagcagtagatagagcagatttggaagacaacctcagaagctcagtgtgggatatggtgacttggacgagccaattagtcatccagtggatggtggttggatgtccaagtctgaagttcagaggagagggactttagatctaactgtgggaatcactgttgtgtgggtgtacttaaagatctaaggtgttgagatcaccaaaggagtgcatgtagataaagaagctggccaagaactgaaccctggggactttcagtggcgcagggtcagggagatgtgtccaatgttattgactagctgagtaataaaaagactgggacttgattatattcatcattggatgtagcaacttcaagttctttagtgactttgtgaacccctattggagccctacaggattttttaattatactccatagcatttagaaaaatatttatcacagcctaatggctgaagagaacaatagtctcaaaacagaaagactccatttagaacactgttaaaacacagtgacctcaaggactaagttt

SEQ ID NO: 173375 - DNA, 386 bp, Homo sapiens
gaaatagtgagggccctggattttaaaatagcttgtttcagatatttaatttctaaacaactttctgcagtgctttctatcaaagctaacggcacaataaaactttgtgttgatgtcatgaaagctgtatatttatagtatgttggctatggtgaaggagacacagagaatttagatcgacaagacaaggcttggtatgattctgttttgttgcaggcaaagggggaaaaaaaaagaaaaaatgagaaacaccagagaattgtgtctcaggtggttgcaaatttttaaaatccattgtgttctgtctgaaaggtgaccccactgcctgggctggataagggactggccaccattggatcatattataattattattaccactcaga

SEQ ID NO: 173376 - DNA, 158 bp, Homo sapiens
ggaggagggccgggccttctgggtctgggacagttaagttggaggtgccttggagatgccagtcctgattgtctggcagacagctggatcaagggagaggtctgggaggtgccagaatggttgaggctctagagacagggcctgtggagtgagggagg

SEQ ID NO: 173377 - DNA, 406 bp, Homo sapiens
actagtgatccacttccatgccacagcacacagtaaaaatgtgacactgaacaggacaacccttcttgtaaaatcattcctttcttagaataagaacacagagtatcccaagaggaaagtcctgggacaggggattgagaaggaaagcaaaggctttgcgagaagcgcacaggaaaggcaggggggaaatcccatgcagactgacaccgggggcagcgggagcctgtttcggaaggagagaagagacccagatcactgaagtagcttcacaaaaaggaacccttcagaacgaagaccttttaaaaaattcagtcttgtgtttttttgttttttttgttttttttgtttttttttgagatggagttttgttcttgttgtccaggctggagtgcagtggcatgatctc

SEQ ID NO: 173378 - DNA, 259 bp, Homo sapiens
tgtattctttaaaagagtttagttttggcacataattgagttacttagaatcagcctggtcctttcaaaacctgccttgaagcttagggtaggtttagaaaggcctttagtctatagctaatttaaccccactttgaagactctagccaatgtcctttgtatgaaacagtctctccactatgcctaatggaaacataaactattcccagctctgtgtgagctcctggaattgttcagtgttctgatttccagtgtgact

SEQ ID NO: 173379 - DNA, 247 bp, Homo sapiens
tcaggtatggggcaacaataggcacagggtctgcggttttctctaccatcaagcaaagtggcccaagccatcagctgttgagaaaagcgtggcagctgcttttagatcttaagggcgtttctacagctttgagggccctggtattttcccttttctttgctgtctaacccacatcttcatgttacggtttcattcggcaagtgtgacgtgagctcaatgtgaagtccagctcttggcttttgtctag

SEQ ID NO: 173380 - DNA, 411 bp, Homo sapiens
cttaaagtacctaactcctttgtgtgtcatcgcaatttctctgtgatcccgaccctgcctacctctgtagcttcacttttgccactccctgctcacgttttacaccacagcaataatgaatgtttgcatttccccacctataccacacggcttttctctctcttttttttgagacagagtcttgctctgtcgcccaggctggagtgcagtggtgcgatcttggctcaccacagcctctgcctcccggggttcaagtcattctcccgcctcagcctcctgagtagcttagattacaggtgtgcaccaccatgcccagctaacttgtatttttaatagagaccagagtttcaccatgttggccaggctggtcttgaactcctgacctcaagtgatccacctgccttggcctcc

SEQ ID NO: 173381 - DNA, 196 bp, Homo sapiens
tacatttaatcccaacactcaacttctagtactactatctaaacactctctcctaaggccaccagtcaccagacccaagggtctgtccaaaggctcacttgcagttgtcatgctacctaatctctctgtagcatgtagcactgttttctatcatctcctttatgaaattctctcctctatggtgttggagatacca

SEQ ID NO: 173382 - DNA, 508 bp, Homo sapiens
aagaaaggaaggggcttgtgctgggcacttggagtttatttctgattgcatttgctcatctcctgatgagagattttagtctaaaaaccgtctccagagcctcaagctctcttggctcagtggtctgtttccatgcactgagagaggtgtctgcaggagagcatcgtgcttgaccttccacgctctcgtgtccactagcaggcaggttttctgacacaggctgcggaattcaggacagtgcatcatggagaaacatacatcttgggggccattctaaagaacagacatctgggtcctcctcacagcttattctattactggaatggaattggcttcacctttcagtccctgtacccccaaacacctgtgctccctgccatactctagaatcccaactgttaaaatagatgggtaagtcattccctcttttttttcatttcatcctgttcttattgtcaagtgacaattcttattctttttttttttttttttttttttttagaaaagg

SEQ ID NO: 173383 - DNA, 523 bp, Homo sapiens
aaaacaacagaaaacttttcatggctcccaggagcatttatatgactaacaagttatctttccttgctgatagttccactttcctcgtgtttgacagaaatgactcttagtttaggaactcctcattagctgtttccaggagcagtggggtatcattttgatgcttctttatttcttctatgcaactaaaatacaaagtgaagatacgatgtctctgaaatgataaagctacatttgtcaaaaagcacatattttccattcgacattttggcttaaagaaatgaaaactacagaatgactttttcctttatctgggtctgtgctgtgtatttacctatttaaaaagatatacaggtgaaaaatattttttgaaatgaacttgtctgaatcaagatgcacactcttgcagcaacatcacagggtgtctctgtcactgaggactctgtcctcatttgtgtgggctgactgggtcgctggctgtgggaggcacacatttgctatcttggtgcagcagtttgtagtc

SEQ ID NO: 173384 - DNA, 633 bp, Homo sapiens
gtggttttaatagactttatattttagagcaattttaggtttacagcaaaattgagagggtacagagatttcctatatagttgttgtccccacacatgcatagtctccaccattttcaacatctcccaccaaagaggtacatttgcagtaattgatgaacctacactgacacatcattatcactcaaagtccacagtttacattagggttcactcttggtgttgtacattttagggggttggacatatgtacaatgacaggtatttataattatagtatcatacagagtagtttcgctgccctaaaaatcttctgtgctccaattattcctccctcccctcccccacccactgctttttactgtctccatagttttgccttttccagaatacatcccagtgtcatatagttggcatcatttaatatgaagccttttcagactggcttcatttagtagcattcatttaagttcctctgtgacttcttatagcttgataactcataatttgtcatagcttgatttaagcactgaataatgactacatgcaccacaatttatttacccatttacctactgaaagacattttgggttgagttttggcaattatagataaagctgctataaacatcca

SEQ ID NO: 173385 - DNA, 664 bp, Homo sapiens
tcagattatggaaagtcttaaatatcaatgtgatgaaatttttgaacatccggtttccaaatcagtattcaatttttttaaaaggatgtacctggttatagtgtgcagtggaggggatacatccttaaacaaacaggctgcgagtcagtcagcaagatacagtttagtcctcatccttttcagtcttactgctaccatcctagctcagtgcttcatcacttcctttctggattatgttaagtctcctgatcaagttcttaccttcaaatattatcttttctggaatatttggaaacaatgcataaaatagattcatctccaaaaaaagttcctttgcaaataccgttctccttgcttagaaaaatttcagatgttctccatttttgacaaggaaaagctgaattattttttaatatatatccacaattaaacacttgcccaaataataactgtgtttatagcctatatcttttcattcttttttttctgttactctttaatgttctatacattttctttttgacatacattgctatattctggtcaggtttaattacatacaaaattcctaaccctgtgtttgtttttaatgatttttagatcatttaatcattttatcactgaagatttggtgctttcttttttttcttgatttactttattt

SEQ ID NO: 173386 - DNA, 895 bp, Homo sapiens
cctctaggtcacactactgccaccactactgctacaactcattctgcctccactgccaccagcagcctctagcgggtttgatgttcccacctatcccagaacattgagccttcccacttaactccgcagaaaggatgccaggaattttttacaagtgcaatgctagcaaaggctggggaaaatgagacaaaaaacctgatttccaagagcagacaagttttacaaggggcagtcttcttcgctgaagttgactaaaatttagccacgggttggcttgtgctggtgtggttcactgggtacatccacaagactacaagaatatcactgctgtctgcagtcttcccaggggaggaccaccctacccttggcccacaccacggatggcggccccacatccaccctctgatgcagcccagtcccttcccttctgttccgcggcagcaccggtgcctggccacttcccttgccagttcccttcctgtttcaaaaactctcatctcttcacaaaattccctccagggatgctagttcctgttggaaaaggtcttgaggtgtgtcacaggcaaagtacaaatgatatgcccagggccagatggatgacaggcccctaagctcagctagtccagagtcaggaggggacctgcagaattctaatggtgaatgattacactcttacagttttggaattccagcaaaaacaccaatactaaaatcaccaaccaagacaaagacgagacttacggcccacgcaggcttctgcacactctgtgcccagacatggacagattaatgtgggttggttggttggtttttttccaagattactattccacagcaaagtacataggcaacgctgaccaatatgcagaaacataattactatctcaccaagctg

SEQ ID NO: 173387 - DNA, 177 bp, Homo sapiens
atccactggcatacaatcaatgccataaactcctctaccaacagaaatgaccctgtcattcatcatacaggtgctctctctctccctctgataagctcctaaacttcaggtttgtgtcagagacaaagcaatgatcagagctaactgcggggcttggtgaatcaaacactcatccac

SEQ ID NO: 173388 - DNA, 406 bp, Homo sapiens
aactactttcctttctagctctgtggattttcctattccggacatcttatgcaaatggaacatgtaatgtgtggcctttatatcgggctttttgcagaatattcacttagcacaagtttcattcgtgttgtagaatctattaaacacttcattcctcgatattgctgagtaatattctattgtgtggatataccacatttttccattcatccgttgaaggacatgtgggttgtttctactttttgactattacaaataaaatgctgcaatgaacattcatgcacaagcttttatgtgaacatactttcagttgtcttgggtatatatctaggagtagaacttccgggtcatatggtaactctgtttagcatgttgaggagctgccactctgctttttaaatcaact

SEQ ID NO: 173389 - DNA, 506 bp, Homo sapiens
tattctgcttggggctcattaaacttcctgggatttgtgagtttatagtttccatcccatctgaaaaatgttcagctttttttcttcaaatatttttttctgatctccctcttcttgaaagtccaattgtaggtatgataagcaacttgctattgttccacagctgcttactgaagctctgtttttatcttaagcctctatttcttttctctctgtgctttgtgctttattttggataggtttttattatttatttatttatttatttatttatttatttatttattttgagacagatgcagtcttgctttgtcatccagactgtagagcagtggcacgatctcaacttattgcaccctccacctcccgggctcaagtgagtctcctgcctcagcctcttgagtagctgggattataggcatgagccacaacgcctggctaatttttgtatttttttattttttagtagagacagggttttgccatgttggccaagctggtctcga

SEQ ID NO: 173390 - DNA, 399 bp, Homo sapiens
tgcatgtgtcttttttctgatccttgaaaactaagctcattcacttactggggactttgcacttgctgttgagcctagaaacttcttcatggctggttcctccttatgcgggagtcagctcggagcatccatcgctgactaccctatctaaagcagctacagtaaatcctcgcttaacatcgtcagtagtgttcttggaaactgtgattttaagtgagacaatgtactgtataacaaaaccagttttacaaagagttagattcctatggcatacagtacatcatttcacttaacattgcagtttccaagaacctatcaacaatgttaagtgaggacttatactttaaagcaatatgttggttttattgcagcatcttcttcgagtttccatgtagctct

SEQ ID NO: 173391 - DNA, 660 bp, Homo sapiens
gaggcaaccgatttcaaggagtagacaacagaaagagtaagactgaaatgcctgaaagaagggaaatttatgaggtgcagagagagctcaagtccaactagagtaccatagtcttaatgaactggaggaagcaaagattagagcttgggtgaagaggaatctacaaagagagggtacccaagaaaaatctgacttagcgattacccatgagtccacagctaaggccaagttgtgtaacagcagggaaagatcactctatatatcaagctactacagggttaagagcatagaagagataacagagagtcagtagtattaaagggagaataggatcaggccaacaaagtccacaaaagatccacaaggaaaacagagctggaaggctaaaagaaacatattacactttcagagattcacattaacaaaacataaagtcaagcctaaaattaaggtggcaaccagtaaataaactgcctactaaaacaaaaatatccacttttcaatgaaaggtaacagactccagagtctctatatattagccacaaagtccaatattcaatcaaaaatcactaaatatacaaagaaacgtgatccatagaaaaaattttttgaagtcaatagaaaccaaacccaagatgtccagatgtcgttctaagtaga

SEQ ID NO: 173392 - DNA, 277 bp, Homo sapiens
agatattctagcatgacatgctactttcctactgctgcttaacagaaatttgtcatcttactgttctgtaggtcagaagtctggcatggcctaaagttaagatgttgattcctctttggagactgcgagtggaatccatttcctcaccttttccagtgactggaggccacccatattccttgctcatggccccctcctccatctagcaaaggcctgtggaatcctcatattgtatcattctgaactcttctgccccgcatttccacttttaaggacc

SEQ ID NO: 173393 - DNA, 342 bp, Homo sapiens
gccttgtttttcagcacactcctataaattcaagtcatattgtaaatatatacatttggtaacatcttaagaaaagtggggaaaaattataatttgttcataatgggaatatcatagttatcaacacaagtttaaggttatattgattaaaaacaaaacaaaactcaatatttgaagagcaacctaacccaggattgcagaaattgcctccagcagtaggatgccaaggagttctaattaaacagactgaggttgggggattccagggagaaaaaaataaatagaacccctttctcatactatagattttcttttcatatactcttatcaagtattttgaaa

SEQ ID NO: 173394 - DNA, 372 bp, Homo sapiens
taattatttgataaatgagtgcgtggtgaaactgactctagataaatgcccatagcattggactgtaatttctaaaaaagaaataggaacccagttctgtggaaaactggagggaatcaccctcagggagtttgggaaggattcactgaggtggtgacatggcagctgagcctgagctgtcaagttaggaacaaattagaagaggaaattccaggcagagtgtatcagaagtgcacgagttattccaaggatgatgggttattagtttgttttgactggcatttaatgtgcatcaaggtggggtgcgatggaaaatgaggctggagaggggctttgaggtgaggcttgtaccttgtgaacactgatgtttga

SEQ ID NO: 173395 - DNA, 184 bp, Homo sapiens
cagtgggaacctttaacaaaggttccaatttttccacatctccaccaacacttattaaattgtttttttagtaatagccaagtgtcttagtctgttttgtatgtgataacagaataccacagactgagtaacttataatgaacagaaatttatttcttagagttctggaggctgagaagtctaa

SEQ ID NO: 173396 - DNA, 383 bp, Homo sapiens
ccgccggactctagaggagcctcgtatcgctcgcagaagccatttcatatctgtatttctactgctcatctataaaatgaacttggtctagagtccaggcaatccataacatatattctattaaactgttttttctatttctatttaaaagtacctatacacagccacaaggatttatctccttctaaggtttgaaacagctgctgagttccagcttactgaaaataccatctgctctcacacaaatcagctaagactttataaacaagaataaagcactcccaaacccagtcctgaagtcccatcttacatatgtcaaacttattttaatcagcttttttgaaaagaaccctttgaaaaagtgaactacgtttgaaacaaac

SEQ ID NO: 173397 - DNA, 333 bp, Homo sapiens
cctagttttagaagttcaatagcaaccgaaagaagttagcaggagggaggaaggaaaaaggtgctatgaaacttctaaaactaggtgctatgaaacttctaaaactaggcctagttttagaagtttcaatagtcaaaggaagtggcaggaaaaaaataatgggcaaggcaaaaatgatgaaataaaaatccaggaagcaacataaagtattaacaaaaccaaaggttggttctttaaaaatagtacaaaaatagacaagcctctggttatattaagatgacacagagaaagaggggagagggatggaagaaggaaggaaggaaaggaaggaag

SEQ ID NO: 173398 - DNA, 271 bp, Homo sapiens
ctttataataaaggttactcaccagtatgttttcatgatataatggcagaattgaattttagccttcagatttcaaagcaacctacttaaagtttaacaaagtgaaaatacagtaaatccatagaaacataccattatgttaagaagaaaagaaatgaacttccatggactactacaatgagagatggtctcagacttcaaaatgaagcatagtaagtgttagtagaatattgcactgccatttaggacaatagaaggaagtcgattttga

SEQ ID NO: 173399 - DNA, 737 bp, Homo sapiens
ggggcgggtatgcgggcagtaggaaggagaaagaagccatcctgggctctgagaaccgctgggtgcaccaggccatgtcacacacacagcaactcatttaatcctcacgcaactgcctgggtccgtgtgcccaggacccatccatggccacacagctagccggaaacctgatctgctgtagctaaaggccatgtttgctttctcagttcagggccgcctctttgaaatgcctctttggccgtgttaggaagacccaggggtttggggcagcaaggaggcaggaagaaggtctgggggagttatttggacaatgaagagagccaggcgggtcaaccatcctcttggctttgcacttgacagcaaccgcctccctcctgtttctcattttcttttattattaaatgctctaattttcttttattattattgttttttaaacatagagatggggttggccgagcacggtggctcacgcctgtaatcctagcactttgggaggccgaggtgggtggatcacctgaggtcaggagttcaagaccagcctggccaacatcgtgaaaccccgtctctactaaaaatacaaaaaaattagccaggcatggtggcacgcacctgtaatcctagctactgggaagatgagaccggagatcacttgaaccccggagatgggtgttgcgtgagccgagatccaccctaaaaatattattacggggagaagatgggccctaaaaaaaaaa

SEQ ID NO: 173400 - DNA, 349 bp, Homo sapiens
catctgtgcatgaattttagatactcagtgggaacaactagaaaaagggaatggatagagaagaataaatcacatagcagcaggaatagaagattttgctaatttttcagcatatttggaatataaactgaggtgtgatgtggcataaagttaccatgcatagatctggacacaaaaagtgtacagcaagtaaacttgacgagtgtgacatgaaaagttgtatttgatctcatagattaacagtacgttttaatagagtaagattcataattggaatcagaaatgtaataaaaagaatagagaatatgtaaagaacatatttgatgtgcttatgctgagacaggagaat

SEQ ID NO: 173401 - DNA, 471 bp, Homo sapiens
cctcaggtttgggaccgacacatccccagagtctgccttagcaaacacctactccacccacaagtgacccgatcacacccacccacgcatcgacccacgcacccgtccatgtctaccaagggctgactctgctgggcctggggcccatagcagtgcacccaacagtcagaaacatccctgtcctcgcagcactcacattctagaaggaaggaggcagtcaatgtatgagataaatcagaaaaacatctactaagtcgggtgagaaatgctgacatagaaaataacgcagcaatcagaaaggagctgaggggaggagaggctggaattctcaataaagtggtcaaggccgggcacggtggttcacgcctgtaatcccagcactttgggaggccaaggagggaggatcgcttgagcccaggagttcaagatcagcttgggcaacctagtgagaccctgtctctaccccaaaaa

SEQ ID NO: 173402 - DNA, 219 bp, Homo sapiens
gcacagccctgcaggcaggaggggccccaccttactgaggatcaaactgacatgcagagagatggagtcatttatttcagtttatattgtccaaaaaagtcaaagcgaagatttgaacccatttgtcaggatagaaggagcctgcgacctggcaaggcagcaccaggcgatcccggctgtggtccgtggtagttaaggtggggctcctgccgccttctg

SEQ ID NO: 173403 - DNA, 272 bp, Homo sapiens
gagggagctggggggcgcggggtgcatggtgagcccagagtccatagtttaaggtgcagaatttagactagccattatcaggtaaaagtatgtcacaggtggtcaaaaaggtaataacatctaagaagtagacatgctattcaataaccaagttttctgaagacttcatcaggtatcttgaaacccaggaaaaggaggcatgccagccttcagcatggaggaaaacaaagtggcatttgggatgtgctgaaaaggcgtggggacactcaggt

SEQ ID NO: 173404 - DNA, 248 bp, Homo sapiens
aggctcagccaagagttcttagtaaagatccctttactccccaaacgaaaaaaaaatcagcaaaagaaacattaatatttggttcatttcaattttataagccttttgtgaacaaaattgaaagacaaaccacagactcgaagtaggtatttgcaacatataactgaattagtatctagaatatataaagaattttcaacatcaataagaaaaggacaaagaaccaacaacaaaagaaccacactaac

SEQ ID NO: 173405 - DNA, 440 bp, Homo sapiens
ctatgacttacagtactacaactgctagacactgtgctagcatgtaatggagagagaagattcttagagaaaaattagttggagccaaatttaaggcttaaatggaaattaaacccaaatcaaataggtatacataataaaccagtaaactcaattgcctctgcctcccaggttcaagcgattctcctgtcttagcctcttgagtagctgggactacaggcgcccaccaccatgcccggctaatttttgtgtctttaatggggatgaggtttcaccatatccgtcaggctggtattgaactcctgacctcaggtgatccacccaccttggcctcccaaagtactgggattacagggtgagccaccacggctggccaacaaagttcttacagttatgaaaaagtctgattatgatagcctccttgcatagaaattcctcag

SEQ ID NO: 173406 - DNA, 228 bp, Homo sapiens
agagctataggggaggtagaaagcggggtcgccggcagcatgtcaggtacacagacatatagtcaaagaatgggctacagtgtggaaaaataccgaaggagaggcaatgggacacggctgatcatgcgatgcatgaagtatctgtgtcagaagaatattccattttacggctctgtgctggaagaaaatcaaggcgtcatcagaaagactagtgcactaggtttcctt

SEQ ID NO: 173407 - DNA, 336 bp, Homo sapiens
  misc_feature (17)..(17): n is a, c, g, or t
  misc_feature (19)..(19): n is a, c, g, or t
tcgagccggtccggaanantctggtggtgatcatacatacattccttactcagtaaggtagataatagtgtgctctgagacttgagatttacagcagaagcttaaggttcatttgttgttcattcaccaagtatttattaaaggaaggaacccttcaagccagttttaaacaagcagaccttctccagagttgaccctcaatttaccgcagattgttttcgccttctgtccttacatattcctgagtgcatctcatgacctggtttttaatcagctggcctgctgtctgtttctaggtctggtatgctgccatttgcatctcatcaccaccagaat

SEQ ID NO: 173408 - DNA, 316 bp, Homo sapiens
ggaggctccctagcaacagcaaatggagttgtccagggttagggttggagacctggctgttctgtgggaattgcaagctttcttaagaaatctctattttattacagttatccttctttgtgcgattgcagtgggctgaatggaaacacctggtttgtgctgtgttagactgcatgcttgagtgtttgggatttcaagctcgctctctttctctcactattaggacttttctttttcttcttcctcttctctctattttggttctattctttttttttcttttttctttttttttttttttttttttttgtggtgg

SEQ ID NO: 173409 - DNA, 601 bp, Homo sapiens
attcatgctctataaaaggaagaatttgacaaggttttttctctagctcaaaaccttctaacattcaatttttttgctgtgtttattcccaacgtgggtagcaagacaatccacaatcctcaaagcattcagatagacgcaaattttgttcaagaacgtaagggaaagtgtatgtgtcgaggaatgtatccatttcttctagattttctagtttatttgcgtagaggtgtttgtagtattctctgttggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgc

SEQ ID NO: 173410 - DNA, 101 bp, Homo sapiens
ctctgtgcctcctggctgtgcaacctgaagcaagttacttccctctctgttcctcagtttctaggtctacaaaatggacatcggaacagaattaacccccc

SEQ ID NO: 173411 - DNA, 550 bp, Homo sapiens
ggcacggctactgaggagcaagcagcctccaagcctggcagtgccagcctcctctgtgtctggaagaacaaggctgcctcagaacccggagcctcctgttggctgctttattcagaccctcccccactttccagagaagccaacttcttgaggaggaaagagaagcaccaactcctggtgccacatccagggaccccagggctggttgtgcgtgtggcgtacacagagcaagcgtgctctcccttctccttcgctctccagcctgaggcttgtctgccctccagcttgggccaccgccaccctgagcagccttttctgcctccccttcctacctcccctgccttgggtttctaaacccctaaccgtgcactgtcagggcacactggcttccctgtgatgctcccagctaatgtcaacccagatcattaataaatccacctcgtcaggtaatgagacacccgggaggggtgtggaaaggtgtgagttcttcaagccgattgaagtcccctcatcagtgaccacaggaatgggcatgaatggggaatttgag

SEQ ID NO: 173412 - DNA, 571 bp, Homo sapiens
gactttgcattaggactaaatgctgccctgtcatagcagaaagcaacacagggcagagctcagctggtgctcaaggatggagaacttagaacagacctagccagaggtaaatcacccatcccagctgttgaaacctgagttccagcaagccccaccaccaagagctaaagtgccctgaggtcctaaataaacttgaaaggcagtctaggcccacaaggactgcagtttctgggtaagtcctggtgctgtgctgggctcagagccagtggacttggggtggacctagtgagacagccagggcaaccaagggaatgcttacatcacccctctcccaaacccaggcagctcagctcagcttgtagctccaacagagatgccttccctctgttcaaatacaagagtggagagagtaaagaggaccttgtcttgtaactaccagcttagccacagtaggagagggcaccaggcagagtcctgaggcccccatttcaggccctacctcacagacaacactcctaaacaaaccctgggccagaaggaaatctgctgtcttaaaaggaaggacccagtc

SEQ ID NO: 173413 - DNA, 588 bp, Homo sapiens
ggtagggggagtcgcccttgaaaagagagtctatcattttcctgtaggtattcctcggagccagcagctctaagctggcgctgtggccagcggggcccactgcaggcagagcatctcgcttgtttgacctctgtattgggcgtacacagaagagttcactgggagaaaggtttctgctgcttaggaaaattttgaaagccattgccttagagtcatctgttactctctaaatgtagcacagcttcatttgcctcctcataaggcaggtttcttcttcttcacacagctagtatgtgtgtgtcctcatcaacatactctgctctgccagactatttagcactcgattgcatgaagttctgtgcttcatgtgaagcagcctttagattgctaactagattattagctttaatagagacaaagacaataatagagaactttttatttttatggaattacattttttaaaagctcagggcccggcgtgtttctgaaggagctggcataggtgtatgttgtaaattggtattgccttctagaaagcagtcgggtgttaagtatccagagtcattaaaatgtttgtaaccttta

SEQ ID NO: 173414 - DNA, 136 bp, Homo sapiens
acattttaaattttttgtagagatggggtcttgctcggttacccaggctggtcttaaactcctggcctgaagccatcctcccaacttggctcccaacgtgctaggattataggcatgaaccattgcccccagctgg

SEQ ID NO: 173415 - DNA, 431 bp, Homo sapiens
ccctgtagggtttgccgtacctcccaagataggtggaattcttgcctgaccctcagggtgggcttcccatcctaggccccatgttggaagaagatgcttcttgcagagcctctgactgctgggaacggaaacccagacactttgaactgggagcctgcccaataattggctaaactcttgagtgggaaggactataaattcagagtttctagtgtgactctattacataaaatgtgtgaacttggagcaaatatccctttcttctgaaaaaaaaaaaacacttcaatggatgccttgtaaacgcaaagataaaccacttcaacggatgcctcatttttgcaaagataaaccaaagacttaattctttaatggaatctattagagaccacaagctcaagtgttctgcataatgtataaatgtcttctctata

SEQ ID NO: 173416 - DNA, 717 bp, Homo sapiens
  misc_feature (535)..(535): n is a, c, g, or t
tcctgcctgtggctaagggtagcagctgcccatttaaaacctccttttaaactttatttgctgtcagtaaaatctagaacaacagcttggcctagaaagactggagtttgaatcctgagtctttctcctgttagttgaggaaacttctgatagtttttaagctttcctgaggcagagctcatctttgaaatgaggaccacggtacttacctcacagagccattgtgaggattgtcaattaatacttgcaatggactcaggctggtctccaactcctgaccttaggtgatccgcgtcggcctcccaaagttcttggattacaggcgtgagccaccgcacccagccaggcagactgatttcaattcttttggttatacacccagtagagagatggcgggatcacatggtagtcctctttttaatttttttgagaaaacttcatactgttttctataatggctgtactaatttacatttccattagcagtgtgccagggttcccttttccccacatcctcaccaacacttgttttctnttggtcttaataaaagccattctgacaggtaaaaaaacaacaaaaacaaaaaaaaaacccgcgggcctttttgttgggcgggggggaaaggggtttaaagggcccgggtcatgtgttccctgccccgtttttgtcccagggggaaacgggggcccaaggggcggaaacgaacggcgttaagg

SEQ ID NO: 173417 - DNA, 1011 bp, Homo sapiens
gacaaggtctcatgatgttgtcccagctggtcttgacctccagggctcaagcaatcctcccaccttggcctcccaaagtgctaggaatacaggcatgagtcaccatgcccagccatattatacatttttaacttacaatagtccacattcaattgatattaaaccagttcacttgtagtataagaatcttccccagcctggccaatatggtgaaaccctgcctctactaaaaatacaaaaaaaaaaaaattagccaggtgtggtggtgctcgcctgtagtctcagctacttgggaggctgaaacagaagattgcttgaacctggaagcagaggttgcagtgagctgagatcgtgccacgcctaggcaacacgagcaagactccgtctcaaaaaaaaaaaaacattttcccggcggggggcacagggggctccacggctgtgtaattcacatcccacaggcatttggggagaacccacaggggaaggaggcaagataacgagagggccagaggcagagactccggtctcgaacaaattaaacctaaattattcgctcccatctccttccactatataggtcctcgggatatgggccatggtgcctacccttcaaactatctgtataaagcccccagggacattttatacacggcagagaacctcaattattaaagcaagtggagagggtcactcccctggtattccaaacttgggggtttgccacggcaggtcgacctggtcgaggtcaagatttcaagacccgtggcaaattaggaaccgtgtgtttcacaacatacacattgagtggcactcactggaggggggaccgctgaacccagcaatcgggaggtaacaggcactggtgacccggggaaatggcgacaagaaaccaaaccagctagacaagggagatcgtcacaaacaatggcgggcgcatgcccccgcgggggaggggcgacaccacccctcaagcatcaacagggcgcctcagcccagcggcaacccaccaat

SEQ ID NO: 173418 - DNA, 339 bp, Homo sapiens
agagataccgggagcattcaatgggaaaaggacaatctcttcaataaatggggctcagaaaaccatatgcagaaaaataaaaccagaaccctatgtctcaccatatacaaaaattaaataaaaatggactgaagaattaaatacaagacatgaaactatgaaactgctacaagagagctgttgtaacccagttacaacagttcaggatgagcacactagtggttgccatttactttttttacaaaaataaagttctccttaactaacttcaaatggtgagtacagaaaattacatcaatcacactttaagcaccattataggcgagctgacctcctgtc

SEQ ID NO: 173419 - DNA, 511 bp, Homo sapiens
gaaaaaaattaaatttagtcatacatgatggtgtgcacctgtagttccagctactcaggaggctgaggtagaagtcttgcttgattccaggagtttggggctgcagtgaactatgatagcaccactgcactccagcctgggaacaaagcaagagtccacctcttaaaaaaaaaaaaaaaaagagagagatgtgtgtcgatgaggtttaagactgtgaagacaactttctaaggaagaagtgaaggtagtcagtgaaaagaggaaatggctaggactgagactacaggaccttcaacttgtaaagtctggtgaacaaaaatgagccttcaaaggataccaagaagtaatcagggaggtaggagaaaaactgtaagagccttgtcatataagtcaagtgaaaagggtgttttgaaaggaatgagcaacagctaagttgttctagaaggttgaggaagatgagactgaagatgtttattggatcagtgaaacacaggccattggtgactttggc

SEQ ID NO: 173420 - DNA, 443 bp, Homo sapiens
tcataaggaaatggtttacgtgattatagaggctgagaaatctcatatctgcagtcagtacgctggagacccataagaactgatgatatagtttcagtctgagaccaaaggcctgagaagcaggagagacaatggtataagttacagttcaagtccaagtccaaatgcaagagaagaccattgtcctagctcgaagaccatcaggaagagggagcatattctccattactcagcgttttcttctattcaggccttcaacagagtggatgaggctcaccacattggggaggacagtttacttaactctgtctagcaattccagggttattctcctgcagaaacttcctcacagacacacccagaaaaatgtttaaccaactctctggacaccccatggcccagacaagttgacacattaaaattaaccatcacaaatcccaagg

SEQ ID NO: 173421 - DNA, 193 bp, Homo sapiens
ctctatccctttactttgctttatttttcttcatagcacccagaataacatatttttgtttttctatttgttgtcttttccttctctacaatgcaaacactgtattgttttgtttgctcactgtccccaggatctaaatcagtgcttacaacatagtaggcccccaatatttgttagctgactcaatgaatga

SEQ ID NO: 173422 - DNA, 286 bp, Homo sapiens
taccaggacccagctgtatctcctcagcagccagccccaccgaagaagctctgcctgtgaagggtgctgcagcaacatcagcctggcctttgcacatctcaaagtcagcccagtataaaggcaggagcttttaattgaaaggcatttaaagacacagtacataaagccaggcacaatggctcacacctgtaatcttagcactttgggaagccagggcaggaagatctctctgagcccagggattcaagaccagcctgggtaccatggcaagatcttgtctctagaa

SEQ ID NO: 173423 - DNA, 188 bp, Homo sapiens
cccaaggaggctgattagctggaacacagctggctgagctgcaaaccgcagcctccttgagagcatccctccccgcagatgtttattttaaaagcctcctcccaagtgtcggtttttactctccctcttacttaacccctctcagcagccccacaggcctggctgggctggacttcaggaacctctct

SEQ ID NO: 173424 - DNA, 657 bp, Homo sapiens
  misc_feature (321)..(321): n is a, c, g, or t
  misc_feature (491)..(491): n is a, c, g, or t
  misc_feature (570)..(570): n is a, c, g, or t
  misc_feature (582)..(582): n is a, c, g, or t
  misc_feature (639)..(639): n is a, c, g, or t
aggagagaaagataaagggagagagaggttaagagatttttcatctatgaaaattagaggaagaagattaatgttctagagaacgttaagaaatcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactnggagacactagtagtatatgtttgtaatgttactttaaaattatctctttattttataaggcccataaatactggttaaactctgttaaaagtgggccttctatcttggatggtttcactgccatcagccatgctgatatattagaaatggcatccctatctactaactntaatgcttaaaatttacataaaatgctttatttagaaaacctacatgatccagtgggtcagccttgccatgttcagttncacttgaaattngagaccatttaaatttcaactgtttagggtggaaaatgaagttctggaaaacttgcncatgaggatttccttaat

SEQ ID NO: 173425 - DNA, 362 bp, Homo sapiens
cagaccttgggccaagcagcctttgaggtggtaaccagctcataaacaagagctggcatgtgccaacaaagtctctcatcctggctccagagttggctgaggagagaaatttgtggaagcctctgtaagtggaggattgttcttggctttggcttttgtgtggctggatatggagtagggagggagcttggacctggtctctggggtgtaggcatttccctgagaggaggattttttttcctttccttgttttattttttcctccctgtccttcccttagtgttaacatttcaaggtacaggaaatgattggatactgattgttttataactctcttaggacagcctattaatattctgctg

SEQ ID NO: 173426 - DNA, 333 bp, Homo sapiens
gctgactaaggagcccttgggctttgaacaaacatcagcagtaaccaggcagtgggtgccatggccttggggtggtggtggccatggatagagaggctccttctgcttgaggaaaggaaagagaagagtgaaagggacattgcttgcaatgtgggtgccacctcagccacagtaaaatatggcatgaagtaggtttctaaagttcctagtgccaggccatagcttcagcatggcattcctagacctaccctgggccagaagggaacatactgccctaaagggaaggacccaggcctggcaggatgcaccacttgctgactaaagaacccttgg

SEQ ID NO: 173427 - DNA, 638 bp, Homo sapiens
aatagaattgcctattcaagaggaaaaaatatcataatcattaatgattttaagtcaaatattactcaatcacaaaatttaagccattcttttatacctgaattaacaaagagatccaatcattatccctcatttaaaaattaaagaaggcactactccattctaaaatatatttattaattcacaaggtattaattataatataggagtataaattatcatttaaaatgctgtgatgtattatattccatcaattcctaagttttactaattataggtaaaaatctaactaaaaatagatgatttagttagattgcaactgacatatattgcattttcctggtgctaaaaaataaaaacagatatttcaacctatttaattttctttttatttttttttaattacacttcaagttttagggtacctttgttttttccaacagactaagaagtcattacatatgaacctgcaaaatatcatagattttgtcagatcacggatcacaaatatgtcaaagaattgcatcaagtggatatgttcaaattgagcctatcttctatttttctgaaactgattatatccaaaatttttgacattcagtattaacaattagtctcatttttaccattagtttcta

SEQ ID NO: 173428 - DNA, 360 bp, Homo sapiens
aactggatggagaatccactcccaagctcacatttgttgttgtctacaggactcagtcgcctcatcacatgagcctccccacagggctgcctcatgacatggcagctggcttcctctagggtgagcaatccaagagacctcagtgagaaagaggacccaaaataaaagccatggtcttttataattttggaagtgacattccatcccttctgctgcattctatttcttaggagtgagtgaatatatccagtgtacagtcgaggaatgtacaaatacaagaataccaggaggtgggactccctggcggccatctgagaggctgcctcccatattcaaataaataacactgtggcaataata

SEQ ID NO: 173429 - DNA, 577 bp, Homo sapiens
gagagaaggaggctgtgttccgggggagggtatgaggtttcaagacctgctagagagagaggtgcttgggtagatggtctgctatatcctcaggaagagctgcagctccctggagcctgtcaccggggtctgaggccagagttgcctggaccatgatcagaagtgctgctgccagaacaggggaaccattgtaagggaaccctgtaaggggggactcccgccaccctgcaccttcaccacaatggccacctccacacccaaactgccttgtctatcagagctaggctcagtggggagtagctatttttctcccctccctagggaggatccctaatcctatctcttcttccttttttctcctaaagtttctattttgagggtcagtggactcattctttggcactgcagggctttctaaggaggggaggggctacatctcgttgagatgtagcagaggggagaggcttactccccggctctcctgctctccctgcatgtgcctctgggggagtggggaggctattctgggctagggggtggtgtgttagtagagtggaccccttccagtcctctgccc

SEQ ID NO: 173430 - DNA, 614 bp, Homo sapiens
aacattattaacccgaccacccaagtaggttccaaatcccagccatcattacactctttcatctaccaaatctaatcagttaacaaatcctatcaattcttcactttttaaataaaccctttttcattcacactaactagaaccaccctattttcaaacaaagaaattaaggctgctgaaaatagtagaaattaggataaatataaaagactttcttcctatttttaattgctctaaaacactggctagatgaaaccccgtgtctactaaaaatccaaaaaaaaaaaattaaccaggtatgtggtaggcgtctgtaatcccagctacttgggaggctaaaggcgggagaatcacttgaacccaggaggtgaaggttccagtgagctgagatcgcaccactgcactccagcctgggcaacaagagcaaaactccatctcaaaaaataaacaaacaaacaaacaaataaataagccgagcacggtggttcacgcttgtaaatcccagcactctgggaggctgacgtgggcagatcacttgaggtcaggagttcgagaccagcctggccaacacagtgaaaccccgtctttactaaaaacacaaaaattagcccagt

SEQ ID NO: 173431 - DNA, 696 bp, Homo sapiens
ggactgggacgtaacaagagcttaatagctcttgtttgttgaatgaatgaatgaatcatcagagaggaaaacgagggagacagtttgtcaatgttggagttaggaaatactgagaaggtgacatttgagttagattttgaatttcttcaagtagaaaaagcagaaatgaaactccaggcagcaatagtagtgatattttattgttgttgttttgtttcatgagtggaaatttggaaaacaaccaaacgtttataagtccaacttttcttcattcagtattcaaatattacaatttaacttcagggtagaggaggggaaatacataatcttacaatccaaataatttctgttgactaaaagaatggcagtgaaaaccttggcactaatttttaactttataaaatgttattttgtggacatttttgagaaatttcaatacaaaggcagtgttctgatcattcattgtctatgatgattttgcactgtaacaagaagctagaaagatagaaactaaagtttgtaagacagaggttcctcatcactgctgttcatcagggcttctcagggatggttctgcaacaaaatcacctgttatattggttaggatgcttttggctgcaagtaacaggatattcagccaaaactcccttcaaaaatacagatgtactttgctcatacatgaagatgtttgaaggt

SEQ ID NO: 173432 - DNA, 403 bp, Homo sapiens
ggactgggacgtaacaagagcttaatagctcttgtttgttgaatgaatgaatgaatcatcagagaggaaaacgagggagacagtttgtcaatgttggagttaggaaatactgagaaggtgacatttgagttagattttgaatttcttcaagtagaaaaagcagaaatgaaactccaggcagcaatagtagtgatattttattgttgttgttttgtttcatgagtggaaatttggaaaacaaccaaacgtttataagtccaacttttcttcattcagtattcaaatattacaatttaacttcagggtagaggaggggaaatacataatcttacaatccaaataatttctgttgactaaaagaatggcagtgaacctagcgctctaggaggggatcctctgatcg

SEQ ID NO: 173433 - DNA, 184 bp, Homo sapiens
tggagccctcccccccatccccatcgtctcgggttaagtagaaacgcaaattggggtgctggggagaggttccccaaggtttcatacccggtggctcaacctgctttagaagcgattgcgggccgcgtttggaaaatgagagttaggaaagctaaggttgtgtcggagcgcttatttttcctta

SEQ ID NO: 173434 - DNA, 101 bp, Homo sapiens
cggaagtttggactggtgtaaccacagtagttatttacggccagtgtcctttcttctttcttttttgagttaaccaggatacatttattaaatatatccag

SEQ ID NO: 173435 - DNA, 204 bp, Homo sapiens
aaacacaaactgtgaatacgtatgtaaatgctgcaacaatgtcaagtggcattcaagtgtctacactcagtcttgatttctgtacttatcttgtcttagatcatttagcacacaggaactctttacagccataatttgagcaacactagcctagcacaaaaattgagacttctaatactattacttgacttactctatcactgg

SEQ ID NO: 173436 - DNA, 369 bp, Homo sapiens
acattcatagcctcatgagcgcatgtctgtaaatatggggtctcaatagcttcatgcattttcctcactagccagcgagttctctggcatacttaatcaatcctctactattcttggataggaagtactaaattgctgaggttttaacaaataccatgtttcacttaggcagtgtagaaattatcccagtataagtacattactatttttatgtttttgatttttaacttttattattttaaaaataacataatgtgtattcataatggaaacatataaaatgcagataagtaaaaagaaaaatatacctgatcccaccatgtggagataatagcaaccataataaatttgatgtatacctgatttaga

SEQ ID NO: 173437 - DNA, 400 bp, Homo sapiens
ctgggtcccaagcagttggcagagggtgtcttgcagagatgagaacagaggttatgctgtatggaagaatgagaggccatcatctcccccagggtcaagaaagagcctgtctcacctgcagaggcgagagttgatcattatgggcctggaaagttgctagcagaagcagtacaaagctcagaaaggtctaagatcctatgttttctgagcttagctactgtatctagagtttgttctaaacaatctgggactgttcatgaatcttggaagaggacagtgttgaaggtcaaagtgtggaaagacaagatgctatctcacctttatgactgttagattggcatgccttttgcaacaggtaaagtgtgcatgggtgggtacacacacacacacacacacacac

SEQ ID NO: 173438 - DNA, 1101 bp, Homo sapiens
ctggagcggtttcattgcctacattccgcattggaaaatagaagcaggcacaatgaagggaaaaggccgaggcatcagcgtgtgaagaccgcaaagacgatcccgagtacagttgtgaacagcattgctgctaggctcctcctgcagatcatctgaaatgaacctctcttattgatttttattggcctagagccaggagtactgcattcagttgactttcagggtaaaaagataacagtcctggttgttgtcatcataaacatatggaccagtgtgatggtgaaatgagatgaggctccgcaatggaactgtagccactgctttagcatttatcacttccttccttactttgtcttggtatactacatggcaaaatgggaaaggtaaggaaaatgactcggaaaatgtgcatgaaatgtactagggtttttgcttggttaaggtgcctaaatgcttaggtcaaataccctggcaatctgcatgttacatgctatctgctggcagtttctttctgatataaaaatgaaacagtattcttggacagaggacacagaatttctaattccagtggggcttgttttgttttcagtttcttataattgtacttggagaaacagatactgatcagtgttttatattctaaaagacagccaagttgaataataaagactttcgttttggcaaaaaaaaaaaaacaaaaaaaaaacaaaaaaaaaaaacaaagaaaaagaaagcaggggcacaaaaaccaaacggaggacaggacagaaagaaaaagagaagacgacaaaaaaaagtacgaagaggagggacaagcaaaaagcaacagcgcaaagacaaagaaagagaaaacgggcaggaccaccacacacagaagcaggcaagcatggaaacgaagaaacaccgatcggagacaactggcacgaagacacacaacacgacaccgaagagaaagaacaacaaaaccgaagccagacaagaaaaacaaagagcaaagaatcaaaccgaacgacgatagcaccgagagaaacgactatagaccagacaacgaagacgacaagaagcagaacgaaaacgagagaacaaggagaaaaagcggaa

SEQ ID NO: 173439 - DNA, 736 bp, Homo sapiens
agaaacaagagattgaggagatttgctgggttgggtcaggaacataagaggttggggaaaagcaagggagtcactgggctgggtcagcaacatgagaggtcagggagtttgtacagtccagataaaaaagatggaaagtcagagaaatatgctggattggtgttaaaaacaggggaggttttctaggtcaaaactggaaccaggatgtttgctgggtaaataaagtatacacaagagtcgggtttcttcaggaagggttgctgagtcaagtcagaagcataggtcagcgtgaagaccaggggaggtcaagatttttctagtcagcctcaggagcacaagagatcaggggacatttgtcggatcaaggagaggaaccttgaggtcatggcatgctcaggggagttttctacatcacaggtgggaacatgggaggtgacagggagattttctggattgcatatgagcccagtgagctcagaggacagttgctgcataagggttgcaaacctgggaggttgcaggctttgctggatcgggttcgagaattctgaaagtcataggaatttttgccaggttggggtcaggaacacataggacatggcaggatatcactccgcctaggtgatagagtgagacttcatctcaaaaagaaaaaaaaaaagttggggggaaaaaagatattacaagcatcacaaggccaggccctgtactaagtgctgggatcttcccaacccag

SEQ ID NO: 173440 - DNA, 653 bp, Homo sapiens
tcgagcttgccgtgtggaggcactgctctagttgatttacaaaacgaaacaagaagcgtcgaaaacacatcgaatcaacaaaacaccatcgtgaattctcgcaactgccctgtgtgggaggcactgccgctacctccatctgcagaggggtaggggagcctgggagctggtgggcggagggccgggtggggtggaactggcatctgcctccagggctgggctcctcccattgctgatgcctgggtttcactgtgctcgtaaaagccacgggtcaattatgcttattacctgttctgcaggtgagaaaacgaggcacacaggggtgagcaattcgctcagcttgaaagtggtagaaccaggacccagcccaggccatggctcgggacccactctgtaatcactcactgggggccccgcagtaatgagctctttgaagaaaggtgagtcactgaccttggctgtgcctcagtttcttcatttgccaagtggggctctgctgcccctgcctctgccctgctgacttgcaagaagagtgaacgaatggaattggatgaaggcttccggaaacttccatcaggaaagcgccctggcctgggagaaagccggtcctggccggctttgcctgcaatgccctcagtggccagtcacgtccc

SEQ ID NO: 173441 - DNA, 581 bp, Homo sapiens
atcacactgtacagcattgcctgttgtttgtttgaatgagtatgtaaatggtttactacattaatgtaactcttttcattttttgacattaaaaaacattaagaccttccttttctaatgtagattctcacaccgcccctcaatgtttttaacattgtgctgtgtttacgaagtggtgttgctgtaatctcaatgggaataattgttagacaatctaattattctagtgttttttacataataatcaggaaatgaagcatgtatatgctacatctgaaaacctttgtttagttacacttgcctgtgcatagttcatccaggggtatgtgctttaatcttgagttacttagaattcagggcacctgtgccccagcctcccatgtcgcctcacttctccacctggatagtgcagccagccagatctgcttactcacctttctactttattcacctactctaatcctcatctcaggatgattcctaaattatcctcttctccttcagaagctttctcaaaactaccttgtccatgccttctttatcaattaactacaccaaacccaggaatgtgtcttcagtta

SEQ ID NO: 173442 - DNA, 412 bp, Homo sapiens
cctgacactctgtgggtatacaataggcactccataaaagtcccttaagaaggtcccttaaataaatgaatgatgataaaaatggatgcataccaagtgtactgatttttttttaaataatgttccatatgcttttacaatatgaaaaatactttttcacttataatccccttcgatcttcccaatgacccaacaaggtagggaattgtttgcctatggcttatctaaagttactcagaaaaatgatgggatttaacttactctccagagttggagttctcttttatgttgccatgaacattaaatgtgcttaatatatgttcatttagtgcagtggtgctcaactggatgtaattttatccctcagaggacatttagtaatgtctgggcatatttttggttgtcactctag

SEQ ID NO: 173443 - DNA, 122 bp, Homo sapiens
ccctgggggaatgctttttctaagattttattgcaggctcccagtggtacctatagccctttgtggtccggctgccaggtccacggaggaggaattcacctgttccagatgccagcagatcc

SEQ ID NO: 173444 - DNA, 241 bp, Homo sapiens
cagtcgctggaaaagagaggctgcagtgatgtggatagcacactcatctgaccggctctagctcctgctatcgcttcccagttccctcatgagagaacagactcagccgtcacctgcaccaggccgctctccctgacccccaaggctgggtcagctgtcacagctgggtcccctgttttcccccatcactctggttcttgaagcaccttcctattacgtcgcaacctgcgtgagggcagca

SEQ ID NO: 173445 - DNA, 837 bp, Homo sapiens
gagggccacgtgggcagggaggagcagatgtccatgtggctcagcccctgcctgggtaagcgagtccacagttcactaacttacacaataccatccacaaacaagtagccactatgtccacagttagcaaacacacacacacacacacacacacacacacacacacacacactggtccgtggaaaacttgtcttccatgaagccaatccctggtgccaaaaaggttggggactgcggtctaggaaaaagtctgtaccccatagcctttgttctggcctcgcccacctaacaagatttctctcctgttactcccttactgcccagcatttctcaacatttttacctattttctttaagaaacatttagaaagcagaaatgaaacttctcccacactgccacccctccctagtcccatgattcctaatcttagttctactttccatagtttctattacaaaagatgatagattaattttctcctaatataaaattataatattgtatatacattctccaggggattctgatacatacctccttagttgagaatttgctgtggtgacataatcaggagtttgtcatattgaaattcatggattctttgagcatttaccaatcttctgtgattagaacagagaatgaaaagagcaatgggctgtggttctagtccccaaggtacattcccaagaaaaaagaacagtgcagtaaaggctccaggatgtgaaaacaatttatttttacagataaataacattaccagttctcaggtcatgttttgacaatcttcctttgcactgctagatccagatgagcatagcggctgcccatcttgattt

SEQ ID NO: 173446 - DNA, 1180 bp, Homo sapiens
gagggccacgtgggcagggaggagcagatgtccatgtggctcagcccctgcctgggtaagcgagtccacagttcactaacttacacaataccatccacaaacaagtagccactatgtccacagttagcaaacacacacacacacacacacacacacacacacacacacacactggtccgtggaaaacttgtcttccatgaagccaatccctggtgccaaaaaggttggggactgcggtctaggaaaaagtctgtaccccatagcctttgttctggcctcgcccacctaacaagatttctctcctgttactcccttactgcccagcatttctcaacatttttacctattttctttaagaaacatttagaaagcagaaatgaaacttctcccacactgccacccctccctagtcccatgattcctaatcttagttctactttccatagtttctattacaaaagatgatagattaattttctcctaatataaaattataatattgtatatacattctccaggggattctgatacatacctccttagttgagaatttgctgtggtgacataatcaggagtttgtcatattgaaattcatggattctttgagcatttaccaatcttctgtgattagaacagagaatgaaaagagcaatgggctgtggttctagtccccaaggtacattcccaagaaaaaagaacagtgcagtaaaggctccaggatgtgaaaacaatttatttttacagataaataacattaccagttctcaggtcatgttttgacaatcttccttttaaaagttacaaatcagagtttttgcttccagggcagaaagtaatttagtaaagctggctggaactgcttagatccagcatgaagcatagcggtctgaccaatcttgatattatttctttgttttaagttaatcttgtttcttctagaacactaatgttattttccttaatctcttgattactaaaatgtaatttctcctcataagctttgaacttgattttaaagttctttgttcttttgatttttcaattgttctttgaaactgaatgttaaacattctgtgatttttttttaagaattggttaaacacgaccggataagtatgttttaagtaaagagaaatgataaaaataagatttttttgaggggtggagggagggggacagt

SEQ ID NO: 173447 - DNA, 590 bp, Homo sapiens
aagaaaatccatgcctatacacattataattagactgctgaaaattaagacaacaaaaaatcttgaaagcagtcagagaacaatgatgtattacctacagagagtaacaatttgaatgagagcagacttctcataagaaactgcggagaaagtggaatacattactggcgggaaagcaaatggttcagatgctgagaaaaacagttttactatatgacctcacaattccactcctaggtatacacccaaaagaaatgaacataaggactcaattgagtacatgttcacacacgttcacagtagtgctattcagaatagcagaaaggtagaaacagcccaaatacttaccgacagataaatgaacaaactgtggcatatacatacaattattattcagccatagaaaggaatgaagtggctaggtgcagtggctcatgcctgtattcccagcactttgggaagccaaggcgggtggatcacttgaggtcaggggtttgagaccagcttggccaacatggcaaaaccccgtctctactaaaaaaaatatacaaaaattagctgggcatggtggtacgttcctgtaactccag

SEQ ID NO: 173448 - DNA, 856 bp, Homo sapiens
aggacaccgtggtgtttaaggacggccagttaaccagagccccttttcctcaggggacaccgtggtgtttaaggatggccagttaaccagagccccttttcctcaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaataaagactccactggaggaaacaa

SEQ ID NO: 173449 - DNA, 813 bp, Homo sapiens
  misc_feature (31)..(31): n is a, c, g, or t
aaacttaggtctaggtacgaggctgggtgtngctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccatgcgcctgccaggttccgtggggaccccactgcctggagtacaggtgcgcattgtctcagaaaacccacagagggaagcctgctcctacaccatccacgcagagggagacgagagggggaccaagggccccagcccatgctgttgtcctgacatgcctctcctgggattcctgcctctgccctgctggtactaggctgctggccacaccccacatctcaggttcctgaatacaccggcccttcctggctctcaagtctgtgccctgcagtgcccctgcccccaactcgaggacctcccagctcagccagttccaaccctgtctgcagggacggggctcagcctgtgcctgggttggggacaccatctagtcagaaatgtcccgcaagcaacgtgatggtttgggatgaagccctggtggggctttc

SEQ ID NO: 173450 - DNA, 852 bp, Homo sapiens
ggtccggcccgactcacgaccccgcgggacccggccggaacccggcccgaccccggcgcgcgcgcggcggaggacgaggaagagtgtggcgaggcagatcctgccccgtggccgcggccgtctcgtaggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccatgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggtaggacccagccccatgggagtg

SEQ ID NO: 173451 - DNA, 329 bp, Homo sapiens
gaatgcactcttagtttgttctggtttattccagtattctcgaaacacggagggtcccctcaccagcagctccccttccttttcttcaaaccctggggtcaccttggtgtttaaggatggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaataaagactccactggaggaaacaa

SEQ ID NO: 173452 - DNA, 1435 bp, Homo sapiens
gtctatctcaggtagtcgcgtgtctgtctctaggtcgatgcgtatcttctcaggtagtagcgtttcatactcaggtagctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccatgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaataaagactccactggaggaaacaa

SEQ ID NO: 173453 - DNA, 1331 bp, Homo sapiens
  misc_feature (181)..(181): n is a, c, g, or t
gcaggaagctgggggtccgctgctgccgctcacaccagccatctacactggagcagtagaggaaccggcagaggtcccggtcccagagcaggatggaggaacaagggcgccatgatcatctacaccagtgggaccacggggaggcccaagggcgtgctgagcacgcaccaaaacatcaggnctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccatgcgcctgccaggttccgtggggaccccactgcctggagtacaggtgcgcattgtctcagaaaacccacagagggaagcctgctcctacaccatccacgcagagggagacgagagggggaccaagggccccagcccatgctgttgtcctgacatgcctctcctgggattcctgcctctgccctgctggtactaggctgctggccacaccccacatctcaggttcctgaatacaccggcccttcctggctctcaagtctgtgccctgcagtgcccctgcccccaactcgaggacctcccagctcagccagttccaaccctgtctgcagggacggggctcagcctgtgcctgggttggggacaccatctagtcagaaatgtccccagcagagagcagaacgtgagtggcgtgtggaggagtgagacgccccgtggctgtgcagccctctccaggtgtcagtcagctgacactcctgcctctgagcacctgctctgccggaaatggcagaaatgttgccagagaaaggggcggagcgggggtggggagcatttctgtcttaaattaaaacaaaacttaactgcttcacacctgcattggctgccgcgccacctgattgttcctgcttgagtttctttaattatttgtgtctgctggtttcttccctgaagcagtcttgaaatagaagcagcagcctcagc

SEQ ID NO: 173454 - DNA, 571 bp, Homo sapiens
ggtccggcccgactcacgaccccgcgggacccggccggaacccggcccgaccccggcgcgcgcgcggcggaggacgaggaagagtgtggcgaggcagatcctgccccgtggccgcggccgtctcgtaggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggttccgtggggaccccactgcctggagtacaggtgcgcattgtctcagaaaacccacagagggaagcctgctcctacaccatccacgcagagggagacgagagggggaccaaggtaagccactctgctcttg

SEQ ID NO: 173455 - DNA, 1636 bp, Homo sapiens
  misc_feature (181)..(181): n is a, c, g, or t
gcaggaagctgggggtccgctgctgccgctcacaccagccatctacactggagcagtagaggaaccggcagaggtcccggtcccagagcaggatggaggaacaagggcgccatgatcatctacaccagtgggaccacggggaggcccaagggcgtgctgagcacgcaccaaaacatcaggnctgtggtgaccgggctggtccacaagtgggcatggaccaaagacgacgtgatcctccacgtgctcccgctgcaccacgtccatggtgtggtcaacgcgctgctctgtcctctctgggtgggagccacctgtgtgatgatgcctgagttcagccctcagcaggtttgggaaaagttcttaagttctgaaacgccgcggatcaatgtctttatggcagtgcctacaatatacaccaagctgatggagtactacgacaggcattttacccagccgcacgcccaggatttcttgcgtgcagtttgtgaagaaaaaattaggctgatggtctcaggctcagctgccctgcccctcccagtgctggagaagtggaagaacatcacgggccacaccctgctggagcggtatggcatgaccgagatcggcatggctctgtccgggcccctgaccactgccatgcgcctgccaggttccgtggggaccccactgcctggagtacaggtgcgcattgtctcagaaaacccacagagggaagcctgctcctacaccatccacgcagagggagacgagagggggaccaaggtgaccccagggtttgaagaaaaggagggggagctgctggtgaggggaccctccgtgtttcgagaatactggaataaaccagaagaaactaagagtgcattcaccctggatggctggtttaagacaggggacaccgtggtgtttaaggatggccagtactggatccgaggccggacctcagtggacatcatcaagactggaggctacaaggtcagcgccctggaggtggagtggcacctgctggcccaccccagcatcacagatgtggctgtgattggagttccggatatgacatggggccagcgggtcactgctgtggtgaccctccgagaaggacactcactgtcccacagggagctcaaagagtgggccagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaataaagactccactggaggaaacaa

SEQ ID NO: 173456 - DNA, 1024 bp, Homo sapiens
aaagagaaaaaaagaaaaatgcgatttggaaatgtggaggtcgaggttgacagcgacaccgaggtcgaagccagttgcccctggagagcgagagactgggctgggccgactcccacctctgtcgcgagaggcctacgggcaggggcaggtgggcagggggactgtgctgggtctctggccgcgtctggacggcaggcgacactttctccacaaaaagcgtcaagaaaccacgacacttggtttctggacttttccgcggaacagtaaccagaacaatcgccatgaaggttcgtttctgtcatggctcagtgcagcctggacgccctggaccagcccctcctgcgcctgggccacggccgctgccttcagggcatcactggtgggcggcacaaccatcctccctttggggggttaatttcatttctttcctcccttctttaatggtgaatggaggagcaccgagcaccactgcagtctcagtttcagatcccatgcgcctcaggctgtgcttgtctctgcagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaataaagactccactggaggaaacaa

SEQ ID NO: 173457 - DNA, 580 bp, Homo sapiens
acctgtccgtactgctgggcgcctgagttcctcctgctgggcactgtcagggcagtgcgcctcaggctgtgcttgtctctgcagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcagacgtccccttcacaccgagaaccacgggggcccgtccaagacctggcctcccttaaacctgaaccccccaaatcaggtcacgtagaatcaagaactgtttgggatgaaatcaccatgtggggtccccagcctcgggccagttgttgcagctcaaggagaccgtccctggtgtcacctctgcctggtcaccgccgacctcatctgtgcagcgcggtgcagccagcccctggccccacgtgctgaggcacctcccgccccacagtgccctgcagttgccaggctctccagggcaggtcccagaggtttcccacaaaaaacaaataaagactccactggag

SEQ ID NO: 173458 - DNA, 459 bp, Homo sapiens
cacgccgcctttaagaactgtaacactcaccgtgagggtccacagcttcattcttgaagtcagtgagcccaagaacctaccaattccggacacaaaatgatctgtcctgaagaatgtttaaattgataccaacatagcctcaatagcataaaaacactctgtttcatattgtcccaacttaagtctttataaattgtgtgcctactaaaagatatataaccataagccgggtgtggtggctcaaacctgtaattccagcactttgggaggctgaagcaggcagatcacttgagatcaggagtttgagactaccctcaccagtatggtgaaaccccatctctactaaaaatacaaaaattttgctgggtgtagtaacacatgcctgtaatcccagctgctcgggaggctgaaacaagagaatcacttgaatctgggaggtgtaggttgcagtcagctgag

SEQ ID NO: 173459 - DNA, 262 bp, Homo sapiens
cctctagaatgtatattattatggccaccattcttactcttaaatatgcacaaggtatcgctgtagatgtatgttcttcagtgaaagctgaaaatggtctatcccttaaagccttactgtctttcttttctttctttctttttctttctttctttctttcttttttctctttctttctttctctttctttctctctctctctttctttctttctctctctctctctctctctcccctccctcccttccttccttcctttctt

SEQ ID NO: 173460 - DNA, 505 bp, Homo sapiens
cctacaacacacaggacggcctccaacaacaaagaattactcagcaatggtaccaggtttgagaaaccctggtctagctagaaatagcagttgcgaatcacaagcagctcccatttccttattatttggccattcatacacaaagctaaacaggcaacatctcattcagtaatttttccccaattgttagcactggctttaaactgttgtccaacaagcaacaagtcatttacccctaagccacaatgggaaaagttagcaaagacagaattctacttagtgataaggaggccaaacaatttagctgtccttggggaatatatcacttccacactcgctgtttctattctaacaggacattaattacagcattttcttcactggacaatttaacaaaaggatgctccattacaagacatgagagagagaaaggggagctgggatctatgttaagagtatgtctacaattaatacctcactatttaacctctctgactggccctgc

SEQ ID NO: 173461 - DNA, 1109 bp, Homo sapiens
gggtgcacgacagggacgcctgagcaaggacccaagcaggggacacctgccaggatgcccaaccccagaggcagtgggagctgttggggagccgtggtcccagtcagcggtggcttgatgagggctgctcccacttcatccgcaggattccagccgcagctaccccacacccgagctgtccctagtcgcccaccgcggccggacaaagccccagcagccaaggtgctccgtggggagggtttcttgggtttcttgaagccagtatttcccatagtatcttacgtcccagcagaggcctccactgtgcccggaccagcggcccactcagtgagtcgagtgtgcacctggcacccctctttctggaaatccacgaacaatgggctcccagcagaggactgaggctgagcaggccacttccctggagctgaccccacagctgtgtaggtacagggtggccgtgaacacttagggctctctcgggctgtgcgcttcttgttcactgcaaggagcagggtgttggctcctgaccaagccctgtcactgctgcccagccacacgtggggccccttcacccacccctgaccacctcatgcaggtgaagccactgtggaaacagcctggcagtcccttgaaaaatgaagtcataaaccccagcaattgcactcctgggcctctgacagagcttgcacgtcccctccaaagctcgtgttaagctgtgagccccagtgccggaggtggggcctggtgtgtttgggttctgggggtggatccctcatggctgggtgccatgaacccactcaccacagtgagttctcacgaggtctggttgttgagaagtgtgtcatacctcccccacaactctctgtcttttgttccggctctggcaatgtaacaagcctgctcctccttcgccttctgccatgactgtaagctttctgagggctgaccagaagcccagcagatgccagcaccatgcttcctatacagcctgcagaaccgtgagccagctaaacctctcctcataaatcaccgagccccaggtttatctttacagcaatgcaagacctgactaatacagcaccagctccccaaaataaaaagaaatattc

SEQ ID NO: 173462 - DNA, 161 bp, Homo sapiens
gccagcaatccccatcagtcctcaagggttaacttaagtttcattgcaccaaatctagtctcaagaacagtgcacctgtatacatagttctttctacctgaaagtccttgcctcagtcctggtcttcctgatctactcatcctccaaggcctgctcaggtg

SEQ ID NO: 173463 - DNA, 449 bp, Homo sapiens
atctgatttgaagctctatgggaatagctggattagccaacaggtgggctttggagccaagtgtttgtcaatctgaatgtctttgcagtttttccagagaagacttgtctagtctactttggagatgttggcctggcttccaacatttggcagaatgaaactttggagaaggaaaggaacagtggagacccctggctcagattacatgctttcatgtaataccttttttgatttcagtcaaagcctgtagtaactgaggtctgtggtcttcatatcacagagttctctgttctttagggaaggtggtcaaggtgagagacagtagtcctgtatgtgtgaagggttaaggcagagacctggaggtccaatctctctctaaataaacttacaactagtttctaaagtttccagcctcatgtctcactcctgttttttgtggtatacagtct

SEQ ID NO: 173464 - DNA, 695 bp, Homo sapiens
ggctgggtttatagttttgtaacccctataccaaattttgacaccttatagtatttggcagggataagtatggaattgcttgattaataaatgcaaacagaaatttatgctggaaattcttaagatatttctaatattactttatcaataattttaaagctagattagttattaaatattttacttaagttacataaacttgaaaaagcatttgactagtcttttcttttttagtacctgatttaaacacttttatttttttaagccaattaattagagctcttttatatatttttagtggtgaaacattgtgtacacaacacataaatacatagacatattaggcatgctgatagaagtacatcttatagattcataaaaacttttttttccttagactttcagattgttgataacctgtttcacaagactgagcagttgccagctaatttgcatatcaaaggaaacaactcaggtgaaaatcaaatagcgaaatttacattataaggtgcagagagaagaagtttggtgtgttagagggagattaaaacagacttaattgctaattaaagataacattgtagaaatgataaaggcctttgaaatacacacacacatgcacacgcacacacacacagaagattctatagcttttactttagaacttttagccatgagataaatacaaattcact

SEQ ID NO: 173465 - DNA, 340 bp, Homo sapiens
aaatcctagagtcagcaaacccctctgctctgcccccatacctgggtagcagttcctctttgatcccacctctgagtatctgtccaaacctctctcctgtcccacttttcccgccacttcatcactcccctttcttacctggcttctagctcccagctcccagtccatctgactggtccacgccccattcattttcatttacatccctctccctctgccacactccagctccagaacctcccatggctccctactgccagcccagccaggccaagcctgtcccacacccccaacacgctgagttagagcaagagcacagatgtgggaggcagcagcaggg

SEQ ID NO: 173466 - DNA, 399 bp, Homo sapiens
agacccaggcatctgggctcccggctgcaccatctggcccaggcgtacactcctctggttcaatgctgccccagcctgaggcgtagcaggtggtccccagtgctggctcctgggtgggcaggtccatgaccttcacagcatccgtgagctcggcaggctctgacaggcggagcagcatgaggtcgtggctggagtcatcacctggcctgaggaatcgattcttcaggaggctcatatcgtacagcgggtgtgggaagctgtggctgacctgaaatacctggcctgtgtcttcaggatgaaacaggctgtgccgacccagcaagatcacgcttttgctggggagggttgacgcgggcgtgaatttagtagtagtagtcgaccctggaattccggatcggt

SEQ ID NO: 173467 - DNA, 248 bp, Homo sapiens
cagctctgaatgattaattgatttaaacaagcatcatctgattccatgaggaatccttcagtcataacagttttttgtcataacagttttctaattgtgtggcttatatctcattataccaagttaacctagctatataaatatttgaattgtcacaaaataattttctaattttcttagcttcaataaggcattttttcttttttttgagatggactctcgctgttgcccaggctggagtgcaatgg

SEQ ID NO: 173468 - DNA, 254 bp, Homo sapiens
aatgctttctgcttttaagccttttctgcctgatatcaatataactatgccttttaaaaattacgtcttttaaaagttctttcagtttcaacctttccatatctttatttttaaggtatatttcttataaacatatagatggatcttttttttttttttttttttgagacggagtctcgctctgtcgcccaggctggagtgcagtggtgcgatctcgactcactgcaagctccgcctcccaggttcacgccatt

SEQ ID NO: 173469 - DNA, 478 bp, Homo sapiens
agagacaaggtctcactctgtcgcccaggctggagtgccatgacacagtcatggctcactgcagcctctaattcctgggctaaggggatcctcccacctcactctcttaagtagctgggactacaggttcatgccactgtgcctggcttatttttagttgagacggggtttcattttgttgcctaggctggtagttggttattttcttatggctgagtttaagagttctttatatattttggatgcaaattgtttagcagatatgtattttgaaaatattttctcttagtctgtggtttgactcttcattctcttaattatgcccttctcagagcaaatgttttcaattttaataaagtccaactgactaattttttgtcatggatcctacttttgatggtgtatctaaaaattcattgtgacattcaaggtcacctagatttcctcccatgctattttctagaagttttatgtttta

SEQ ID NO: 173470 - DNA, 352 bp, Homo sapiens
cgggattgttgcctagtcggtctggagccagccgcttggcagcagaaatcagtcggtaatcacattgccacagcggctcctgggctgcgtgccaggcagtctgcatgaaaagtctccccagatcctcctccaaattaccttgagaaatctataaacgcggtacaccacagcaacaaaatcatatgatcatctcaatagatgcagaaaaagtaattgacaacattcaacatcattccatgatcaaatctttcaaccaattacatatagaagaaatggaccgcaatacaataaaggtcatatgtgacaagcccgcagctgacatcatacctaatggtgaaaagctgaaagcttt

SEQ ID NO: 173471 - DNA, 566 bp, Homo sapiens
aaaacactaaaaaacattgaaataatatcaagcatcttctctgaccacaaaaaaataaattagaaataaataagaggaattttggaaactatataaatacataaaaattaaacactgtgctcctgaatgaccagtggatcaatgaagaaattaagaaggaaattgagaaacttcttgaaacaaatgataatggaaacaaaacataccaaaacctatgtgatacaggaaaggcagtactaagagggaagtttataggtgcctacattgaaaaagaggaaaaacttcaaataaacaatataatgatgcatcttaaagagctatgaaagcaagagcaaaccaaaccctaaattggtagaagaaaaggagtaataaagatcagagcagaaataaatgaaacaaaaaattcaaaatacaaacaaaacaaaaagttgtttttttgaaaagtcaaacaatattaacaaaactttagtgaggctaagtaaaaagagacaagatccaaataaataaaatcagaaatgattacaacagatactgcagaaattcaaaggatcattagctgctatcat

SEQ ID NO: 173472 - DNA, 648 bp, Homo sapiens
tctaatcccaactactcgggagactgaggcaggagaatggcttgaacccagttggtgaaggttgcagtgtgctgagatcacaccattgcactttattctacttgggtgacagagcgaaactctgtctcaaaaaaaaaaattctatttaaaatagtggccttggccaggcatgtggtggctcacgcctgtaatctcaacactttgggaggctgaggcaggaggattgcttgagcccgggagttcaagaccagcctgggcaacatggggaaaccccgtctctacaaaaaaatgccagagttagccaggcgtggtggcatgtgccttgagagaatgggttagagagctagaacaggtcagagacctttttgtcctatgtgaaaatgtacaatatacaagagttactccctgaaaactacccgcatctcccactccctaaaagtcatttttgaccttacagggggctcatattaaaataattaggtcaggcgaggtggcttatgcctgtaatctcagcacttcgggaggccgaggcgggcagatcacgagttcaggagttcaacaccagcctggccaaatagtacaacaccgtgtctaccgaaaatacaaaaatcagccggtcatggtggtgggcacctgtagtcccagcta

SEQ ID NO: 173473 - DNA, 657 bp, Homo sapiens
gagtaacttgagtgagaacaatgaatgaataaggggtcttgctgagaatgagatttgaatttgagtttttggagctggagtagggtagactcactactccagcttaaaatgtaggtgaaattagtggaggtgaaggtcactgcagataggagactggagttagagtcaaaatggccaaggctccactcagcttccatagaacagcatatggagtctgtggatcgctcttgagaaaatatttgcaccccagggtttctaatgacatgacgttgggggacattttccagcagtcaattttcagagtattcaaatgaagttaacttgttccatctcagacctgtgtgctccctcactcctctttactctggtcatgcttgtcagatctccttctgggacagcagagtgtgaggaacacaggacagataacagactggattcaggaatcttcacttgaaggtaatcctgacacctgctaccacatggatgaaacttaaggacattatgctaagtgaaataagccagtccaaaaaaaaaaaaagacaaatactgtatgattccactcaaatgatgtacttaaagtagtcaaatcatagagacagaaagtagaatggtgcttgtcaggagctggaggggggaatgaggagttattacttagtg

SEQ ID NO: 173474 - DNA, 336 bp, Homo sapiens
ccaaggattattgtgaataaaattatgtcactggcatggaacacagatgcttggtttcatgctacagtggggctaggtctccagttaattcaaaggctatataaggataatttgatataagttaaaaagaaaagggagcaacaacacaatctattatataagttttattttataattcctgtatctacaattaagtatatagaagttgttatgggtaaaagatttgaagaagaattacctagggagcatgccaaaccatacaggttgaccaagagagtttctatctgcagaatctaaggctggtgaaagatcagtaaatgtgaagaaatgtattct

SEQ ID NO: 173475 - DNA, 134 bp, Homo sapiens
aaaaaaaagacctattgtaaagctatagtaatcaagatcatgtggtattggttaaggaatagatgaataggtcaatggaatagaatagagagctcagaattgactcacataaatagtcaattgatctttgacca

SEQ ID NO: 173476 - DNA, 522 bp, Homo sapiens
aaaaaaaaaaaatatatttccttttgaaacactaagttttgggtttatttgttggttttaccctaacatcacagttagtgtgtattctctgggcacagacaagctgcgaggttcagggacgcagcctgggggagagctgagagaggaggctgaggatgtagccatgtttatagaactcttttcaggcatgggtcttggcagacagatgggcaggtccaaggtttatgggcattgactgcaagctggttgctgtagaagagctccagggtggtacatgacctcagaggaaaaagggaggagtcaagaacactgaaaatgctgcggccgtttgcaatccacaatagcaaggaaacaagatatttacaaatgagataaggatggttaagcactcagatgtcttcagaaggagaattaacatatgtgtagtttcttacactttacaaagggcgttcacaggcattatcttaattagcagttcaaatagaaagttaaaaagtgggagtctaaacttagggcactctg

SEQ ID NO: 173477 - DNA, 497 bp, Homo sapiens
aaaaaaaaaaaatatatttccttttgaaacactaagttttgggtttatttgttggttttaccctaacatcacagttagtgtgtattctctgggcacagacaagctgcgaggttcagggacgcagcctgggggagagctgagagaggaggctgaggatgtagccatgtttatagaactcttttcaggcatgggtcttggcagacagatgggcaggtccaaggtttatgggcattgactgcaagctggttgctgtagaagagctccagggtggtacatgacctcagaggaaaaagggaggagtcaagaacactgaaaatgctgcggccgtttgcaatccacaatagcaaggaaacaagatatttacaaatgagataaggatagagggattaaggatagagagattaaggatagagagataaggatagagagattaaggatagagagattaaggatagagaggttaaggatagagagattaaggatagagagattaagaa

SEQ ID NO: 173478 - DNA, 132 bp, Homo sapiens
gggtcatgtttaagccattgtcagttgctattataattacagtgattgttatctagtgaaagctttgctggcagaattccaccagaaggctaaaacttgcatccaagttttcattaagctattggggtttgt

SEQ ID NO: 173479 - DNA, 796 bp, Homo sapiens
tccgggcttctgggtcaccgccttcctgaaccacccgcagctctcagccatgatcagccctcgagatgaagacatgctctgctacctgatgaatttggaggtgagggagctcaggcactctaggacaggttgcaaattcaagttccgcttttggagcaacccctacttccagaacaaggtgatagtgaaggagtatgaatgcagagcctcaggccgagtggtgtctattgcgactcgcatccgatggcactggggccaggaacccccggccctcgtacacaggaaccgggacactgtccgaagcttcttcagctggttttcacagcacagcctcccagaggccgacagggttgcccagattattaaagatgacctgtggcccaaccccctgcagtactacctgctgggggataggccctgcagagccaggggaggcctcgcaaggtggcccacggagaccccttctaggccctacgggttccagtctggctaagtgctgccttgggatgtgcggcctacataagcttcctcatgcctcctacgggtggcggatctgggctcaggcccatggtgggcgctctgttgtctgctgtctgctgtctgctgtctgctgtctgttctgtgcactcccgctctgcgtggttcggtggactcagctctcaaattgtggccctcgtggccagtctctactgtttccatatggcctcttgctgttctgtgttaacatcacgtggctgtcacatgccgctgcgtctacactaagcacccagtgctgtggatgtgcactgccataatc

SEQ ID NO: 173480 - DNA, 618 bp, Homo sapiens
gcttgagtgacaacttgaggacaagcggcgcctcgacaagatttcacacagcagctacgggggccagagaagaagcaccgcatggtgtggcaagagaaggaggacatgcacaagcaattggttgaagcttcagagacattgaaatcccaagccaaagaactgaaagatgcccatcagcagcaaaagctggccctgcaggagttcttggagctcaatgagctcatggcagagctctactcccagaagcagaaggtgtgggacaaggaggaggagatggaagtagccatgcagaaagctgacatgatgtggcaggagatctgaagatccaagaagctcagaaagaggatgctgtttagccagatgtggtggctcacgcctgtaatcccagcactttgggaggtcgaggcgggtggatggcctgaggtcaggagtttgagaccagcctggccaacatggtgaaaccccgtctctattaaaaatgcaaaaactaaccaggcatggtattgggtgcctgtaatcctagctacttgggaggctgaagcaggagaattgcttgaacctgggaggcggaggttgcagtgagccaagatcatgccactgcactccagcctgggcatc

SEQ ID NO: 173481 - DNA, 639 bp, Homo sapiens
aattatcgattgtcagggcaaagggtaaatgagggcaactgcaggtggaagaaagtcacccataagggctttctgggtctgcagcgtttgtagtaggtgctacttctattcttgcagtgctgggagacgggcgggggaagatgcagtccctgctgacaattgggtcatctgcgcgcagagaaggccccgggatgtgcgaggacatgggactgggagtccggaggcagtctggtttgagctgtcactaattggccatgtgacctccctcagccggcttcgtcctctctgaagcaaaaggctggaattggggtggctggagcatttttattttatgcttttgtatttgaatgctgttgggtttgggcctcaccgtttctggttgtctacacctgcctttttcaccgttgcaggtgacgttgcctgcctcccctgaaggtgtttgaacctggtgagatgtataaagggcccttttcagctcaaaaaatcagaattctgtgctgggttatggttggctctatcagggtcacttatgaacgtattactactgttctcttttcattcatccccaatttaatggcttttgggcaccagtgggtgtgcccagtgtaagctctcatggcacacctgctagttaaaggg

SEQ ID NO: 173482 - DNA, 357 bp, Homo sapiens
aatgcctatcttgaaatggtatctctgctatttgcttagtatttatttactttttagagtaaaagcaatacatacacttaaaagaaattaaggcattcaaaacatatagagtgagagaagcatcttttcaccctggaccccagccagtcagatctcctccccagatacaatgtcaccatcagtttctcgtgcccccttccacggatacactatgtgattgcaagcatctatgtaggtttaacttaactgatgaactccggatctacaaaggtgactgagagggcagtgatcagctctcctacaacttgcctttagggaactgaccatctggaagaggagccgatgagcaacaaaaca

SEQ ID NO: 173483 - DNA, 772 bp, Homo sapiens
ccaacattttagggtttgagaggccaggactttggtgtcaggcaagtggagtttggatcctggctcaggcaagtgctggccgggcaaacagctttacctctccctgcttctgctggacaaactttacaatggggatgaattgtgggggcactcactggaggagcatgcccgtgtgcaagaggatgcacgtgcccctgcccacagacctagagcctttttctttttaagacagggtctcactctgttgctcaggctagagtgcagtggcacaatcatggctcactgtatccttgacctccccaggctcaggtgatcctcacacctcagccttccaagtagctgggactataggctcacaccactacgcctggccaatttttttatttgttgtacagatgggttttccccatgttgcccaagctggtctcgaactcccgggtcatgcctgtaatcccagcacttcgggaggccgaagcgggtggatcacctgaggtcaggagttcgagaccagcctggccaacatgatgaaacctcgtctctactaaaaatacaaaaaaatagctgggcgtggtggcgggcacctgtaatcccagctacttgggaggctgaggcaggagaattgtttgaacccaggaggcggaggttgcagtgagccgagatccaccctgggtaataagagtaaaactccatctcaaaaaaaaagaaagaactctggacaagacaagcaggaggcttgccagctgctggctggggcatcgctgccttccctgcc

SEQ ID NO: 173484 - DNA, 437 bp, Homo sapiens
aacactgcctgtctgtatgatctttaatcacaagttaatttttaaaagcttcattagtgtgctgtttttctaagctgaaattagttttttcgacttggacatatcagcttagctgcatttgccttattttcttattatcataacctatggctggtggtgtcaatttgatgagaggctgtgctaataacacccaagttgtgggtttcattctcgccacagggagggcagttcgtctcaatggaacaggcagacctatcttgtccagtcttgcaaacgtgtatgagggtctgggtgtaagggtgaatgtttgctggacctgggtgttaaagctttgtagtccccatcagtataaagctgtttctgctcctgctgacctggctcagtgcaagtcctgtaacgatgggtaggctgctggctctgctccttcatgaaggacg

SEQ ID NO: 173485 - DNA, 201 bp, Homo sapiens
atcaacttagtcattaaccagctgtggacttagatgggttatttcatctttctaaaacttaattttgtcttatttaaataaaggtagtaatgttacctacctcatagatttattttaaagattaaatggtataataaatgtatctttgtaaattaaaagtagcttttaatatatgtaattaataggcgaaagaaagcagga

SEQ ID NO: 173486 - DNA, 426 bp, Homo sapiens
tgcagcagagcaggacgttcgctttcccttctccgcctgtgtgttcttcctgcactgcctaactgctgcttgctcatttgtgcttccgtgtcacccctcctcagccctctgaactctgcacgtcaggacttggcacacttcctaactgctgcttactcatttgtacttccgcgtcacccctcctcagccctctgaactctgcgcttggacttggtgtgacttcccttccccgcctattctctagaggcagtctcttggtgactcctggtttgggtcagggcacgccttaggtctctggatggctaccaaccccaggttccctcagctctagccccataagagaggaggcctcaggagcgcctagggcagccctttcagcctgggctgtgggaagggaaggtggacagagaggagaccccatgccta

SEQ ID NO: 173487 - DNA, 404 bp, Homo sapiens
atatatttaggcatcttcaatttttaaaatgacatttaaaactctgaaactgtctgagatcactaagggagagtgtagatactgaaaagaagaaatccgaagactgagaattagtctgattttcattttctggcttttcagaatgcagcagtaggctctctagaaacagatggaggggaaaatcttccttctccccctccatcagaatgaagacaaattgtgccactatacataagcctgtggagggcttctcttaaatagctatgatggtataatctgtttataaactaagtatcatagtctaacttaatggagcaatccgaatacgtaaatgtaagtaagaatccaacataaaaatttctatgtgtatatatgatttattaaacattttgtcaatagtattt

SEQ ID NO: 173488 - DNA, 480 bp, Homo sapiens
ctacacccaatgcattagatatcagttgaattcgtctctattaaatatcataacttaagcttgtcgtgttccactttcttgcatcatgtcgtgactgatatacccctcgcttattaaaccaaacctaattccagagcctcaactttgaagaaagggagaacatctatttcttaaactccacttaatactgtaaaaattataactccatagcatctattaatcccattacaatgcaggtactgagagcacaaaagaacattaaataatccacataaattatattatgctatttttggtttttaaaaataaactattacttgaatgacaagtatcaagtatacagatatttcaaatttacaaacacattttatgactcaaaaatcatcaaaaagagacatttaatctttttttttttctttctttttttgagacagggtcttgctctgtctcccaggctggactgtagcggcataatctcag

SEQ ID NO: 173489 - DNA, 1335 bp, Homo sapiens
ataagcaggattcaaggctagtgtagaccctttttttcctaagagtaaggacacggaatatcaaagtaacaaagggtgctgccattttagtttcaatttaatatcaggatattctttgttttagaaatgtagattttgacttttacagtttgaaaaagggtacctcagcctcttcagtactggttttttggcacatttcaacagaaatattagattccctttctttttcttaatagtgatcttctaacaagtttcttggaaaaactatcattctaagggaaatccctgtttataacctattaatatatttctattcctagaagagagtctagcagggattctagtaggaattactgagtgttttggaaggcacttgatagaggcatctctgctttccagcacagggattctcagccttctaaagatctagaccagtttccaagctagcttctccacagcccaccactgcctagtgtttgcttgtgtattctctaatggattttaggaggataggccttctgacagagtcatgaaagactgaaggcatgtctagggaaataaaacctgacttgcccttcagcaggaatgactggcagcggatctctgtgttcaaggaaagggtgagcgctaagcatgccagtgatggatccgaagtatttagatggattgcagaccaggaattagagaccgtttgtgactcaaggaacttgatggatctgtttagagccctacatgaatttgccaagggcagtgatttttatgaaattcaagaagcaaacgacttcgatacagctagaatatgttgcagtcttcctatttcaaacttgattttaatatttttaccaagaagtttaactgacaactctgcaaaattttcattcagtatcattaaacctgagttaaatgtttgcttagcttatcctcttagatgttcttctgttgaacaggcaggttgcccttaacagtaacttgctacttaaattaccttttattagttagtcaagctgcaaaaatatcattagtgtggcgtctttattttggctttatccatatgaagtattcattattttcattctttttgagaattcataaatgtcttaaagcttcagtaagaattgttgggaggtttgacatcaagtaacgccttcctgtgtagcagtataaccctaatttagaactcttgttttcctatttcagtcctcatatttgatcatagaaaagcacttttgtgattctataggagtcaaaaaatcagccaagagtaggtaagtcagtcagcacagaaatcagaaagtgagaattttctccaaaaaatctttttaaaaaagtcctgct

SEQ ID NO: 173490 - DNA, 248 bp, Homo sapiens
atcttaaagataatttaggagtgggtaaggggaaatgagctcttcctagatgtcagggaaagcatcatgagcctagtcatgggtgtttgaatgaatatgatatacctagggaacagttttaaaaactgtctggattagagtggcagctggagaagactgagaaataaggttgtgtaagtgaatatataatgtttatgatacatgaaaaatatgtatttttttcagcagtgaatggtacatatgctggt

SEQ ID NO: 173491 - DNA, 452 bp, Homo sapiens
gtccttacaaagggtgagtttgtccctctcttgcctctaggccctttcaccttgtgctgtgtgattatgcagaagggaagccttgccagattctggctctttgaccttgggctttccagcctccaggactgtaagaatatacatttccattctttgtatattacgcagtttcaggtattgtgttatagcatcacaaaacagactaagacaacactgataatggatttacagcccaccctaaatccaagctgatctcaatacccttcagttaatttcttctgcagaaaatcctttttccaaataagatcacattcttcatattcaggttcagcactagctatgatggaatagcgtgaaactaactagggtgcctatcagaactactacacaaaccctggtttaactaggttatgagatgcaaaggggcagctcacattctgtaggtacttttt

SEQ ID NO: 173492 - DNA, 266 bp, Homo sapiens
ttagaaatcactaaaagccatctagtgccagtttatctgttgtacataatgttttaaatcaggctatttaaaatcattttggggcagaagtatttatcttttttatcttctcattgactcgtaacactattcagtgaatttgggcagaagtagagagtcatgttttaactttgagatgcagttttttacatggctcttaagttaaactgagtacatttccaaaagagtttttctgaaaaatactttagtagcaaaattagtagaat

SEQ ID NO: 173493 - DNA, 381 bp, Homo sapiens
gaggtgccccgaaagcttatagtgtatatcttctatactactttgtatcttatattacctttcccatcagaaaaatcctcacccagtttctttctttctccccattttagaggaaacacttatgtgtactatttttcacttcatcttgaaaacaacactgccattacttttatcactttttttcattactttctcagacaaactccttaaaccaagagtcttattttccctacttaagtcagattttaaagattttaaaatactctgcaaaattctaaattatgatgcaattcaattaatgtgatgttttagaatacagagctattacatgtttaagctcattgtctgttttccttaatttttggcttccactgtttttta

SEQ ID NO: 173494 - DNA, 258 bp, Homo sapiens
ctgccacgccgcactccagctgaaaagcactttcagatccattatgccattacctcatcatagcaagtcagggaaactctgttctctctaggggggcagtgacaaatgcctgtgtgcagatggcatcattcataatcctagtggtatccagcacagcccaccgctgcagtcaagcgaacagagaggcataaatgtttgaagtgaacacagatgaatgtagagatacagccacatccatcacttgcactttccctactt

SEQ ID NO: 173495 - DNA, 366 bp, Homo sapiens
ttacatttgtaaatggttgaaaacaaatattggtgacacacaaccattctatgaaatttgcattttacagtctgcaaataaggttttgtggcaggacagctcgcctgttcatttatgtatcaccttcggtggttcccaagctacatctttgcttttggttttgttctgagacagaatctcgctctgtcgcccacgccagagtgcagtggcgtgatgtcggctcactggagactccgcctcccaggttcaagcgattctcacgcctcagcctcccgagtggctgggattacaggtacctgccaccatgcctggctaattttttttagtagagacggggtttcactatctttcccaagcagatcgcaa

SEQ ID NO: 173496 - DNA, 604 bp, Homo sapiens
cttccatggggtcgagagattactgggatcaagtcccctgagcagtgcccaccgatgacagcttatcaaagggaaaaagtacaacaataaacacatgcagtggccctctctggtgtgtttacacccatgagtatctatgtagagacagacacgctgcagagaaatcactctccatgactgttcgtatacagggaagagagctgttcacagagagagaagggagggctgtatatgtggtgtgtcaacaggggaataaaagggaagaaaaaaaaaaaaacagaaagaaaaacaaccagagtaagaaaaatgcatgaaaaataaataaaaagaaacaaattaataatgaagaatccacggtggactctcttcaatttaatttattcattctttgaaagtacaagagggtctggagaagaaagggaaggtaaggcatatgggcaagcaggctctgtctgatgagctcccagttgggctggcagataccaggataatatataccactgactcagacacccacactcacacaaaaccctcattccaaaggcgcagaggctttctattgatttgaatgcagatttaacctgcttactcttaacctccccca

SEQ ID NO: 173497 - DNA, 525 bp, Homo sapiens
accgctttcccatgcactcatttgcatgcatgtgcatgttcgtgtgtgtgtaagttctatgtagttttcacatgtagatttgtggaaccaccactactatcaagagctgttccatctcctcagtgatccctcatgctacccctttatatcacatccattttccttgcttatccccattctcccatccctaaaccctggcaaccactaatctgttctccatctttgtaattttgtcattttgggaatgttatattactggaattacaccatatgtaacctcgagattggctttttgttttcactcagcataattcccttgaaattcatccaaatggttgtatgtattaatagtttttttctttatgttgctgggtaatatgccatggtacatccgtggtaccatggtatactacatgtatactacacaccatggtaatggtgtctttagctattaactcattgaagggcatttggaatgtttcaaatttttggctgttacaaataaagctgctatgaacattaaaa

SEQ ID NO: 173498 - DNA, 969 bp, Homo sapiens
ttcttactggatgaattcaagctatacaggaatatttcatatatccacaagggagaaggtaaaagatggaacatgaggaggggtctgtttcaaatcagacctattcttcagaagctttcatcactgctacacaaagaaaggaggttgctgcttcaaggattctggagccaccaaaatccccaaacaggacctacagaaaaagccttcacagagactactgaggataaaccaaataatatggctaatagaagatacaccacaaaatccagtcattgtaacataaactgaacttccttatatatcttttcctaggcttagccaaaagcaggagaactgcaactctatgtggtattgtctgatagactggattttttccccaagcaagaggtggacagctttatgccaggactagatttacagtcaatctgggtgtgtgtctttactttttctttccctccaaactacctcagaaaatgtctggctattgtgccttgatatgtaataatgcagggctttaagtactgcaaaggtctggaaaagaaagtccctcagtcccagttatggctcaaatcttacgatttctctagcagttgttttaatcaaccaaagctggttggcttttctcaatgagccaagcaacatgagccttctaagttaagcgcagaggggctgcttgtcagcatgactcccaatggggtggctaacatggaatatgctccagagtctagaaatcaggacagcacagctgctgttttcctccacatgcacctccagcttggtgggtgggggaggaaaggaagaagaatcagtaaattgaaacaggaggaatgctttacatgcaacacacaagactcactgcttaaaggtgagatgaattcagaggtctcaacacatgattaggataccttcactgacacaatggtccccaaaattcaacctggaggtccagccttgcccgtctggcaaaaa

SEQ ID NO: 173499 - DNA, 300 bp, Homo sapiens
ttcttactggatgaattcaagctatacaggaatatttcatatatccacaagggagaaggtaaaagatggaacatgaggaggggtctgtttcaaatcagacctattcttcagaagctttcatcactgctacacaaagaaaggaggttgctgcttcaaggattctggagccaccaaaatccccaaacaggacctacagaaaaagccttcacagagactactgaggataaaccaaataatatggctaatagaagatacaccatcccatgtgtctgtgtagaaaatgaccgggtcctctagatc

SEQ ID NO: 173500 - DNA, 846 bp, Homo sapiens
gacaccagtgcagcgggggggggcccggaggccctgggatggggaactgcggtggcttccgcggaggtttcggcagtggcatccggggccggggtcgcagccgtagacggggccggggccgaggccgcggagctcgcggaggcaaggccgaggataaggagtggatgcccgtcaccaagctgggctgcttggtgaaggacatgaagatcaagtccctggaggagatctatctcttctccctgcccattaaggaatcagagatcattgactttttcctgggggcctctctcaaggatgaggttttgaagattatgccagtgcagacgcagacccgtgctggccagcgcaccaggttcaaggcgtttgttgctatcggggactacaatggccacgtcggtctgggtgttaagtgctccaaggaggtggccaccgccatccatggggccatcatcctggccaagctctccattgtccccgtgcgcagaggctactgggggaacaagattggcaagccccacaccgtcccttgcaaggtgacaggccgctgcggctctgcactggtgcacctcatccctgtacccaggggcactggcattgtctccgcacctgtgcccaagaagctgctcatgatggctggtatcgatgactgctgcacctcagcctggggctgcactgccaccctgggcaacttcgccaaggccacctttgatgccatttctaagacctacagctacctgacccccgacctctggaaggagactgtatttaccaagtctcccgatcaggaattcactgaccacctcatcaaggcccacgccagagtctccgtgcagcggacccaggctc

SEQ ID NO: 173501 - DNA, 317 bp, Homo sapiens
gtctctgatgttgtttctatgaatgcaaagtctaaagctcaacagattctcctgttacaaatgctgcctacctccaggtagattccatctctgccaagtctatttattatgaagcggagtgtgggtatgggcagtagaataaatgccaaaataatgtattttgtatactactttaaagtggcttgtctggctggatgatccactttaatactgcttgtctggctggatgatccactttaatactgcttgtctggctggaagaggtagcctgcacacatctggttgcatccttggagtattaaagtggatcatccagc

SEQ ID NO: 173502 - DNA, 157 bp, Homo sapiens
tcactgcaacctccgcttcctgggttcaagtgattctcctgcctcagcttcccaagtagctggactacaggtgtgtgccaccacgcccggcagcaatatgaatctttaaggaatgggcaaaggaaaagatggagtagtggagaggtagaaggaaaac

SEQ ID NO: 173503 - DNA, 363 bp, Homo sapiens
gcgcccaccaccacacttggttaatttttgtatttttagtagagacagggtttcaccctgttggccaggctggtctctaactccagacctcaagtgatcctcctgcctcggcctcccaaagtgctgcaattataggcatgaaccagcgcccaacctaaaactatcttttcaatttatctgttctgaataatgcctcatcaatgactactcatggttgagttagatcacaaatcatttgaggttgtgaccagctgccagtaacattattagagctgacttgtttggttaactttgctgaacaactcaatctgtgctcacacatatggaagtataggctgtagtaactgctcttgcagtaaaata

SEQ ID NO: 173504 - DNA, 218 bp, Homo sapiens
tcataaatctaagttccttgagagcagagatctctctgtttttgtcattattcttcccccatgcccaaaactatgtagagtctcaacagttttttccattaatgaaaaccagtgacataggtcctaacttcttttttttttcttttttttttctttttttttaagacggagtctcactctatcactcaggctggagtacagtggcacgatcttggctc

SEQ ID NO: 173505 - DNA, 658 bp, Homo sapiens
gggattacaggtgtgagccactgagcccggcccaaagatgctaaatttctacctggaaggcctggagcttcctctgtattcccatgggtccaggccataggcatacagtctggccaggaacatcagagctgggcaggatcacagaactcagacaaggggacatagggaaggattggtagttgaatggaggaggatgaatgaaaatctactcatcaaatacttatgaagccctcactgtatactttccaagcccctgcttttctactctttcttctgttcttgcttttgttcaccatttcttctcttcgactgtctgtccctgagtgtgctcagagaaacagaagagagaactgggcaccactggagaaaggcagacaagtggcacagagggaggtatgagagaggaagggaggaaggtgcctctggggaaggaggcaggccagagtacaaagggcttcggttctagtccagagcaggacttcatcctttggacaaaagggggtcactggaggttttactttcattttctaactatttgcatattaaccttgtatctagtcaccttgctaaacgcacttatgaaatctaataatttgtctgtagattcttctggatactttgtgacatgttcctcacacttgcaaataaagacaatttt

SEQ ID NO: 173506 - DNA, 488 bp, Homo sapiens
ctcctgccaaggtacatcagagaagccgaaaactgggactgcatgggcttggggtgggctcgctgcaatgtcttgatctaaaacctaaatgtttcaccttgtggtaaggagcacctgtttcccagagtggcctagaacctggcctctctgctggaaggaatgaagccccagatgctttgcacgggggtggagagagtagtcgccttggtctccgagaatagggttcctcctgggtcaccgcgttcacccaactacctgttaccttcgggcctgggttttccacagaaaaaattacgcaatgagccgccgcctcagggctttggaagttgcagtggggagagaaggggtgggagaatcccccagggatgatagagagcttcaggtctccctttgggtgtcggtgccgctgtttaccagcccaacagccttcagcccacttcccctttcctccccgggggaagagatggttaaagattacacagcggccg

SEQ ID NO: 173507 - DNA, 405 bp, Homo sapiens
aataaataatggtggttatttatgaatgaaataatttttctttcaacgtatgtgtagtattttttaaaagaaacataaatacttaggttattaggacccaactacttagtaaatggaattctgaaatatttctttaggtctggggtactacgaagaaattattgagatattacgtgtgctgtcaattaagacagtgtgagaacttcaaccttaatagaaaccagctcatctacctatagtatcaggaaaggattgatactatttgctactggctagtccatctgcctatcaaagtctctccgtccttctcaactcagatgaaatacctcctcctctgtgaaatctctatacattcaaatcaccttttattggcttgacagttttcccctccccaaccaagtcagt

SEQ ID NO: 173508 - DNA, 484 bp, Homo sapiens
atgtaaaatattcccattttcttaatgcttcacaatctttgctctgaatttaccacagtgtagttttgttttgttttgtttttgagacggagtttaactcttgttgcccaggctggagtgcagtggtgtgatctcggctctgttcaacctccgcctccccggttcaaatgattctcctgcctcggcctcctgaatagctgggattacaggtgcgcgccaccacacctggctagtttttgtacttttagtagagacggggtttcagcacattggccagtctggttctgaactcctgacctcaggtgatccatctgcctaggcctccaaaagtgctgggattacaggtgtgagccactgtgcccggccatacactgtagcttttaaccctaatgcttgcttctgacttccaaaaaatggcataaggctttttgctgtggtttttgtttgtctgccatacacatgactctcacgaactgggaaaacg

SEQ ID NO: 173509 - DNA, 584 bp, Homo sapiens
ttgcaaatgtacatttcaaaatcttgaaggaggagcatcctaataagctcattatggtgcaaggcatagcacgtgcagaaaatgctgtcactgaaatgaacttggacctagtattcctgtctctgaaatggactgaattgctaatttttgaaggatatggggcattattaactgtagtggtttaacctgtgaaattagtgactcttgagaaagcagaggctattgaggccagatttgtttacgtctgtcatccttggtgatgcacctcgagtgtgttggttacagtttctcttctccaggcatttcaaactctgaagctcatctgtcggtggagagttagctaacaggcaaagctcggatattgagactgcatctgcagagctcctgctggggatatgagaatactggctcttttccagacaaatgggagttagagccttttataaggactttccataagatctgatagtattttcatgcctttttggtttatctatttggtgttttttttaatttattttttgtgtgttaggcattcataacctcatgtaaattcttggccaataaaattgttgcttacttca

SEQ ID NO: 173510 - DNA, 1116 bp, Homo sapiens
caggtgtggaccttggatgctgcctgcctaaggctggtgaccaaaaagaaggtagagttggatacaagagcctggcattgttggcatttttgtgtttgagtgtcggaaagatcgtggcagaagcctaagtatctgtgttgcttgggcctagcatctgtgttttcacaaatcccccaggtgatttgatgcctctttaaaacacagaatgttgggccctacccaaagggtttctgattcaggaggtttagggcagggcccaagaatttgcattatttacaaatgtcaaggcgatgccagccagtgctgctggtcagggaccacgctttgagaaccactgctctggtgaatgggtattgctgtgttgttatctgcaaagttacctttgtgtacttctgctttacaaaataggatgtagcttgaactctgagtcaaactgccatttactgtggtatgaccttggatatggcatatacagtgattcctcacacatggtgttaataagttcttagtaaatgctggctatttgaatatggtatgtaggtataaaatgatgtggtggaggtaaaatatgaataatttgctgaatataagctctggactgtggacattataaacaagatcttgttttgttttcagcatgacatgaaaggttcattagctttgttttacacatagggaagtggcttattcatgatcacgcaactagaagtagcaacggtagatttcaaattcagttctttctggcttcaaagcctgagatttgccaccaccgcatgagctgcttggagtactggattggctctcccacagtttttgtcattgtgtgtgtgtatgtgtgtgtgtgtatatgtatgtgtgtgacagacagagagaaggagaggggtgtgtgtgtgtgtgtgtgtgtgtgtgtgtgtatgagagagagagagaaagtgtgccagaaattatttgcgtacgttttaaaatctctgttaggccattttttaaatctgtaaaatgggcatgaagcatgcagagttcatagggtttctttgctgagtagaatatgggatggcttagcattgtattttttttccttttctaattaaaaaaatttcaaagccaaatcgaatctag

SEQ ID NO: 173511 - DNA, 278 bp, Homo sapiens
agggaccctcggtcctatggttgctgcttgagacaaagacccctgtcagtggaacctggtgacattcacccttctgtgtcaggctgcagacagcaggagatggcagcagattacacccaacaggaaaagggccattgccaccccacaggttgccatagaaggagatgacatctctccctctcctcctccagcagtgtcagctggggaagtggtgggtggatgtgcacaaaagagtagaccacagagcatgctccttctcctccggtctgctggggccc

SEQ ID NO: 173512 - DNA, 314 bp, Homo sapiens
ttctcactctcctgggaaaaatgtatttcctctagcagggaatcaatatctctaagtccttttttaccaaagaaccaatcaatcatttacttctaacattaggttgagaactgcacgatggaaagatctagattttattcatctctaaagcctactgtcctaacacctggaacagagtaagcttcaaaaatgttagtttctatcctttctctaacatataataagtgctcaataaatgttagctgtctctatttcattaagtatcaacattaatgactgtcaaacctaagagcaatgtaaaatccaggagatgg

SEQ ID NO: 173513 - DNA, 602 bp, Homo sapiens
accatggctcacacctgcaatcccagcactttgggaggccgaggcaggtggatcacctgagtttagaagcttgatactagcatggccaatatggcaaaagcccgtctctactcaaaatataaaaattagccaggtgtggtggcgtgcgcctgtaatcccagctactggtgggggctgaggcaggagaattgcttgaatccaggaggtggaggttgcagtgaaccgagatcatgccactgcactccaacttgaacaacagagcaagcctccatgtcaaaaaaaaaaaaaaatggaggcacacagagcctggattcagatctcagctgtgtcgcttaatgggctctgtcacttagggtgtgtgacctcaccttcccaaatctgttttctcacctgcaagatgagcacaccaaaacaggattaaaacagggatgaaaagcaatcatttttagcatagtgtctggcacatagtaaatgctcaataaacagtatccttcattctgaatgaaagtgccatatgttattgctattgtcagtagtagcaacagcaatagtggtattggttctactattaattttaaccaatgctgtagacatagtatgag

SEQ ID NO: 173514 - DNA, 510 bp, Homo sapiens
cagcagtgcaaagaagcagtgggatgattagcttctagccccctgaactcctcaggattgcagaaaggcccagagaccatgccttgtaccatggtatgccaaacctatttttgattgagagtgttggagagaggggagggaagagacaatacatttatttttagagagtaatgtggaccaaatctttttaattaaaaattagggaccaacacaactcctaaaaataattaatagtggtctagaatggcctgcaagctgtagcagagaatcagagacatctgtcaacaaccttccattactggtacatgttggcatgatgtctgccagcatgccctggtgctcacctcttgtggtgtgtgttaaggggtggaggggtcctggtctcagcactccttattgctcaggtatcattaagcagcaggaatgttaaacgcatgatattggcccataagtcattatttctgtcaacagagatggatccctctttgtgatgaaaacataattatcata

SEQ ID NO: 173515 - DNA, 432 bp, Homo sapiens
gtgtccataaccagcatcaacagcccataaccttcacggcattcacacagaatcactttttgcttcaatggcagacgggaagagatggaggaaagtgttatctggagcctgaatggtgttagtcactacagtggacatttggattacaaatcgtactatgccacttagtgctggatcttaaatgacacttatgttttaaacatttgtgatatgtgcatcctttaagtataagatccaaagtagggggccctgtcacccaggtcttaaggtgatactctaaactttagggaatatttcatccaggatctactgaaatctaagaaaaaaaaatttgagcagattgataacagcttttcttttttaaatgtatataatgagagagctgttaacaaagtcaaaagagttattgacagaagtaaagatggctgtagt

SEQ ID NO: 173516 - DNA, 415 bp, Homo sapiens
aatgttttcagaactcgttttttactattacaacaacataatatccattgttggaataagcatatcactccctttaaagtcatactctcagtcgtgatattaattctggtatatttattaaagtcagcttgtgctttactctttctagaagtattcaacttctataggctaacactgccccaacaaagtaaaaatataggtcacgagaagggcatcttttattgaatccattttgctagatttcgtgtgagctgtttctgaagtctcccaagaaaattttctgaaatttcttgaatttttaaatatgctccttttcgatgaccttttgataattatttccttctttaaatctgacctacagtaacattacctttctaaagaacagaaatccttggtgttgggggaggagcagctt

SEQ ID NO: 173517 - DNA, 291 bp, Homo sapiens
aaatgcagacaggtgacaatgacctaggtaatatattttctgcagaggaaaagcattttcatagtatctactcagagttccatacagcaaaataaaggccagtactattggtgactgttgtactgtggctgtagtaagtagtttataaaactcagctaacgaatgggagaaagctacatttattaaaagatcatgatattgataagaatgcattttaattttcaaggtatcatttcagagagtgaatttatctgcataaagagctgactggaacgtagattttattattct

SEQ ID NO: 173518 - DNA, 1017 bp, Homo sapiens
cagccccttccctagcaccagagtctggtcaaaatgccacagaaaatgagctgctctgccagcaagctgtggagctgcctcctctccaggcctggcatcccttggtcagcccctcctgggagggcacagccgtattacagtgccagtgtgcctggccatcagcatcttcacccttcccagtctgtgtggggaggctgtaaaccccgtggattcagctccgtgtggagtttctgtgctatggtgggactgctcattttgccccatcatccctttggcctcccacacacctgccccttcccagggatcacgtgtgtctccagcctttcacctttctattgcaatggtggcctttgtccaggcaagagcaggcctgatggatgtactggtgagccccacagttggatgtcagctcagccgtccaactgggaggaacagtaggctcagttcctccctgacccctgacaccaggccgcagtgggcatgcacaggcccacagaaagtcagtctgggttttgcttttctcgtgagcatcacagttaaagaagcgctcattgagcaactacagtgcacttggtcttctgcaagtgctgggcacctagagataggaacagtcatggtccctgctcttaaggaactgatgacctggtggggccctgttgtcttcaaggaacccagaagccactgggccccaaaggtggaactgaaggactgggggcagctggctctcagcctgccacctctgcactgcctgcctttaaagaaccccaccccaccccatgatggccccctctgttccccttgtatttcagtgactgtgaattgaggttaggaaggcacacctgcccttctgtgtgctctctccacacgaaggatgacagatactgtgaattcagccctcacggccaactgtgaaggggatggagaaggctgggagggctcggggagagctcttaggggctgcggaagtccccacgggggtctgagagtggagcccaagctttggccctccaggcatcc

SEQ ID NO: 173519 - DNA, 482 bp, Homo sapiens
gtgcgatggtgcaatctcggctcactgcaacttctgcctcccaggttcaagctattctcctgcctcagcctcccaagtagctgggattacaggcacccaccaccatgcccggctaatttttgtgtttttagtagagacgggttttatcatgttgaccaagctggtctcaaactcctgacctcaggtaatctgcccgcttcagcctccccaaatgctgggattacaggcgtgagccaccgcttctggcctgagactcccagagatttttaaggaaggtcaagagttagctttaacaatcacactagagcttacttcttgagtattatgaagaaaataccagtatttttctcatggatatttcaagtatttaaatcatttaggcagatcatttgactcaacacattttctttgatcatacgacatttgcatagacttgtaccatataattgccccctcagttcccatttatacatgtactgtgc

SEQ ID NO: 173520 - DNA, 192 bp, Homo sapiens
agttggttacaggattctcttaacaccaagtttttttttaaataacaagttctataaatctttttattgcttcggtatcatgaaagacaaaaaaaaatcaaaacatttattttttcctcttgagacagggtctggttctgtcacccaggctggagtgcagtggctcaatcatcactcaccataacctcaaac

SEQ ID NO: 173521 - DNA, 381 bp, Homo sapiens
gagtaaataatctgaccccttaaatttcctcaagcttaaaaggaggacaggatgaaggctgcgtccaaggttgccgagagttcacggaagttatgctggcagagcccccagcaggcgagcatctgtagtgtgctggtggggggagggctgagtgacttacaccctcttccaaagacaggcgagtgaaaggtatggtttaaacgaatgctgcagtatggggtggggtccaggtggcagaatgcattggctaattgtatctgctggggacactggtctttgggcgcttcctgggagcaggagggaagctccccaccttatggtccccatgggcactttcattccacagggacatggggtctgagaagcatggatggacttaca

SEQ ID NO: 173522 - DNA, 449 bp, Homo sapiens
agagatgggaagtgaattagactgtctgttgtaatcagaatacgatgtgtatggacatcaaaacctcacactgcgtatcttaaatataacaatttcaacacaaaatgtgaaagcaaactgtaaggataggctggtgcactttgatctcttgttttatgctctgccttcattgttctgtacccttaatcgggtaactagtgacagtacgcaacagaatgttaataaccgtgtactccatgctgtgtgtgagatgttgccaaccttaataaacagacagtggctctctaaaagaaaatgttgatttgcgagtagagcatgtgcaatgggaaatacatgtgccatagtaaactatgtatatatacaggagataaagacagaggtgtttaaagaaaaaaaatgaggaggattacataattgtttagcaataattattcttggccacgagatca

SEQ ID NO: 173523 - DNA, 254 bp, Homo sapiens
gagaagtcttgttctaattggttctaccgcatctcctgtacctatgatttgtcaagcagctacataaattggtagctacattttggtctaaaaatgccacttttctccgccatcatcctttttaaaaatatggctatcctggttctggaaaaaatggaaaaatgaaatcccatatgccaggaaccatatcataaagaacacttactagaactactcctgaagcagttctgctattaatttaacttctgggttcc

SEQ ID NO: 173524 - DNA, 519 bp, Homo sapiens
cccacacccccactccagcaaggtaggcccaccccctacttctccctgactaggaaagggaggagataaaaataaggagctacagagaccactagaggtggaaggaatgagaactaggcagaagagacccccctccagttacctccatgcacctgaacacagaaggagaattccattccttgcggttgtgtttaacttgtccaatgtgtcccagtgcccatgggagtgaatgggaacaaatacagggggcttgcctgcctctagacattatgtgaaggccccaaaggacaggagctatttctggggagggctgggagacccaggatcctctaactgaaggaggggcagactcagggaccacatccaggcaagccagggcacgggccagcgctagaggacatagccctgctttgcatattttattatcaatagttccttctttcactcttggtgtgactctatgaccagtggttctgcacatccccaggtttcgtagatgaagaaaggatgacgtgctgc

SEQ ID NO: 173525 - DNA, 125 bp, Homo sapiens
caagacaagtttacttttggtagagtttgaaccagagctgtaccctagacttgaaatggggaggacgggtggaaactatctggacgtggtgggggagacgtatctatgaagtgaaagtttgtata

SEQ ID NO: 173526 - DNA, 226 bp, Homo sapiens
aaggagggaccatatcaagcccattaggatggttattattttaaaaattatcgaaatataaaaaggagagaagccagcagagatgagcccagcatttggagcacttttctttccttttttttttttttttttgggaaggggtctattttggcccccagggtggagggaaagggttttaacccgggttaagggaaccctgggcctctgggggtctaagccactttct

SEQ ID NO: 173527 - DNA, 485 bp, Homo sapiens
aaggatcccctgttggagtgcttgttgcagtgagctgagatcgtgccactgcactcagcctgggcaacaagagcaaaactccgtctcaaaaatgattgaataaataaataaataagagctcactgtctctggacattgctcttgagctgcggcagtccagcctgatctgaggagctcactgttggcataacgctaacgaatcagccaattggaagcttattctgactacagccatatcttcattttcacttctgagaagaaattctgctgtgatgagacattccattttaaattttcagcattttgtaaacactgctttcctgtgagtagggaatattgctggtgtctaaatactgctttcctgtgagtggggatattgctggtgttgagtcagtgactccatcgtcggctgtttgctctcagcatagctacagtatgacggatgagaaagtcggtgctttgccatcaacaatgacagttcaaca

SEQ ID NO: 173528 - DNA, 1170 bp, Homo sapiens
gcacagtatacgaagcataaccttctcttcccttgatgacctgggattgctctcaagaatacccattactggcctgagctgtcactgcctcctcccgagctcccagtaggatgtccagacactgcctctggtcagccctgtcttggccctcagggacctctggctggcttggagagtgcttttgtgtggcgttcccagcccagtgggttcatctgggctggaaccagaggctcctagtggaggagggaaggatgcaggcacagcagaagcattctatcatttgaatgcctggggtctgcctccgcctctctttaaacaaagacggcaatgtgtgcaggactgtgtggactagaggtctggcgtgctgtgctctgagacctcctgtctgtgtttccttcctccttcgctggcagctgctgccggtcagggtcacagaactcacttgtcacctgtggccctattttatccatgggggcctgggaggagctggaacatggacgggggcagctcctacccaacaaaggaagggcctcctggccatggtgcctctgttctggatgagcgaggctgcagcagtctcggtgggctcgtggtgtgtagcggcagggaccctatgaggagcctgcgtgaaccaggagccatccctaggacaacactaacttctatggcctcgtctgtattttccagtctgagtgtctaaaatctgctaaacattcctagtttgattggcaatgatcatggcaacatgtaagtggccaaagataacaaagagaattatagagccatggaaggtcaggctacaagtgaccttagtgaccttttagtccagcctctcgctcagatggggcaaccgagacacaggcaagggaatgatttgtcaaaggtcagagcaacaacagaggcagagcgaggcccaggccagcccggagcagccatcccctgccaggtctacttcacaggacagcagcctccactcagatctgcctgcccttgccgtagccctgtgcattttaattgcttactccttttcttatcatgccctggggtaattttacaaagggcacaactacgacattcaaacaaaacacatctattctcaggttatttttcctgatgtaaatccttatgattaaagaggaaaatacaactgtaggtaagacaggccaaaaa

SEQ ID NO: 173529 - DNA, 700 bp, Homo sapiens
atttttgtatccattaaccagccccacttctcacttctccagcttccattcccagcctctggtaaccatcattctactatctatctccaggaattcaattgttttaatttttagtctccacaaatcagtgagaacacgcagtttatctttctgtgtctctcttatttcacttaacataatatcctccagctccatccatgttgctgcaaatgatagaatctcatctttttttcaattgctgaatagtactccgaaacagtgtgtatttggtaagtgctgatatatgtaaacaccactgaagtcttcagcaaaatcagaataatgaacatgtgtcaatcccaaaaacttctatctgtcttctttgtatttcatttctcccatccctctacccccatcccccatccccaggcaaaactaatctgcttcctttatttactattggttagtttgcattttctagaattttgtataaatagactcatatagaatgtactctgttttggtctagtttctttaatttagcataattattgtgagatgcatctatgttgttgcatacatcttttttttttgctgagtagtaatctattgtataaatgtaacaccaatttactatttcattgatagatattttagttgtttccaagtttagtttaggttattacttaaacatgaaattatgaatgttcatgtttaagtc

SEQ ID NO: 173530 - DNA, 700 bp, Homo sapiens
gcgctgaaagctgagctatcccaggacctgggaggtgaccctgtggctgccgagtttctctctggatgcacaccatgtctatgaaccctaaggaagggtccccactttgctgggagcctcggaggctgggggcaccatccccaatccctcggggcaggctcagatcctggcacactgacattgccagccactcctgggcacttgctgtgtgccgacccaggactaggagctgcacctgggccccaggatgtcccctagtttgcaaatgtggaaacttgagtctcagagacttagggacattggcctctgtgaatctcagggctgcttctcctgaggcctgaaccaggcctggcactgtctgctgggtgcgggcccagccctgggaggacccagcaggggtgctcagacctcccatcccatggctaacccaccgctggggaggaaacctgtggacacttgcactgaaaaatgtcactctctacaagtatgcaagggagtcggaccatctcccatcagacctggacacccgccggacaccacagcccctaacactccggccaggtcgctccaggctggcacaggtggcacccagccagtcacacttaaagcagggtttccctggccttaccatattatcactccccaaggaggaaatgcgaatttttaattaagtgaattaaatgctaatttaattaagtga

SEQ ID NO: 173531 - DNA, 779 bp, Homo sapiens
gctaggatcaggcctggttcgaattcggacgaaggctgtgctcacacagctccgcgagacggccgcccaaacaaagctacctccgtgggccttggccggctgacaagaggaagagaaggagattactctaagctccaggtattctggtgagctggaagctggccgggagggccaggcgccagtgacacctccagccagcaggcccatgtggaggccccatcccgagagcgtgcccggggcgaggcgtgtccggccaccaccgaccaccagccgcccaggaggcagaggtgaccggagagggggctgctcggttcagggaggagcccagcccccaacgcagggcacggatggaatctctcaaggttccctgggcatcctgcccacccaagctgactgctaaggtcatcgatacggagcaggagcccaggcctagagtgtccaggccaagtgaccaccatgagtgcctgagaggccggacgtgcaggctggctcctggcttctcacctgagcctccccagccccttgcctccacgtctgagaatgcccggcgccccagcatggcttggggaggcggggtgctgagtgcatggggccgagaggatggctctgggccagtcgggtgctgggacagtggctggcaggggacccatttggagaagagcccactgctctgagcagctccagctgcagctcccaccgccctcttgtgagggcctgcctgggcccgtgtccaaatcccagcaccacaggccagatggccggcaggtctcacggggtga

SEQ ID NO: 173532 - DNA, 563 bp, Homo sapiens
tccaaaggcagttaggctggaaacccagatgaggtccaaaaccatatgctggcagaattcccttttgcttgggggaggtcagccttttgtttgattcaggccttcaactgattagatagagcccactcacattatggagggcaattcactttgctcaaagtccatcaatctaaagggaaatctcaccccaaaacaccctcacagaaacatccagaacaatgtttgaccaaatatctgggtatcatggcccaggtaatctgacataaaaaattaaccatcacagaaatccctggaacctgtgttatcttatctgaaaaaagagtctttgaagatgttagaaaggatcttgaaatgaggagattatcctggattctccaagaaagcccccaacttaatgacaagtgtccttataaaagacacacagggccgggtgtggtggttcacacctgtaatcccagcactttgggaggccgaggcgggtggatcacctgaggtcaggaggtgaaaccccgtctctactaaaaaaatacaaaaattagctgggcgtggtgatgggagcctgt

SEQ ID NO: 173533 - DNA, 779 bp, Homo sapiens
ggggaatcccagtaagattaacagctagccagcatctcatcagaagaaatggttggagggtggtcaagatggctgataagcatttcatgcccacttcttccacttagtagaaccagagcagtgtacagacagtcacactcaaagtacattatccaagagagaatgctggaactcaacagagaagtgacagggaacaccaaaagtggggaaggaggaggagaggcagcctctctggctgggttcggctgggcatcaggagtgaattcccaatatagggaagaggtgagtaggtgtaggggccagccctacagggtctgtgagtttttctccccatgtgtggagacaggagattgtagaaataaagacacaagacaaaaagataaaagacagctgggcccgggggacaactaccaccaagacgtagagaccagtagcatccctgaatgccagactgtgctgttatttattggatacaagacaagggggcagggtaaggagtgtgagccatctccaatgataggtaaggtcacatgggttacatgtccactggacaggggacccttccctgtttggcagccgaggtggagagagagaggagagacagcttacgccattatttctgcatttcagagacttttaatactttcagtaattctgctactggtatctagaaggcagagccaggtgtacagggtggacacatgaaagtggaccaggagcgtgaccactgaagcacagcatcacagggagacggttaggcctccggataactgtgggcg

SEQ ID NO: 173534 - DNA, 824 bp, Homo sapiens
aaagtatgaggaggcgtaccggttgttatttcagtcacggggcgggggcctagttgatataatgtacgctggctacatctagcatcagaagaaatggttggagggtggtcaagatggctgataagcatttcatgcccacttcttccacttagtagaaccagagcagtgtacagacagtcacactcaaagtacattatccaagagagaatgctggaactcaacagagaagtgacagggaacaccaaaagtggggaaggaggaggagaggcagcctctctggctgggttcggctgggcatcaggagtgaattcccaatatagggaagaggtgagtaggtgtaggggccagccctacagggtctgtgagtttttctccccatgtgtggagacaggagattgtagaaataaagacacaagacaaaaagataaaagacagctgggcccgggggacaactaccaccaagacgtagagaccagtagcatccctgaatgccagactgtgctgttatttattggatacaagacaagggggcagggtaaggagtgtgagccatctccaatgataggtaaggtcacatgggttacatgtccactggacaggggacccttccctgtttggcagccgaggtggagagagagaggagagacagcttacgccattatttctgcatttcagagacttttaatactttcagtaattctgctactggtatctagaaggcagagccaggtgtacagggtggacacatgaaagtggaccaggagcgtgaccactgaagcacagcatcacagggagacggttaggcctccggataactgtgggcg

SEQ ID NO: 173535 - DNA, 792 bp, Homo sapiens
ctagttcggcacgggggcggggcccagtatgattacatggttgaccctggcatcagaagaaatggttggagggtggtcaagatggctgataagcatttcatgcccacttcttccacttagtagaaccagagcagtgtacagacagtcacactcaaagtacattatccaagagagaatgctggaactcaacagagaagtgacagggaacaccaaaagtggggaaggaggaggagaggcagcctctctggctgggttcggctgggcatcaggagtgaattcccaatatagggaagaggtgagtaggtgtaggggccagccctacagggtctgtgagtttttctccccatgtgtggagacaggagattgtagaaataaagacacaagacaaaaagataaaagacagctgggcccgggggacaactaccaccaagacgtagagaccagtagcatccctgaatgccagactgtgctgttatttattggatacaagacaagggggcagggtaaggagtgtgagccatctccaatgataggtaaggtcacatgggttacatgtccactggacaggggacccttccctgtttggcagccgaggtggagagagagaggagagacagcttacgccattatttctgcatttcagagacttttaatactttcagtaattctgctactggtatctagaaggcagagccaggtgtacagggtggacacatgaaagtggaccaggagcgtgaccactgaagcacagcatcacagggagacggttaggcctccggataactgtgggcg

SEQ ID NO: 173536 - DNA, 803 bp, Homo sapiens
ggtggacctccgaaggtcatattatgctcgcgtattgccagagaatctcagtcagatgaaatgggtagtgggtggtagtctgtatggtgttgactaggcattctctgtgcccacgttgttaccatcttggctggactcacagcagtgtacagacagtcacactcaaagtacattatccaagagagaatgctggaactcaacagagaagtgacagggaacaccaaaagtggggaaggaggaggagaggcagcctctctggctgggttcggctgggcatcaggagtgaattcccaatatagggaagaggtgagtaggtgtaggggccagccctacagggtctgtgagtttttctccccatgtgtggagacaggagattgtagaaataaagacacaagacaaaaagataaaagacagctgggcccgggggacaactaccaccaagacgtagagaccagtagcatccctgaatgccagactgtgctgttatttattggatacaagacaagggggcagggtaaggagtgtgagccatctccaatgataggtaaggtcacatgggttacatgtccactggacaggggacccttccctgtttggcagccgaggtggagagagagaggagagacagcttacgccattatttctgcatttcagagacttttaatactttcagtaattctgctactggtatctagaaggcagagccaggtgtacagggtggacacatgaaagtggaccaggagcgtgaccactgaagcacagcatcacagggagacggttaggcctccggataactgtgggcg

SEQ ID NO: 173537 - DNA, 222 bp, Homo sapiens
tcatagaccttttttaacatgcaatttttgcgactgcatgtcatttgcatttaatgtcatttgtcattgcaaataatgtcaaaaaaaaaaaagtacctcataatctatgaaaaattctaaaccaacacagggttactgggataaacacctcttagatatgaggaattatcctttttatatctggctggatttccattaactaatgtttttttgtagaaatag

SEQ ID NO: 173538 - DNA, 285 bp, Homo sapiens
ctcccctattcttacccccatcactgctccccatctatgctctacactgccacccgaaaaagatttctaagatacaaatcctagggactttccgttaatcgttatggtgggctattagattcaccaggaggaaactactgaaaaccaaaggcagatacaccctcccactgaaacaactaaaaatatttggatttaaaaaaaatctcaaagcattaaagaactgacgggcattaccaggttaaaattggaattgataagacattgtaggtttgaccaccagttgct

SEQ ID NO: 173539 - DNA, 397 bp, Homo sapiens
acaaggtttgtgaatcaacacgaccctgtagtttagcatctttgtcctgttatttgcagcatataatttaaaaatgactagaccataaaatattaatgttaaatatgtttgcagatttttggtgattttttttcttttttcgtatttttctgttaagttccaaattatttcctaagaaagatgtatacattttaggctgggtgcggtggctcacacctgtaatcccagcactttgggaggccaaggcgggtggatcacctgaggtcaggagttcaagaccagcggcccaacatggtggaaccccacctctactaaaaatacaaaaaattggccaggtatggtggctcacgcctgtaattgcagctactcgggaggctgaggcaggagaatcgcttga

SEQ ID NO: 173540 - DNA, 650 bp, Homo sapiens
gaataggtgtacattttcttgtttcggcctatattttcttatttctagtaaataatacagtaactttggaacagtacttctgtgctttcttttttgagatggagtcttgctctggcacccgggctgtagtacagtggcacgatctcagctcactgcagcctccgcctctcgggttcaagcgattctcctgcctcagcctcccaagtagctgggactacaggcatggtggcacgtgcctgtagtcccagctactcgggaggctaagacgagagaatcgcttgaatccgggaggcagaagttgcagtgagccgagattgcaccattgcactcaaggctgggcaacaaaaaagaaactctgtctcaaaaaaaaaaacaaacggaaagaaaaaaaaaggggcgggcggcccgggccccacaaaagagcccaagagcaaacgagtatgggacgcggggggagccccaagtccgggcaccaggagagacacaagggggtccacaataaagcgtggtaacccactagggaacaaaacactgcaaggaacacgcgacaaaaagtagccgcttgtgcgattatcaccacacccaagcatacaatacacagccccacgagcggagctaaacacacgagcctaggaattcgactaaaccaa

SEQ ID NO: 173541 - DNA, 503 bp, Homo sapiens
tcagtcttactttgtgcttttttaattcttcactggggccatagcaaggaaagccaaaaatagtattaaaacattcccttcattaaaaaatcttgcccaaatccaactactacatactttcttccaacatctggggtaccctgggagccttttgggctgagtgggtctagaaatccagcagggcaaaaggctagaattttaagcaggtaagtgtaactaaatcctgccgactagcttctccaggaacatgggtaaaggtcacgcttgtatccatgttgcagcacctatcatggtagcctgaacccaaaggagagagagaaggaggagaaagaggatgccccttctctcttgctctccaccctgggtcacacaaaagggagaaaaggaactaaggaaagctttgtttctccctcttgttctagatgagcaacagaccatctgcagtctatactcccctcaagtgtattctaaattactaaagctcctttaaccgtaaaactcta

SEQ ID NO: 173542 - DNA, 236 bp, Homo sapiens
tcaccccttctcagccttcccaccctgctcaccagagctgagtcaggagccctggctttgactccaggaagccttggccctttaacctcaatggctggggttggggtagaatcaggaggtcttgttagcagtactccccattctgcctgtggtgcccaggctggcccctgtatagcagagaacacaccagctggcccttgctggcctacacggtatcttcatctgtcatctcaatg

SEQ ID NO: 173543 - DNA, 289 bp, Homo sapiens
gccaatacggtgaaaccccatctctactgaaaatgatcgtcacctgatccccaccccttgaagatgcctccaccctctccatacgcatttggtcagcactaactgccctgggtgacaggcacactgcactgggtgacaaggacccaaagctacaccagccagtgccccagccctcaagcacctccctgtgcagaaggaagacaacacagaaaagggaagcatggttgtcacagaggcccagaggactgctggctgatgtcactgaatggggaagtggttggccgcacag

SEQ ID NO: 173544 - DNA, 480 bp, Homo sapiens
tgttactagtccaacctctacccttgaaagcagagatagtggcatcattgctacattaacaagctattctgaaaatgtggaacgcacaaaatatgctggggaaagcagtaaagaattaggatctggaggaaacataaaaccttggcagtctcaaaaatccagcatggactcctgtttgtatcgagtagatgaaaacatgactgcttccacctatagtctgaataagatcccagagagaaatttggaaacagtgttatctcaatcagtacagtctattcctttgtatctcatgccacggccaaattcagtagcagccaccagctctgcccacttggaagaccttgcttacctggatgagcagagacatacacctttgagaacttctctacgaatgccaagacagagcatgggtggtgctcgcacacagcaggatttaagagttcgctttgcaccttataggctccagatatctccttgaag

SEQ ID NO: 173545 - DNA, 408 bp, Homo sapiens
catgatatttcctgattctccttttaaagtatgtagggtatgcagggatagtgcctctttcattcctagtattggtttttgtgttcttcttttcttgaactgtctagctagggacttatcaattttattagtcttttcaaagaatggcattatcaattttgtccattttatcaattgttcatttttctattttattgctttctactcatctctattgttttcatcttttttgggggatccttttttattctttcctgagctttaaaggtagctatgcagttttgaaccttatactgtaaaataaatatctaaagctgtaaattttcctctgagtcttattttagttgtacttcttgaattttaaatatgtagtatttttattatagttaatgtattttaatattatct

SEQ ID NO: 173546 - DNA, 627 bp, Homo sapiens
agttaatgcctggcttccatgaagtataataccagggtgctcattgtgcccctggaaagtggtttatcattgctggggccacccaagtgggaccttcatgagttagtgaaacaggctgagtggcctcctagctggatgataaaccttaggagtctgagttcagttcaaataattgagtccttattttaaggcgagactggcctatttgtctatgccaccagccagaggacatttgtccgtaccatggaatggctgagggatagctttggaattagggaagtacagagccgttgactggcattttgcttagggggtgcaggggctaccattatctcttctgttcccaataaatttttcagtaaggttaaagggagtggccatggtatagcagtgagagctgcctcgcagtgggtgacaggcccagcactcaattaaacagaaggcactggcaacagcttgggagatctctctgttttcctttgaggaaagctctagaggcagttcactggaaacaaagatcattgatgtccctacctcccctgtatctccagggtctgaggtattcttcagatgctgaggttgctgttatccttccactgctacaaaatctatgtgccccattccaat

SEQ ID NO: 173547 - DNA, 258 bp, Homo sapiens
ctgaagccaagctgcctgggtttgaatcctagctctgccacttactgttactgcaaccttgtgtgaaagctaaacctctctgtagctccatttccttgtcaaattcaaatgctatttcccgacatgaaatgggttgtttttctctggttgctttcaagatttttaatctttttttttttttcaagagatgaggtcttagctgggcatgatggctcaaacctgtaatcctagcactttgggaggccgcagtgagaggat

SEQ ID NO: 173548 - DNA, 548 bp, Homo sapiens
gacttgtacattgaaaactacaaaacattgatgaaagagattaaagacccaaataaatgaaaagatatcctgtgttcaggtactggaagattaatattgttaagatggaaacatttccccaaacaatctagagaatcaaaccaatctttatcaaaattccaactgattttgtttgtaaaatggaaacgttgatattaaaattaataaggaattgcaaaggactcagaatagctgaaacaatcttgaaaaataataacaaagttgaggaacatactttccaatttcagaacttactacagtgctacagtaatcataacaatgtggtacctgcaaaagaacagacatatagatcaacggaataaaactgagagtacaaaaataagccaacatatctttgatcaattgatttctgacaaggtcgtgacatgccacgaccatccaatggagaaagaagtctcttcaataaatgatgctgggacaactggctatccacatgcaaaagaatgaacttagattcttatctcacaccatttacaaaaactcaaaat

SEQ ID NO: 173549 - DNA, 132 bp, Homo sapiens
aatggtgatggtggcacaataatatgaatgtgcttaataccactgaactgtacacttgatattggtgacatggtaaatggtaaattaaatttcatgctacgtatatctcactataataaaaaattgaacagc

SEQ ID NO: 173550 - DNA, 385 bp, Homo sapiens
gcatccccggtcatcaaccctaaaccctcctgtaccctggccagtaacatctcactgatactcgaattcttttggcaaacttcgctgttgtttgtgttccctgattgaaggtagggtttcgatgcacccctaaaccctggaatccttccacttctcgccatttccactgccactacggtagtccgagctagcactgtttctgcctggagactgtgtagctttctctgtggactcccatgtcctctcctgcctccctcctctcagagtgatttctcaaaaatgcagaccccctcatgtctatctatctgctgtataaacccctccaaatggcttccgttgctcttagaatcaagtccagattcctgttctgttaggccttcgattt

SEQ ID NO: 173551 - DNA, 343 bp, Homo sapiens
cacatgggtggtggctgagtggctttctttagactgggtatgagctctggtgcttcgtagtcctgggactcctataacacacatgagggcttactcaggctggcctcactgccctgcaggctagggcattagagaaccctacattatgaatgagggactggaggaggggcagatttgggggagttgtggtttgggccatgcgcatcatcttgagttgaaggtaacataataaaaacttgtggcatgcgttcacatttaccatctcactttggagctctatttagacccacatcttagaaaactaactgttaaagaatggccttggtcacatggccagcaggga

SEQ ID NO: 173552 - DNA, 294 bp, Homo sapiens
ggaggctgtagagaggtattagagctgggacattaggaagcctaaagaaccatctgtcccactgtcctgcaccccgatgggtgcctctggaagggcctggagaaaccatggaatttatgttctttgggctccctttttgtcgggttaagacagggactcactctgtcagccaggctggaagtgagactccgtctcaaaaaaaaaaaaaaaaaagaaagaaaatattcctcccagtttgttctttgactttgtttatagtgatttttgccctgcagttttttttttttttttttt

SEQ ID NO: 173553 - DNA, 284 bp, Homo sapiens
tagcagtgatggaatgggactctatgctggtgagttttgataagagattgcaaggaagtgagagaggaagaatatcagctgcagcacatgacaagtctgcctcctgggtcaggttcccctgacagcgttggtgcctggggcataaagatgctgggtgccagggaagggaaggatggggcactggagggagaccaaattcaatcattttaagtccagtccccagttctgtgcaattcttagtgtaaagtttttaaaaagaacattaaagacagttacaaagccga

SEQ ID NO: 173554 - DNA, 589 bp, Homo sapiens
cctgttttatatatcttagtgttattttgtttggtgcttaatgttgttaacatactatgttctctggcttttctagtgttttagaatgtatccttctgcctccaaatagtttatttttttcttaattttattttttaatagagtctcaatatgttgcccaggctggtctcaaactcctgagctcaaatgatcctcctgcctcccaaagtgctgttatcacaggagtcaaccactatgcccggcttcctaataatttttactgctgctctcaaagtttttgacaacgcacttgtgttgctggcaaacaacattttcaccgcaatgctgagccactgctaacagaccattagctaaaaatttacaaaagtgaaaaaaatcatgtatccatttaaatattcaaatgaatcatgttggtgttttctcaatatggagttctgtacaagtttttgtttctttgttttcattgcttttggttgttatttataaggatttgagaacttggtctctagaagagagtttttatactgaaaaagactaagggagggtgagaaagtagcattttaaatgtgaataaaaaatatcaattgct

SEQ ID NO: 173555 - DNA, 323 bp, Homo sapiens
gggcaaggctcatttacagaaagtggtcaatagataatgccagggggaattaggagagtaaaatacttgttagtgagtcagttggaagtacaaagttcagcaatatcagtgaagcccacataggaaaacgatgcaaagaaaatgaggtcaggataacaaaaagtggtttgaacacctgatctgcagtatcccaactgattctcacagtactattgagcacttgatatacacatctcagttaattctcacagcaattctatgtgagatgaaagttaccatccttatctaaatgacgagacagaggctcataaatgttaaatgtg

SEQ ID NO: 173556 - DNA, 532 bp, Homo sapiens
gttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggct

SEQ ID NO: 173557 - DNA, 366 bp, Homo sapiens
aatggagctatgacttctgcagcttcttctgttctgcccaccgggcttcttgatcacacgggaaaaacccagcgtgcatcacctattttcggcagggctcagtctgctggtaccacaggaaagaacaccaactcgttaaagcataactcatggccacagaggaacaagcattccccaaaaccaggaaggtaccatgtataagctagagcctgggatccccagactagactcttgggtctgtgagacttgggtgaggccactgatctttgtgctttggcaggcatgaaggaaaggccactctgacctaccaagagccaaaagaatgttaggtatcaattaggtgactcagaatatccctgacctttg

SEQ ID NO: 173558 - DNA, 433 bp, Homo sapiens
aacagttcaaagtccatctcaactatttctgttcaatcaccacaccccaaaggctacaattgcatcaagtaaagtggtcctggtgtccccacgctatactgactgagtcttcacaccaatggtcattggaaggagctaaaaactaaggtatcttgtttgtgtatcatttttagcttattgtttaaagaaacttgaggaagaagaagcaataccaaacaatttttctgaaaatgacatgtgaacacacacactggggatctgctctaataatataccataaaaggacacagttcacatcaaagttaatttttactcagcaaatctccattgaacccaatagcccctatcaaagctacttagcctcttggacaaaattttattaatagcactcacatgcctaccatatgtagtgtgaaaggagatccaagcaatg

SEQ ID NO: 173559 - DNA, 438 bp, Homo sapiens
ggagaatcatttacgaatttctaggtattcatgtattctatgtctgactcaacagtaacgccttttgactcatccggttcttggaccaggacgctgtcttgctctgtaagccagggagagattttattacgctattttacaaatgcagggtctgaaacaaaaaggttacggtccgggcaggctatgttttctttctactggatcttaagctggaccggatcagtagattgaggagcaggctttagagagcccagtgtcaatctggaatctaagcccttctatcagagcgcaaaactcgtgtccaggaccccagccttagcggggagcaggggcccgtgtgtcgggaaataaggacgaatggttgcaggcacagtttctggaacctgcgttttgtgcctcctttgctcgtatttggaaaaaccgctggggaaaggcgcc

SEQ ID NO: 173560 - DNA, 494 bp, Homo sapiens
tctttgctcccctgtgttactgttcctaaaccaacttgcagcaccacaaagcactgaactcaagtggccctcagcgcgagctcctgctgtgatgagtcgcagagccaccagcactttgttgccttagatttgatcactgccatgagcagtccttcgattgtcagctaagagccccttcagggagttgtcccttaatagaaagtctcttttcttccctcctgttgtaactttaaattaaaagaaactgtagaggagctggtggcattgcagtagttcattcttctacccactgggagaacaacatctgagaaaagacgttattggactgagaattgagttgttgctatttttttgggccagagtcggcggggaggcggttgtggtggaggatgaagaccacgtcatttagactcagtcagactggtaatcaggattgtgattgagagcaatacttttgtgtatgcaaggaagctttctttttggatacaagaaga

SEQ ID NO: 173561 - DNA, 380 bp, Homo sapiens
tataaaaccttataaacggcaacctattttgcaaggttgtaggatatactatcagtatataaaaatcacttgtgttggccgggtgcggtggctcacgcgtgtaatctcagcactttgggaggctgaggtgggcggatcatgaggtcaggagttcaagaccaggctgaccaacatggtgaaaccccatttctactaaagatacattaaaaaattagccaggcatggtggtgagcacctgtaatcccagctacttgggagagtgaggcaggagaatcgcttgaacctgggaggcagaggttgcagtgagccaagatcatgccattgcactccagcctgggctacaggacgagactccatctcaaaaacaaacaaacaaacaa

SEQ ID NO: 173562 - DNA, 352 bp, Homo sapiens
tctttcatctgttgtaaatagtgctcttatgaatgtgggtgtacaaatatttggctggacaactgctttgagttatttaggatatacgtctagaggtggaatttcttggtcatatggtagctctatgtttaacttatagaggaatcctgcatgggctttcgagcaagctaactggctgtatgtgttaatggcagctcagcatggggaaaattgccaattctattcccaggccagccacactttggcagatgttccagatgtctagtggagagtcctaccccaatggccacacatgtgttttctctgaactgcctagtatttttcaaaaatttgggctgggcctgatggctca

SEQ ID NO: 173563 - DNA, 235 bp, Homo sapiens
cgcttttattggtcactaaaatcatatatgttttccaaagaatactgccattgtttatatttccctacagtttttgttttggggagtttggtttggttatagtggcagctgaagtgattttgagtgtttgcagcatgatgttaaattaaacccaaatgttttcaaaccctgggaaaccttttggaaacacccttgggggctttacaatttaaaatttgcctccaaggaaattcaa

SEQ ID NO: 173564 - DNA, 229 bp, Homo sapiens
tcaacacatccttataggctcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctggtggaagggag

SEQ ID NO: 173565 - DNA, 216 bp, Homo sapiens
aattcagacatgcttatcagaaagcaactgattaaagcagacagctattatttagaaccaatacaaaatttctagcctgactctgccctcttaccatataaaagacgtcagtgatcggtatccagggacattttgtatatccagggatctctgaaatttgtattctctgcaagttctgaaccattccttttttttttttttttcttttttgagatg

SEQ ID NO: 173566 - DNA, 150 bp, Homo sapiens
catttaatatgtgccagggattgtactaggtacatgtatgcacacacttactcaaagacacatgtatatatgctcacccagggatacacatgcacagatatttatctctgcaaccaatatttagagtaacaatctactttcatggaaaag

SEQ ID NO: 173567 - DNA, 246 bp, Homo sapiens
tacctgtaactattttgacatttttttcttacagagggttcgaagattttacaacctgaactattctagtgttttgttttgttctttaaaaaggcttgacaatgtagtcctagctacttgggaggctgagatgggaggatctcatgagcccaggagtttgagaccagcctggccaacaacatggtgaaaccccgtccctactaaaaacacaataaattagccaggtctggaccctcggcgtgtgca

SEQ ID NO: 173568 - DNA, 539 bp, Homo sapiens
ttcctgaagttacaaagctgttttctcctgattcaaggcatgaaaccttctcccactaagaaaaggataaaaggaataaaaaattagtggagatagcacagtacccaaatactgcacacctttgcatctccaatagggcctggcacagagccttaaagtagagaaactatggcactgtggaaaagaaaacatggtctaggaatgcagaggtatgggttcaaggagtattctgctgcccactgggcatataatttgggattttaccttttgaattttattttgttcactgataagcaagtctcagaagataaagaaataaaagtgttttgaaatctacaagtttctttgccaatgtaatacaatatatcagaaaattaatggctgaaatacagtctcagaaatgtttcaagtaatcaaataaagtggctctaaaacatgctgatgtatcacaatagcatagcacaatatttgagtgaggaaatcaatgaataaatagacagatgagtgcaaatataatgatttacccacacggctctctt

SEQ ID NO: 173569 - DNA, 517 bp, Homo sapiens
gtaactctatgttgtaacttcttgagaaacttccataactgttttccactactgatatatgagggttctaagggttctaatttctctgcatccttatcaactcttgttattgtctctccttttgattacagctgtcctagtaggtatgagccatgtcttattgtaattttatttgcatttccctaataactaatgctaaacagtgttttttcatgtgcttattggccattttcatttttattttttggagaagtatctattaacatttgtgcccatttgaaaattgggttatttgtctttttattgttatattttaagagttctttatgtattttatatactagacccttattagttatattaattgtgtcttagcctgttcaggcttctcacaaaataccacaaactgggcagcttataaacaatatctgtttatttctcatagctctggaggctcacaagtccaagatcaaggtactggctgatatggggtttggtgagggtactctttctgatt

SEQ ID NO: 173570 - DNA, 245 bp, Homo sapiens
cttgggaggctgaggcaagagaatgacttgaacccgggaaacggaggttggagtgagctgagatcgtgccactgcactgcagcctgggcgacagggcgagactccatctcaaaaaaaaatcagtaatcacattaaacataaatagtctacaaactccaattaaaaggcaaacactatcaaactggataaaagcaagatcccaaacacatgatgcctgggaaaaaaaaccactttaaacataaaga

SEQ ID NO: 173571 - DNA, 941 bp, Homo sapiens
gagatataacttgcacacagaaaaatgcatagttgagggtccaatttgatagattttgatatatacatacacccataaaatcgtcaccccagaccccatcatgagtatgtccatcaccctcactccttgctcacttccattccttcctggctcccatcctcacccccagcagccactgatctgcttcctgtcactccagcttagcttgcattgtctagaattttgtataatggactcatccactatgcactctgtttttggtctggcttgttttactcaacatagttattcccaggtcatcgatgttggcgtatatatccatggctcattccttttccttcctagatagtagtctattgtacgaatatgccacaatttgtttatgtgccgaccttttaacggacacttgtattccttcaaatgagggagtttctactttttgactacttcagatgaagctgctacaagtctttgtatggatatatgctttgttgtctgttgagtaaatatctaggagcggcatagctgggtaacatggtaggtgtatgtttcaacttttcaagaaatgccacccacagtgtaggagagttccagttcccccacatcctcagcaacaattgattatgctgagtgtttttcattttataaattctagtaggcatgcaacaaacatatgaaaaaaagctcaacatcactggtcattagaaaaatgtgaatcaaaaccacaatgagataccatctcacaccagtcagaatggcaattattaaaaagtcaagaagcaacagatgctggcgaagctgtggagaaataggaatgcttttacactgttggtgggagtgcgaattagttcaaccattgtggaagacagtgtggcaattcctcaaagacctagaaccagaaataccgtttgacccagcaattccattactgggtatatact

SEQ ID NO: 173572 - DNA, 449 bp, Homo sapiens
atgatcctctgactgaagttgtgtgcccagcattgagggtggctgctgcaatgtactaaacacactgtcagaagtgtgcaagtgcctgtgagctgacagactcagaggtgtcttttagttccattatctgtgttcacccttgctacagactttatgaagagggttgtgctccatccaccaggatctggatttgtccatctgtccatacaacgagggagcccttgtggagacagatctctccgggagcccagaaatcctgggtcattgccctgctccattctggtgagatctgtgacttcaatcagacaatctctctgagaatcagcttccttgtctgtaaaacaggaacgcttaatactgctctgtttactttatggggttgtttttaggattaaagaagataacgaccatgaaaagactttatacaccataaagtgtcatatgaatgc

SEQ ID NO: 173573 - DNA, 176 bp, Homo sapiens
ccatccccaccccactcgcctcgtcgacgttccgttgagaggtttctaatccctcccctgtgaacccagcggcgggcggatgtgcgtccagggagtgggcaagggtcccagcctggctgcccaggggcatccttgaactcagcagcctgctgtgagggtcagggcttggccgaaca

SEQ ID NO: 173574 - DNA, 1074 bp, Homo sapiens
agagaaattccccaaaactctttgggcccctttatcttcctaagtcacatctcagaaaacttctcactatttgtgaaatcgacagcccacatcacaagtacacccctgtgtcttttccttcttcaacttccccaaccagctgctctctgtagcatcaggatttggattatatcaattcttttgacattgcctcttttggatctttgttttcctaaggggagcccagtttaattgagtgtggatgttagtatcatacaatcagcagccagatggtccagagacagggattttgatacatgtggtctctgtccttcagaaggaagtgattgctgcttctcgctgtgtctgagatgctgtaggtattggcagtattaacaataggcctctcagtgcaaagcaaacgtgacatataatagagcacaatctcatcctgagatgtctttctcctagtatgcatcctccagccagcagagttctggagagaattctgagactgccacagggcatctggttccagttcaaattcgcaaagtgtgtaaatgagtgaactgaggcccagataagactccctcagaaagtaagttactggcagacaccaaaactagaggccagattactaaactctcattatagtgctcagttttacccacattctggatctagataattaaaatagaatgcataatcatttactgtatatctagtatattgtatagtagtgtatacataaatattaaaaattaatataaaaagtacatgaaaatacaaataagttaacataaagaaaagtctcaaagtggttataactgcattgacacatggaaggaaactgcttttacaagagaaaccaggagtcaaaaaagtgatgtgacctggggagagagctgctgtgacatcctcagaatttctatgactatgatagtaacccatgaaattatttgacatgtaagtcttgtgtattgagatatagtgcagttgcctagacttatggaaatactgaatgtggaggagaggatagccaatacccctcttccaagttcatttcaattgtttattcaactaatattaagcttt

SEQ ID NO: 173575 - DNA, 219 bp, Homo sapiens
tcacctagcagtggcacagggagcgtcagccacggccggtcacatgtcagccacggctggtcacaccccactccccgatccatcacctggcagtggcacggggagcatcagccacggccggtcacaccccactcccccagagcccgttcccaatggcggcactcccggagggaagacagccacctggtcagccaccatccccccacaaactgtcagccc

SEQ ID NO: 173576 - DNA, 494 bp, Homo sapiens
agaacaacctggccaacatggggaaaccccatctctactaaaaatacaaaaattagctaggtgtagtggcttatgcctataatcccggccatttgggagactgagacacaagaatcacttgaacctgggaggtggaggttgcagtgagtccaggttgtgcaactgcactccagcctgggtgataaagcgagactgtctccaaaaaaaaaatttagccaggcatcgtgttgtgtgtctgtagtaccagctacttgggaggctgaggtgggagaatcacttgagcccgggatgttgaggctgcagtgagtcacgatcacaccactgtactccagcctggacaacagagcgagaccctgtgtcaaaaaaaaaaaaaaaaaaaaaagcaatattaagaaaacaggtaacccaataaaaaagaggcaagtgacttgaacagacactttaccagaaactgtatagacagcaattgagtgcctcagaagctcagcagtcag

SEQ ID NO: 173577 - DNA, 716 bp, Homo sapiens
gtcatggttatgcaagtgtcttctggcctcttgcatagctgctgtatcatcaaatggttcaataagatattagacaacaaaagaaaagtaaatagtttctaattttcagctaagctaattaccaaaactttcagctgaaccaactatgaggaacagctgttgatttttatttctatagctcaaggaaactatggataaattacccaatgataatctttcctgcgtcctaataaaggaggcccaaatggaagatggttaagggaaaaacctatctaaccttggagcatgcgtacctggtttcgtgtgagccagagctccctaacatcaaaaatcccattctagatctgatggagaataatgttatcagtgtcattgttttgaggatgaataagagcctttaaattgacacacaggttattctttaaatggacacacaggttattttcttatttggcatacagcatataggaaaaggaggcgatgatatgagagttctggcaaacaggaagaggaagtggaaaggctactccttttgtctcagttgagtatgggaaggggaagaataacagagtggccacatgtgtacatcatggcatctgccttacaggccagaatctcagggatagggtggctaaataggttgaggggatgttggaagcaaagggacttctgcctgctttcttgttggaatctcagacacttgcatccacagaata

SEQ ID NO: 173578 - DNA, 260 bp, Homo sapiens
agagtcagtgctacctcaaaaggaagggaaggttactcagtgtccgggtaccagatgcagtgaaagaggtgtgcctcatggccaggaaactcaggtcagcgtcctggaagggatggttcacactcagagctggagtcaaagcagaatccactgggccgtcaaacaaatgcccagcacttgtttctgggcccatttaactctcactagcatgcttatgttttcatgtgcttctagaagtgtcattggacaggatgattttg

SEQ ID NO: 173579 - DNA, 282 bp, Homo sapiens
ctttactgtcctgccaactaacaggataccacagagttctgaagacttgtgttagaaaaaataaagtccacgtcattgtccccctaaagaaaaacccaacactttctttttgaagcaagaattcaaagaaagaccaattcaggcccaaggtgggtaacacctatttgggaacatggggagattcagcacctaaggaaggggtaatgggagccctgatgcaaaagtgtgctcagggtgtcacagatcacaccattcagattgtgatcaccctgggttcaagca

SEQ ID NO: 173580 - DNA, 551 bp, Homo sapiens
gaatgtctagataacagaaaaaaaaagttaccaaaattattccctcaaagggaaagtgtgctgatacttgcaatctaaagtacactgatatagtttagatatttgtcccctccaaatctcatggtgaaatgtgacctctaatgttggaggtgggcctagtgggaggtgtttgggtcatggagatagatcccttgtgaatggcttggtgcccttctcacagtaatgaatgagttcttactcttgagttcacatgagagctggctgtttaaagagcctggcatctctccttgctccctcactcaccatgtgacacaccggctcccactttgccttctgccatgattctaagtttcctgaggcttcacaagaagcagatgctggtaccatgctttctgtacagcatgcagaaccatgaggcaaaataaacctcttttctttttttgagacagggtctcactctgtcacccagggtggagtgtagggcactatctcagctcacagcaacctccacctcccaggctcaagcgatccccccacttcagcctgccaag

SEQ ID NO: 173581 - DNA, 196 bp, Homo sapiens
gtaatggctttccacagtaggtttccaggcttgaatatattcctgggtgaaatatttcagtcccacatcattgtcctggaagtcaatgcaaaatacagtctgcttgcctcatttgtcactctgaatcaaagtcattgccaagccaagcaatagctgcataataataattgcaaacatttatatagtactattccag

SEQ ID NO: 173582 - DNA, 530 bp, Homo sapiens
ggtttctatgatttaaggcagtggttgtgtagtaataaaagactattgtttaaggcaaaagtgttttttaaattaccactcaatgcattttttgagtagtttttgagaaagcattttaagtaacaagagattctacagtaaacatcaggtttttgctttagagttttgcccccagcatctattcattctctctttggttagtaatagcatcccgagtcattttgatggatttatccctccatcaggtgcagacctgggagatccttgtcccatggacctttctccaaaggactctgggtcttgactgggatggtgcaaggacagagacatgattctatttcattttttacaacatgccctgaaaagacagggcagtagttagatagtagatcctgctccctaaaactaccctctatctctctcaatctttattctgagcccagttttctggcctgccactagagtctgtgagcttcctcatgtccttataataaattccttttctgctttaagtgaactgcagtccaatt

SEQ ID NO: 173583 - DNA, 409 bp, Homo sapiens
ctgctctggagtcctattattcatcatcctcatatgactaacaaaagctgagttactgagaatttggcttcagtgcatacagatattctaccatttgataatcgagttgctaactaaatctgcatgaaacaaaacgtccaagtattcattctttaccagacttaaaagggaataaagtgaacgtctaatgaataacaacttctgcagggtctcaggaaaaggtaaaaactgctatctccctctcttctctctgttctaagatttttaataaggccacttctcttgctacatggggagagtgtgcagctgatcagaggccctgaatgttgcctagtcaagttcctccacttcattctgtataggccaaattaaatgttgacagacatcatcatccatcttttaactttac

SEQ ID NO: 173584 - DNA, 416 bp, Homo sapiens
tagcgttctagaggatcccagtgtgcatgtatacatatatacagatcagaatggaccctgaggtggtcagttatagtcagatatgccagcaggaactcatgtttacatgatacatatatacagatcagaatggaccctgaggtggtcggttatagtcagatatgccagcaggaactcgtgtttacatgatacatatatacagatcagaatggaccctgaggaggtcggttacagtcagatatgccagcaggaactcgtgtttacatgatacttatatacagatcggaatgaaccctgaggtggtcagttatagtcagatatgccagtaggaaatcatgtttacatgatacatatatacagatcggaatggaccctgaggtggtcggttacagtcagatatgccagtaggaagtcgt

SEQ ID NO: 173585 - DNA, 188 bp, Homo sapiens
acaactcgttgacatgcgccctgttgaccttcgtaacctctgaccctcacagtgaccttccgaaggtagccttcttcttcctatggaaaacaggcgcagagaggtgaggtgatccgtgcaggtcccccagcagagccaggattccagctcagactctcagaacaagcggtgaacaggaggctgggcaa

SEQ ID NO: 173586 - DNA, 266 bp, Homo sapiens
tcaggagttcaagaccaacctgggcaacagagacttcatctttactaaaaaacaaacaaacaaacaaccaaaacccagctgagtgtggtagtgtgtgcctgtagttctgagaagttgaggtgggaagattgcttgagcccaggagatcaaggctgcagtgagttgtgatcatgctactgcactccagcctgggtaacagagtaagattctgtctcaaaaaacaaaaacaaggccttgtgtggtgggtcacgcctgtaatcccagca

SEQ ID NO: 173587 - DNA, 350 bp, Homo sapiens
ttagcacttcatcctcctcatccttctttgactgggtgttcctggaaagctcaagaggaacataaagatccaacaggagactcctcccccaccgcattccacccaagactctgctcacatcacacttcacttttcaaaaaccttcaccagcggctgggcatggtggctcacgcctgtaatcccagcactttgggaggccaaggagggtggatcatgaggtcaagagatcgagaccatcctgaccaacatggagaaaccctgtctctactaaaaatacaaaacttgctgggtgtggtggtgcatgcctgtaatcccagctactcaggaggctgaggcaggagaattgcttg

SEQ ID NO: 173588 - DNA, 108 bp, Homo sapiens
tagagcaataatgtataaaattaggaaaagcaggcctgaagaagattcacactgtcttcagaggacagcaagggaaaaggctttaagatttttaattaagaaaaagat

SEQ ID NO: 173589 - DNA, 300 bp, Homo sapiens
tgtgaagggcaattcaccagctgtccaccttaacaggtgcaagaacaaagagaaagaagagaaatgatacaatagtgcatagaagttaatatgaaactgaggaaagctaagaaagataggtgggatgctaaaaactgaaaaacagtggggagattccttaaagaactaaaagaagattgaccgtttgatccagcaatcccactcctaggtatctacccagagaaaaagaaggcattatacgaaaaagatacttgcacacacgtttatagcagcacaatttgcaggtgcaaaaatatggaa

SEQ ID NO: 173590 - DNA, 260 bp, Homo sapiens
ctgcagtagtgcaacttttaagtacatattgttggctgtccgtagtccacacagagttacaactccatacttcaacaccatgctgacagttcctaaagaaaactactttaaaaaaaggcataacccggatgttcccttatttgaccaactccacctaagtttagatgtgcagaagggcttagatatatccggagtaagccacaggcaacatgttacttcatcagttttctaaaataaggtttcagggcaatgacagtaag

SEQ ID NO: 173591 - DNA, 385 bp, Homo sapiens
agcctgggtgacagagcaagactccgtctcaaaaaaacaaaacaaacaaacaaaacaaaaaacaaaaaacaaaaacggggacaatgattcctgcagtccaactattgacaatgtctcagtatgagtccaggtgagacgtgtcacctcccaaattgacaaggtcaaaagctaaggcgttagatgacagtcacggtattaaaccttcagggactgtgtagcgcaggtcacagcggcagctcagacttacagggaggctatttggggagtcagacgctgtcacttgttctggctgatgacacacaagcacccctgcaacgctgtcctttgaggcaactctcctttgggggccatcatcctgggggagaaaacgagggcaaagccaagg

SEQ ID NO: 173592 - DNA, 553 bp, Homo sapiens
tctcttggacttagtaaatattctaatatagcatttacatttctttgatgatttttttccacatatatttttacttgtatccttgttagttcctctaggaacttacaatgtactatttttattattatttttttttaagagagagtctcactctgtcacttgggctagaatgcagtggtgtgaccatggctcaccagaccatcaacatcccgggttcaagcaattctcctgtgtagttgggactacaggtgcgtgccacaatgcctggttgatttttgtgttttttagtagagacagggttgcaccatgttggccaggctggtctcgggctcctggcttcaagtgatctgtctgccttggcctctccaagtgctgggattataggtttgagccactgcacccagcaaaaaaccaactttttaaagcagaacttctgaagaaagataaatatgtattaatgttgactatgtgacagatgccatgctgtgtattacatgcttctgttcatttcatactccctagtaatactgataatttttttggatagtcatgg

SEQ ID NO: 173593 - DNA, 400 bp, Homo sapiens
tatttattgattcgttattttagtttctattagtgattttattggttatacacacacatatataaatacattatacatgttatgtattagttatacatacaccaattctttatcaattcattgtattgtgaatatccatttctttggtaggcagaataagggctcccccaaagatgtcctagaacctatgaatatgttacgttatatggaaaagggactttgtatctgtaattaaggtcatgaacactgagatggggaaatcatattgaattgtccaggtgggcccaattaaccacaagtctttaaaagtgaaggccctggccaggcacagtggctcatgcctataatcccagtgctttggaaggccaagggtgaggtgggaggctcacttaaggccagg

SEQ ID NO: 173594 - DNA, 498 bp, Homo sapiens
aacattttaactgtaacatttaaaaacttttttaaaaattcctgaaaatacaattaatttcacgtgtaagttaagaattttaggatccaaacatattttaatactatttttaactaattctttccttcatagtatattgaaaatcagtcttaagcacaagcatagccaatggtaacatgacttgacaacatgttggttgaatgcctacaaccactctgggctctgtctctaatcttccgtgtttgtctacccagtccttccaattacttgtcctcttttgactggtccaagactgacctgtgttaaactgaagccctcattacaataaggcatatttaagcaaaactttttaaaaagtgactttggctctttctacacaatattaaaactatcagctgaaatgtgaactccctggtcaattggtgtcatatagcacacccttcaaacacttttttttcctggtaatttcaaaataaaatggcattctgatgaaaaata

SEQ ID NO: 173595 - DNA, 165 bp, Homo sapiens
cagaaatacaaaaggtcattcaagacgactatgaacacctttacgcacataaactagaaaatgtagaggagacgaataaattcctggaaacatacaaccctcctatattaaaccaggaagatacagaatctctgaacagaccaataacaagcaacaagactgaaa

SEQ ID NO: 173596 - DNA, 328 bp, Homo sapiens
ggactgataataggcacatgtatcagaataacatgatggaggaatatgattcgtcaaaagtttgtcctgcggtaaagaagaaagagaaaatcctcaaatcaagctgcatggactagtttgtggcttcattgaggatttcacatggtcaccttggtctcagtcatttttcaagaggaaaatggggatctttccttatgcagaaaaaagtataaccagtgataaccagtttagattagataatactctgataatacaatgtatacaattgaaatgaggtaggcatttgttgctaagaacaggctagaaaggaggaagaggaggaagtctt

SEQ ID NO: 173597 - DNA, 379 bp, Homo sapiens
gtgtgtgtgtgtgtgtgtgtgtgtgtgtaggggatatgggatatggtctgtttggagacaggttttgattatgattttttatcatcttaaaagatccttcaactttgattcgtgaaagaaattttgtcacgattgcttgctctgcttttttgatctttactcccatgaagtttgggagagtactggttacaagttgggagtgatttcatacttacaaatagggactctgggtatcctctgaaaacgggattctcggcagtgggggaaacaagctctttaatggttaatgctgatagctgttgggtaagtttgtgaaactttgggtaagcggaaaggggccttctgtgattgggccaagatcccagaactctgagaggtt

SEQ ID NO: 173598 - DNA, 858 bp, Homo sapiens
cagctcagggcttttgtttttttgcctgtctggaatgtttgtctagctcattatggctgcccttttttcagctcagtgttcaacttgcatatttttttagagatggcttcctggatactgtagcaccccttctagtttgtttccttcatatcatcaagtttcatttcctttttaacatccttgtcactctctgaaatgatacttgttttcttgcttattttctgtcttctcacattaggatataatggtagaagccttgttggtctttttcattgccatatttccagaatctagaatagtacttggtaaagattggccattcagtaaatatttgttaagtaaatgaataaagataaccaaattacttttccaaaatgatataccagtgacttgggagactggattagttctggtgggaatggtttggttcccaagagagcaggtggttgtaaagcaaggatgccttttgtgtttggcctctttgtactgtctgcctcccctttgatcttctgccatgttaagacacagcaggaaagcccttaccagaagccgagcagatgacagtgccatgccccttgaaattcccagcctccatacctgtgagctaaataaactctttttctttatcagctacccaccctcaggtattttgttatagcaacaccgaatgaattaagatggcattattctcaattttgggcaaaatatttagctaggcttcaacaggtgacctggcagggtggaaagaagactttgattctagttctagccctgccagcaataagcttggtaatctaggtgaagacattgtctcagatttccagattttttatttgtaaaatgaaataattattgtcc

SEQ ID NO: 173599 - DNA, 336 bp, Homo sapiens
tatgcaaggcagtaggagaaataggatctccattcatctgaggtgaactatttagttatgtcccaagtgtacaagggatgtgaaaagtaaatggccatacattcacttacccagctattaagagtaagaaactattaactggggctacatactaatagcagcagttctctaaatttttgacaacattaaatcagcccttttcttctatacagacctctttctaaaagctagtttctttagagagtacaattgaatttctttttttcttttttttttttttgagacggagcctcgctcttgtcacccaggctggagtgcagtggcacaatctcggct

SEQ ID NO: 173600 - DNA, 491 bp, Homo sapiens
agtccccttgcaaaaatcacagttttcatatttttgcattgtatctccaagctaatttcaggcatcccaaccaaaacgtacatcaagagattatataattaaaattaggcaatcctttgtctcttttcagtgtaacagatttatcttaccacaaatatcaaaaagttattccaatcttggtaggatattgccatactaaagtttaaggtttttgaatctgacacctgacagatgagaaaagtgattagctgatcgtgctttctgagttttgaactgcagaaaacttccgataaaattgtaaggacatcaaatagtaacagtaatactctcttgtttagttgtaaaatgttctctggaaaatattggagaacgccatttaagactggagaatatgttgcaactattttattaataatatcctgagtattcttttagtgattagaatctagtcaatgtatacatttctattgaaaaggggttaattttcatac

SEQ ID NO: 173601 - DNA, 387 bp, Homo sapiens
tctattactgtagttacagaaatatctttacaaataatgcagtgcagaacaataagacaaatgatgccaagaataaagggcccctccttgaaaccagagggcctctgcaggcccaaagaggacagaaggcaattaggacttaggtgttggggggaatggagagaggttttcttattttccttttctgccattgctaattttttttaatgtgtatgcctgagggtgagaatcaggagatttatgcattaggtggatgccctcctttgcaaaatggacaaaagagtcagcttgcggagcagattagatggaagaggccaaagagcccaggggcttcaagctccaaccaaatgggaaagcaatgagtgggcgagggtcagggcaaattca

SEQ ID NO: 173602 - DNA, 274 bp, Homo sapiens
attgaagactcacttaacgaggaagtcatggtacaaatacttggtagcctcatgacagaatgtattggaaatacaagagaacacttcttcaaggcaatgccatctgcataaagactatggatgtggaaagtgtatgattcttactgagatttatagacaagcagctttctcccaagacagttcttcaggccctttcacactgaagcatgtgagcctgaagtgtttcagagttacgtttcattatgatcctcgtatgctataggagctttggccc

SEQ ID NO: 173603 - DNA, 189 bp, Homo sapiens
aaatctccatattgaatagggaggtcctgattgccaacattatttattttggatttggggattccatgattcagtagccatagtcacattgccttttgcctatggttgctggacttgctgtcctattctcaagaaaacaacatattctttttgcttttagaagagtgaggagaaatcaggatatcattt

SEQ ID NO: 173604 - DNA, 463 bp, Homo sapiens
tcacattggtggcccagaaatcagtctcagcccctcccagtatggaccgctccttgacagccgccctctttcttataaaggcagatgcaagctacgtttgtgtggggatgacacagcacaaaggcccttgccagatgtgagccccttgatattggatttcccagtcttcagaactgttggttaaattcctgagagatggatctttcagtctcctgctttcacagtatatgcctggctgtttgcatcctgagaaccaagcagagcaaggctggagaaacagcattcatgatgtgaactgctaatgaatttttctgcctgtattaggaaatcctcagcctcaaatgtacttagtcttctagtaaagagattgtcaaatttccttctccagagaagccactttagtattcttgcagaatagggaaggggatgggacccaacttcttaagtaaactttcaaccaatc

SEQ ID NO: 173605 - DNA, 348 bp, Homo sapiens
  misc_feature (215)..(215): n is a, c, g, or t
gtgtcactgtactggtacattacaaatttcagggaacagaaatccttaatgaaggcaacaacttcagttactgtattaagactaactcttaatagatttctcagactaaataatgataatatgaacacacctgagattactgtgtctgctttccattaatgcaaacaccattctcataaccattaagagaaacctgtattagcatttgaacaacntgtgatattgatatgaaaagatccctgctaaatttcttttctctcattaggacatctaattgaaccttttttttttttttttttttgggaaacaaggttcccctcgtggtggcccgggcgggacggtggaccc

SEQ ID NO: 173606 - DNA, 383 bp, Homo sapiens
atgatgcacatacagctccactacattatggcaatgctaaaaataacctgagaatgaaggagctttatttcttcatttccaatgacccatgagcctcctaaaatgcacagggaaagatgtctacccccaccacaagcacctgttcatgaggtcacctctgttcaaaataccgaagtcaatgaaatgtcagtggcaggaagttctggaatatacagattacacgagcccatttccctgcagtaccagagcagcaccacgaattcgccgagcagcagcacgaaatcgccgagcagcaccaggaattcgccgagcagcaccacagcagcaccacgaatacgccgagcagcaccacgaattcgccgagaagcatcacgaattcgccg

SEQ ID NO: 173607 - DNA, 517 bp, Homo sapiens
gtacttcttgatgctgccacgtgaagaaggacatgtttgcttccccttccaccatgatcctaaggcctccccagccatacagaacttccccaaactacaaacacaaaggaagctcccatggaatcggatgatggcactgtacgaatcaagatgcagctagcaataaaaacagaagacaccaacaccagcagtccagagacctccagtataacataaagtgttcatagtatcctgaggattccagtcacacaggctcaaacctgaggatcaccccggatccttcctctccgttgtccggaaaaatcctacctcctatcctttctaaccctccatcccactgtcactcctctaattcagaaatttctctcctttcttcccccatgcaccccaatctcatatagtggtgtgatatgatttggctctgtgtccccaaccaaagctcatcttgtagttcccataatccccatgtgttatgggagggacctggtgggagatgattgaatcatgagggtgggtc

SEQ ID NO: 173608 - DNA, 797 bp, Homo sapiens
ggacacgtacagcttagagcctagtcatgaaatgggaaataaacagccccatcctcaaggtctgaacaggggattggggagcacagagaagggccccaccccgaccagctgtcaagagaactatccatacattctaattcctccaaggttgagggctaaggtgtaggaagaggagagaggttccaagcagaaggaattgcagaagcaaaggcacagaggcatccgggacctgcgagcagctatggctggagccgcgtgtcgcaggatggagagcgtgtgaacagaggggactggaagcggatcctcccaggaagcagttgcaggcggtcatgctacatttgcagggagacgggaggttgtgaagaacaataaccagaagagagtttgcgtcttcatcagaaagcacctggggcaggtagagttggtgctagcttctccatccatccctgacaccccagccccattcatcattcagcagaagacaggctgggctggcccaacttggtcctgtacccccaccacccagaaccccactggtccatagtgaggatcccttctctttgactctcctccttctctgtgactcgcctaagcctgatcctacaccttctctcccagcactgcctcagttcctccacccccagttgggacgagccacctccctggctgggtagcatgggacaagccatctccctgcagaggcagagaaccagtgacactacacgcaaaccaaggccatgctgcaaacagaacaccaaggcaccctcgtcttaggatgcattatattcggggtagat

SEQ ID NO: 173609 - DNA, 723 bp, Homo sapiens
  misc_feature (610)..(610): n is a, c, g, or t
  misc_feature (618)..(618): n is a, c, g, or t
  misc_feature (631)..(631): n is a, c, g, or t
cacgtctcgcgagattttggcttcctcttagccaggtggcgggaccgtttgctgtgccgatttagctgccgccgcgcctggagtcctgaggaacttggctaggctggccccgagcggaaccagagaatgctgaggctctaaccatggaatattcggaatgtcccattctatgaaggaggtttgctggctgcaacaggaatattcatgaacatggaggggttggtcatgttccaggatctgtctatagacttctctcaggaggaatgggagtgcctggacgctgctcagaaggacttatacagagatgtaatgatggagaactacagcagcctggtctcactaggtctctctatcccaaagcctgatgtgatttccttactggagcaagggaaagagccctggatggtttcaagggacgtgctgggaggatggtgccgagtagagttggagtcttgctttgttacccaggctggtcttgaattcctgtcttcaagcaatcttcccaccttatgaatataaagaatggcccaccttgtcctctcaaagtgctgggattacaatcatgagccactgcactccagcctgggcaacagagctagactctgtgtcnaaaataantgactagataaanaaaaaattgtttgagtactttccccgatttaggagattggacggggtccttctattgcgttcaagaaactggaggttaggaaaatccttagc

SEQ ID NO: 173610 - DNA, 211 bp, Homo sapiens
ctacatgctgcatgtttccatttgtatgaaatgtccagaagaggcaaataaagacagaaagtagactagtagttgcctagggctgggagggagttaggaggaatggagagtaattgataatgggtaaagggtttcttctgatgtataaaaatattctagaattgactgtggtgatggttactcctatctactaaaattactgaattgtgta

SEQ ID NO: 173611 - DNA, 486 bp, Homo sapiens
ctgaggttcctgctcagctctttcccagaatcatgtgacaatgaacaacaccacttaaccctttgcttcgtagtgtagtagctggttattattacccttattattattattcattattttgaaaaagtacttcatcctctttctacatcttggctttggagatggtttggtggcctctccttgccttccaatcactacttcttggaccctttttgtggctgttactgctaacactcttacataaatgcatatgtagaaatatatttccaaatagtacacacaaagcaaatgcatatatcgtaatactgtacagatggtgaaagcaatggggttcttgacactttcataccatttcatagttcattccaaaagccagcaggctggccaatcatccccttcaccaatcccagagtctctgatgctcagccatcatcaacacaagaagcccccaaatggcatcactgtttttcccatttactaaatggt

SEQ ID NO: 173612 - DNA, 506 bp, Homo sapiens
tttgttggggatacttatctcgggtgagcaattgatggggctccgcattagaaaggcaatatatggctcaaggagaaatcctgggctttggagtctgatagagctgtactcaaattctaacttttccaatcattatgactttcagtaagttgtcactatgtaattgagtttttactaaatgtaaaacaaagaattacggcacagtcaacgtagattaacctgccctaggtcacatagtcactaagggtgaatatatatccaggtctgcctaattgctaagcctgtgcctacttcctggtggatgttccatacataatagttccttttaacattttccttttatttatttttaattttttactttttattatagtttaagttctggggtgcatgtgcagaatgtgcagttttgttacataggtgtacaagtgccatggtggtttgctgcacccatcaacccgtcgtctacattaggcatttctcctagtgctgttcctcccctagcc

SEQ ID NO: 173613 - DNA, 2687 bp, Homo sapiens
  misc_feature (1228)..(1228): n is a, c, g, or t
  misc_feature (1697)..(1697): n is a, c, g, or t
  misc_feature (1735)..(1735): n is a, c, g, or t
  misc_feature (2371)..(2371): n is a, c, g, or t
  misc_feature (2376)..(2376): n is a, c, g, or t
  misc_feature (2415)..(2415): n is a, c, g, or t
  misc_feature (2496)..(2496): n is a, c, g, or t
  misc_feature (2498)..(2498): n is a, c, g, or t
gggaacagagcttgtcatgaagcgggaggggagggtatgcgtcagaaaagaaatgacaggtttgaaatctgcagaagctcgtctttcctctccgcctctcctccccagccggccccgcccccacctggcttcctaaataaagaccttcctctgcatggagaccgcctcactcaaactcaccccctcgtgcatatgcagagtctcaaaagacacggccccgcccccgccacagcgagggtctgaatgggaggtttggaggagagcatctgtgtcccagacccggcggtggggggcccagggtgctgggcacatcttctggaacccgggctcgccgaggcaggcgagagctgtcccctcgcctctgttggggatgcctgccaaggttagccatgggcgaggccagggacagcgcctgggtggtgccaaggggactgtgagtcacctgtggataggagggctgagtgaggaggggacacgggccctgggcctcaagggcaccatctgaagatcccataaggatgaggacaggggaggccagagggcagaaattcaaggcaacggaacagctctagatgggggatgcccctggcatggggtgggtggaggccagggacgctgctcggctccccgcagtgcccaggacagccccaccccagagaatgatccggccccaatgcccacagtgccgagggggagaccctacattcatctggaaaaaaatagacttcgatcccttctcactccagacaccaggataaactcctgatggggaagacggtataaaccaggggggccccccagctcctgggattctcctcctccctccgccccactcaggatgtggatttcaatgtgtgcagcctcctgggacctcagcagggccgaggatcatgggactcagatcgatccctcatctgccctgctgcggaatttcccagctctgtgtttgtctgttgcaaatccccaggtttgggagctgagggtctggctgtttgtgtccttgggcgctgcttggagatactgggctataaaatctatcagccttttcagaattacaagcaaaaataacaaccagcaccttaataaccctagaagatgcatgccttcgacactgtgggtgaggcctggtttttgttttcagtttctattatttattttattttattttgatttatttatttgagtcagagtcttgctctgttgcccgggctggagtgcagtggtgtgntctcggttcactgcagcctctgccttctgggctcacgtgatccctggagccaccatgcccagcaaatttttaaattttttgtagagatagggtcttgctatgttgcccaggctggttgcaaacttctggcctagggtcttgctatgttgcccaggctggttgcaaacttctggccttcagcaatcctcccacctcaacctcccaaagcactaggattacaggcatgagcccttgtgcccagcccatagtacaatatctttagctggttcacaggctacagtgacatctctcagtgtttccaacacagctgaaactatgtatcctctgacccccatctcccccttcctttccctcctctaccactaaccgctcttctgctttctgtttctatgtatttgggaggttttgattgtgtgtttgttttgagatggagtctcgctctgttccccaggctggagtgcaggtggcncgatcccagctcactgcaacctctgcctctcgggttcnagcgattctcctgcctcagcctcctgagtagctgggattacaggcatgcaccaccacgcccggctaattttatatttttagtagagacgggctttcaccatgttagccaggctggtcttgaactcccaacctcaggtgatttacccgcctcggcctcccaaagcgctgggattacaggcatgagccaccgtgcctggctgtatttggggttctttgcttgttttgtttttggactccacaatacgtgggattacgcagtgtttttctctctcagcgtctggcctatttcacttggcatcgtattctccaggttctacaagggggaattttatggcatgcgaatattttaattttttttttttgagacggagtctcgcttagccgtccaggctagagtgcagtagtgcgatcttggctcactgcaaccactgtctcccgggttcaagcgattctcccatctcagcctcccgagtagctggcattacaggcgcctgccaccagacctggctaatttttgtatttttagtacagacggggtttcactgtgttgcccaggctggtcttgaactcctgactcatgcgtgtcatcccagcactttgggaggccgaagcaggtggattgcctgagcccagganttcangaccagcctggccaatatggcataacaccatctctacanaaactacaaaaattagctgggcgtggtgatgggcacctgtaatcccagctacttgggaggttgaggcaggagaatctcttnancctgagaggtggaggttgcaatgagctgagatggcaccactgcactccagcctgggtgacagagtgagactgtcttaaaaaaaaaagagagagagagagagagagaaagggagagagaaaagaaagagaaagaagaaagaaggaaagagagagacaaaggaagacagaaagagagtaagagagagaaag

SEQ ID NO: 173614 - DNA, 661 bp, Homo sapiens
  misc_feature (24)..(24): n is a, c, g, or t
tgcaacctctgcctctcgggttcnagcgattctcctgcctcagcctcctgagtagctgggattacaggcatgcaccaccacgcccggctaattttatatttttagtagagacgggctttcaccatgttagccaggctggtcttgaactcccaacctcaggtgatttacccgcctcggcctcccaaagcgctgggattacaggcatgagccaccgtgcctggctgtatttggggttctttgcttgttttgtttttggactccacaatacgtgggattacgcagtgtttttctctctcagcgtctggcctatttcacttggcatcgtattctccaggttctacaagggggaattttatggcatgcgaatattttaattttttttttttgagacggagtctcgcttagccgtccaggctagagtgcagtagtgcgatcttggctcactgcaaccactgtctcccgggttcaagcgattctcccatctcagcctcccgagtagctggcattacaggcgcctgccaccagacctggctaatttttgtatttttagtacagacggggtttcactgtgttgcccaggctggtcttgaactcctgacctcaggtgatctgcctgccttggcctcccaaagtgctgggataacaggcatgagccactgca

SEQ ID NO: 173615 - DNA, 596 bp, Homo sapiens
gattccgcttatatatacaattctagaaaatgtaaaataatctacagtgacagaaatgagatcaatggttggaagggagggagggaaagattacaaagggccacaagaaactttgggggaagataaatatgtctcctctcttgataaggataagcttcatgggtgatacataaaattaaaacttatcaaaagtatcactttaaatatgtacagttaactgtatgtcaattatacctcaataacaaaaaagaatccaagatgccaaaactaattctacagttcctgttagatctatctgctcataaatatatttaacctaccgacttgcagtatgcactctgagaatacaaaattatgcctaaattgaggatcaccattatcacaaaaaacatcaaagtttaaacaatgaggaaattagaattcatctttaatcactatgccaggctatttcagtgccaaaacgataccaactaaaacacaacacaacaaaacaagagcccgctgagtgtagggctctgagatttttaattaaatattttaattcaaatgtttaccttctttgatctagaatcccatttcgggaaaacagaaataac

SEQ ID NO: 173616 - DNA, 543 bp, Homo sapiens
ctcaggttacaaaatcaatgtacacaaatgagcagcactgctatataccaacaatggccaagctgagaaattaagcactcaatctcttttataatagctacaaaaattttaaatacctaggaagatacttaagcaaggaggtaaaagatctctacaaggagaaatacaaaacactactaaaagaaatcgtggaagacacaaacaaatggaaaaccatcccatgctcatgaattgaatgactcattatcatgaaaatgaccatagtgcccaaagcaatctacagagtcaatgtacttcctatcaaaatatcaatgtcgtttttcacagaattagaaaaaacatttctaaaattcatatggaaccaaaaagagtccaaatggccaaagtaattctaagcaaaaagatcaaatctgaaggcatcacattaccggacttcaaattatactacaaggctatagtaaccaaaacagcataatactgctataaaagtagacacattgaccaatggaaccgaagagagaaccgagaaataaaacctaatat

SEQ ID NO: 173617 - DNA, 622 bp, Homo sapiens
acagaggactcgctgggatgcggctattcgctaactgtatatctcctttagtaaagtggatgtctaaatctatagaccatttaatagagttatttgtccttttatttattcatttattttaggagatggtgtctcactccctcttcacccaggctggagtgcagtggtacgatctcggctcactgcagcctccgcctcctgagttcaagtgattctcctgcttcagcctcccgagtagctaggattacaggcatgtgccaccatgcctggctaagttttctatttttagtagaaatggggcttcaccacattggccagtctggtctcaaactcattacctcaagtgatccacccgcctcggcctcccaaagtgctgggattacaggcgtgaaccaccattcctggccaggaaatgactttttagtgggaatatttgaggttcctggcttcagagtgacaatagctctttaattagtaagagttttttttttataaaaggctcatatattcccttaaatttgctgtcttacgtgcaaacattaaagaaatggctttcagaccttctttgtcactttgaacccattgtttctttaacatcaaggagagtactcttcagtactga

SEQ ID NO: 173618 - DNA, 526 bp, Homo sapiens
tttttgtacagacatggtctcactatgttgcccagactggtcttgaactcctagcctcaagcaatcctaggtgtgagccatggcacatggccacaagttttaccaggatcccacagtgaaaactggagaaccccctgccccgtgattctggcaaaggggaggaggaaagtagccactttgaaatacatccattgcattctgttctcactctgttgcccaggctggagtgcaattcattgcaaccaggctggattacagctcactgcaacctcaacctcctgggctcaggctgaggcaccagaatcgcttgaacttgggagacacaggttgcagtgagctgatattgagccactgcattccagcctgagcaacaaagcaagacattgtctcaaaaaacaaaaaaaacccactgtaacagaaatgatgaatgtctgtgatgggctcatcaatagactggacatggccaaagaacatggtgcgcttgaagaaatgtcaacagaaatttccaaagctgaaatgcaatgag

SEQ ID NO: 173619 - DNA, 563 bp, Homo sapiens
gccagttacatcactctgcctcaattttcctcatttgtaacatgggcctaatgatgctttctcacgggcaggctgggaggctagtgacaatgtggaggggagcatgacctgtgagatcagcctgccccctctctgcaaagaaaccagaagattggcctcttgaggacaggagtggccaaagaaagaggctggaatttcgtcatctggtttcctcccagatccagctgtagggataggataccagtgggcccagtgcagctcctgaaggaggaagccagtacccaaggaagactggccccagggctgtctgaccccagatttggcacttattcccaggagcagccaggataggggccgcaaggaagaggtagctgtgctttagatcagagccaggctgccctggatcatcacaagctgggactagatcagagcaggcagccctgttgagaagagggctggaaaccgaacctggttctgtggcctagggacagagccaggtggggcaggaaggagggaaggggtcccaatgaggtgggttgaaataaaccagaattaacattcag

SEQ ID NO: 173620 - DNA, 155 bp, Homo sapiens
gggctctagactaagtgcccagctgcctcctggctgtcaggcacatttgcacctttgcctgtgctgtgatgtaggctcagccaagcatgccttccaccctcctcccctcctattaaaatcgtgttcacacagttaggacctttctaatgcctctt

SEQ ID NO: 173621 - DNA, 511 bp, Homo sapiens
catagaggaccccagggcagataacaacagtgtcttaaggaggtctattagaactttagctaaaatacttttatttttaaatgcaaccaaaaattataggccataaaccaatctcatgctgattgtagtatgtgtgtgtaatacattgaaatgtgagagaaacccaacaaattaatcaggaaataaggaatgaacatacattaggtgccatttatgtgctagtaactattagataccttttattcagtaactcattaaatcctcgtaacaactaccaagactagcctaccaaatctagatgaaaaaactaaggttcaatttccaacatcacaaagctgggtaagagaaaaattccatgcccttttcactgtataactagtacctccctaaataaaataatttaagaccttaaaagttcaaaatacacttttttttttctgtaaccaactaccatttcttttctttctttttttttttttttttcaacagaaattactgtaactgttgaatt

SEQ ID NO: 173622 - DNA, 154 bp, Homo sapiens
tatgctggatattaagcctgctatggtgtgaatgctgatgtccccccaaaattcatgttgaagtgctaacccccaaggtgacggtaataagaggtggggcctttgggagatgactagtggaaagggcagaaccctcatgaatggaatcagtacc

SEQ ID NO: 173623 - DNA, 310 bp, Homo sapiens
gcacttttctccctgtgggagcattaggagcaaggttgatattcagtggacaagttcagtggttgaaatgtcgaagttctccactgtgagattggacgtagcttcagcccatgctcccgagtcccctccttcccaccttctaatactgctattccaagccccgcttgatccagcaaagaaagtgttaacaattggcaccctcaccaccaccccacccaagcccaacatctgttctgacttatcagtatccaggcaatacctggggttaaatattttgaaacgacacccttctttctatcaggtttaatcc

SEQ ID NO: 173624 - DNA, 331 bp, Homo sapiens
ctagtgaaattccaacctagtctttagaagtttcactagcatcttacttgttaatgtaaacaaaagcatccatcaatgtgtatgtcagaatcacacttggagaagtcggctgctaagcatttaccaggagcacacaccactgggcttccatgtgggattcctcgtttagtccaactccttttgcttctcaaaaccaattttcgtctcaggacacttctcccatcagcctatgcattttcttcttgccatcgttcacaaaggattaggtcttatactttaggatgtttccctcaactctgagacagacgtttgctaaggcacttctgacatt

SEQ ID NO: 173625 - DNA, 205 bp, Homo sapiens
atgtgctgccgcacacatgcttgcccacctccacgtgtgacacggcccgtgtaccactccctgttcacacgcacctccacgtgcttcctgcttctgccagacattaaatcttggtgcatattattacaaaaaaaggatcactagatcaagaggaaggaacatgcatttgctagcataccatgtgttccaagatggcgtcaattgc

SEQ ID NO: 173626 - DNA, 266 bp, Homo sapiens
aaggaggccatgaagtgctgagtcttcagagtgcttaaaatcagtttcagtgtcagtgtgaatcccacactctataattacttggtcaagcttcttggctgtcttgggtctttactggttcctcagtaaactagggagccaaacttaatgattatttaaggtctctaaaattcatgtctctaagctgactgatgagggaaatgccagggattccttactacagttcaaacataagtgcattataatatttcatgaatttcaagtaa

SEQ ID NO: 173627 - DNA, 218 bp, Homo sapiens
aaaaaatctccaggtggtgtctctgcatccaccctcaccacccaggatctggtttattccgaaataccagttttaacaggatcaatgtgagtgctaagcagatcatgtctctcctctactcaagacactccagcagcttcccaactctgttctaataaaatccaaacttgtacagcactctacatgatctgtccaacccccagagctaggagctaatc

SEQ ID NO: 173628 - DNA, 535 bp, Homo sapiens
gtgttgggcattccgcttgcttctctgctccacgcgacaggtgcctaattttagcttagcttttcccagttaggtgtccttggcagtaagcttgttacctactgagcagctggctgttgtatgctctctgtaacctagtattgtgaatatgatgctcaaaatgatcctgcaaagctctaagttacacatggccactatgatggcaaagcggttttaaacatctgcacgtttctgaggtgaacacagcttttcagaagataagcattattagagagacagccttccccaaaaatgtatttaaatctcaacttgtagaagcaaaagaggcaggcaacaactgcccagatgtgggagttacaaaatgacatcacccacagatgggacttgacttggaaggcagtgttaaaatcctctaggatctgagcacctctgggtgaggtctgagtactgctcaggtcccatgggcgtggttaggcccgaggctcacacacttttacagaaaaagcgtctggacctttctgaggtcctgagagca

SEQ ID NO: 173629 - DNA, 116 bp, Homo sapiens
tagtttttggatcctcaacttcctcccagcctccaccctcgagtaagccttggtgtctcttggtcccctctgtgtccacatgtacttagtgtttagctcccacttggaagttagaa

SEQ ID NO: 173630 - DNA, 328 bp, Homo sapiens
ccttccaattttccagaaacatgggtttttttatggcttcattttcctgtctttctgcctaaagagcagaggggctcgtggccctgaaacaggctccttccctgcctgactccatctgcaggaaggagaagcacagcacactcagctcaaagggaggtgcctcctcccttgaagaagcccatccagaggttcacagggagcagatgagagaagagttcttcctgctccctgggccaaggggaatgtggacctgtcccctgcttgtgacattttccccaacctgtcaaatgcaagagtagcaaatttggaagagtagaagaaggcagtt

SEQ ID NO: 173631 - DNA, 314 bp, Homo sapiens
agttgcaactgcctaaacagaacagcttacaagaggacacagagtctagtgggccgaagggttaggtatgcaggcctctgcattgcacataataaaattccagacttccagaaggacaaaatgtacattggtgcaaaaagtttcttttctgtcttttttttttttttttttaaatttaaatatagagataaggtcttactgggttgcctaggctggtcacaaactccagggctaaagcaatctgcctacctaagcatccaaaagtcctggaattacaggcatgagccaccatgcccagtctgtgcaaacagttt

SEQ ID NO: 173632 - DNA, 604 bp, Homo sapiens
cgtcgtatacgacgtacgcgatgggagcatttgaatttccttattgacgtacttattttcctgttttggacatttcatataaatggaaccatgtctttggtgatctctgcatctgctctcaccgggcagaacattctcaaggcacatccatgtgtgccatgtgtcagtgctttacccctttttacggcccagtaatagtccactgtatggatgaaccgtattctgtttacccgtttgtcagctgatgggcctttgagtcatttccatcttttagctattaggaataatgctgttgtgagaatttgtgtgcaagtttttgggtaaatatgtttgctgggtccaaaggtaattaaccttttgaggaactgctaaacttttccaaagtggctgcaccattttatcttcccattggcaatgcatgaggactgattcctccacatcctcaccaaccctgcggttcctggtttgattcccgccgtactcgcgggtgtgcgcggcagcctgtggctatgctttgcccttccttgatgactagtgatgctggccatctttgcacgaaccaatggcccatttgcttgctgccagtccctggagagatgtccaa

SEQ ID NO: 173633 - DNA, 400 bp, Homo sapiens
  misc_feature (375)..(375): n is a, c, g, or t
ttgtaacagctttactgggatatcacccacataacttacattcaaaggttttattatattcgtaaagttgtatgaccatcgccacaatcaatttctgaagattttcattattctaaaaagaaactccacatccctcagctgccactcctggttcctcccagccctggcgatcactcacccaccttctgtctctagattttcctgttttggacatttcatataaatggaaccatgtctttggtagctgttgtaatgggtaacagattgtttctaatagatgagaacataaatttaatagttttcatccttttttaaagtgtgtgcaacaattaatatgcctgccttatttgaggacatgataaaatgtacccccanaaatgacttcgaactgtctaatgcc

SEQ ID NO: 173634 - DNA, 435 bp, Homo sapiens
agggagagcatggacgatagtgggtaacataaggggaaccggcaagatggaaaagggccaggaaacaaaagaattcaaggaaaaacagaaacagaagttaaactttgtgttccaaccccaaagacctctagaaagctgtgggatgtgatggagctacacgttctatgcggcatatgagaatcataccaattttctgtcttttagacaaaagaataaatgtgaaataggaaaaagggagggaaatgagatgggaggagggcatcaccccctttaatgctgtaccaaattactatacaaactgaattgttgtaattagaattatggacagtgtcttatcatttgtatgttaccagaaacctgtgctatgacttttaactagaaaaacaacaagggatgatggatctttctttggtcacattagcctctgtaagttac

SEQ ID NO: 173635 - DNA, 1084 bp, Homo sapiens
  misc_feature (900)..(900): n is a, c, g, or t
gagacacacgagtagaatagggggacaaaaacatcttcttttaacaagatgggtgataaaggaaaacacaattaaacatgaggatagggtgttttctgtgttaaagaaatatatatctccaaatataaaatagaggaacaagaggtgagagcagaggaatggttgtggccaaaagttttaaaaccacccgggaaaaaaaaaaaacccgtgttaccaaaaaaaaaaaaaaaaaaaaaaaagattagaaaattagccgggtgtagcggtgcatgccccgttgcccttgctactcagggaagctgaggcaggaggctctcgtgagccaaagagtttgaggctgcagtaagctatgatcacatccctgcactccggcctgggcaacaaagcgagatcccgcctaaaaataataaccagtaattctattataaacatacaaccaaaaacttcacggtttaatacttttgcacagaggaccaatgaagggttctatagaaaattaggttttttataaagtgtgctgatttaaatattattttcaaacaacttttttttttttttttttttccccaaactttttttcctttgatggctaacccaatcttcatttaaccttttagatgctgggaccagatcactgtaattaaaccacatttccttttttaaatcccccaaatgttttaacccccaggtatatacagaaccctctgcgtagggaccttcaaaatggcgggatacctcttatttacaaatcttttcccttttagggtcctttttacccccaaaaaaagaaccccaggggtcaacatggggggcactataacatctccttcttttccccatgtgggtcttgtatagggaaacactttcaaacactctggagaaatgggtcggtctctccgngtggtcaacaagggaaaatattcctctgcagaagttaatttcgggaccccaagggtctgagagcgcagggatttcgctttgaagcgccaagatgttctttaagaccacggtcggggacaaccgcaaggaaaatcctcgtggggttcccaaacaataaagcacagacacgacacaaaaaaaccct

SEQ ID NO: 173636 - DNA, 154 bp, Homo sapiens
tacaaaagtcctgcattataaaatagggtagaataaatcagtgtaatcaataaaactatacaacaatacaaattacatatcttctgagcgggcagtttattctctctctttgcagtcatgactacaacatgctcactaaaaacaactaaaactg

SEQ ID NO: 173637 - DNA, 656 bp, Homo sapiens
tacatctccgccttacaatcacagcttgttagatctggcagtgagttctcagttctgcatcataaggcggagcccccgggctgacatgctgctctatgtacccatttcattacagacaaactatccagtgcaccaccaactcctgggacctaggacatgcacacagctgtgagccacactccagaggagtcagccatcagcccagtgaagagcaaggccagtcgacaggaggggtggcgcgtgctgaagacaagggaggcggtcctgcatgcccatcacaggggcatggcccaggcagccaccatacatgccagaagggctgaaacatctgctctctgccctgtcttgagtgaggaaatatgaaaaagaaaaaccaccagaaaccttgcctgttttgagctcaaattttccttatctatcaggaaggcagcacttccggtaacagccacagctgaggtttccagccctgcttggctccagcctcaagtgggagaactatgtgaggtatgaggtccccgcagggcagaggcaatggaacagagggagcagtggcaccccagtgagggaagccagaagtcttccgtgctgaacatttttccacctacaatcacagcttgttagatctggcagtgagttctcagttctgcatcataagg

SEQ ID NO: 173638 - DNA, 626 bp, Homo sapiens
tgaagaagtggctgcagctattgttttacactttttaaaatgaaggtggtagctgccaatgtaaaatcaactgtgggccagataaatagacccacatattttggacagtttcctgcattgtcttggtgatctgacagccccaggctcaaagaaccctgttcatttaacaaatattgactggactcctgttatatgccagggcctgtcctaggccctgggaacatgacattgagcaacagcatggcccctgtccttagagaacgaacattccagtgtgtgtgttgttaggggaagctgtcctgaccttaccatatattagctatgtcatcgtgggtaagtcactagatctattttaaccaacattattattgctgtttataaagaggatatagcatacagcagcctcatctttctgcagtaggattcagatgagatcgtctaggtgagtccagacttagctatgattgggtatgggtgcccaggtagaatgaatacttgaagggaagccatgatgggtccctaaggattcatggagttatttgcatatcttctccaatgtcaagggcaggtaagtctcagctgggcacaccagggagagaagcagctgcctcaggaatctgtgtctg

SEQ ID NO: 173639 - DNA, 175 bp, Homo sapiens
aaacttaacaaaattagcgggctgcttttgttgagggaaatttctaactgaataaacctaattaatgaatgatcagaaataaaatttttatcattaacagtaacttgcagaataattagaaaaataggtgttcaatgtaaaataattattatccacaagtgcgtccctgctgttg

SEQ ID NO: 173640 - DNA, 125 bp, Homo sapiens
aatgtcaggagatctggaaaagccctgtgagaaaacagatagtatccttaatcctctgacctatttacttaaaagaataaactagatgtaggcatctaacaacttcagggaagttggtaataatg

SEQ ID NO: 173641 - DNA, 500 bp, Homo sapiens
cggatggcgacatttcaaaaaattaaacacagatgaccgggcacggtgcctcacgccttaaatcccagtgctttgggccgaggcaggaggatcacttgagcccaggatttcaaggttacagtgagctgtgattgtgccactgcactccagcctgggtgacagagcaagaccgcatctctaagaaaaaaaagttccttctcaaactgaacacagcctgccttcctgtaattcccacttaatgattttttaaaagttttctcaaaatcacaaagtctgttttttctatatctgacacaccttagttatacttgaaattctctttacgttttcttttctctaagctaaacaaaccagtgcaatcaaatagattcttggccagtgctgcgaaatattataggactttatgtaatgatgcagtgtttagtactgtaatgatggaaagttactatttccacaccatcctctatggtagccactggccacatgtgacttttgaatac

SEQ ID NO: 173642 - DNA, 285 bp, Homo sapiens
ggaagcatggccctgccaacaccttgattttggacttctaggctccggaactgtgagagaggaaatttctgttcttttaagccacaaagtttttgatattttgttttagcggccccaggaaactaacaaacacaaataaattatccctgagaatgtttgggagctaataaaagacgccaatccaagacaggaagctaaaaattcccaaaacataataaatatctagtcaatccaataaatacccagtaaatccatcaaaaaggcaatatttattgtattgcctgg

SEQ ID NO: 173643 - DNA, 300 bp, Homo sapiens
actgggtctgtctgacctgaggacactccatcccagcaggaccctaatggagcaacccacctggtctttcacctgtcagaggaaagcacctcttcaagcacatggccagggaggctgatggggctggaaagcaggaaccatacaccacctgggtctgtgcctgggaaggtctgctgctaccacctcttgggggtccccaccctgagctcagtgggcccccagcccacaccacaggctgagggaggcttggttgtcatggtgacgtccaggtacccagaataaagaaggggctgctgggga

SEQ ID NO: 173644 - DNA, 217 bp, Homo sapiens
accagagactattatgaacacctttatgtacccaaactagaaaactttgaagagatggataaattcctggacatataaactctcccaagactaaatcaggaagaaactgaacccctgaacagaccaataatgagcgccaaaattaaatcagtaataaatagcctatcacccccaaaaaagcccaggaactgaaagattcacagataaattctatcaa

SEQ ID NO: 173645 - DNA, 182 bp, Homo sapiens
gtcgataaggggccaacactcagggatcacattgtgacaacccccaggcccgtcgtttgggttttaactgagaatcccatctcaattttccctgcattaagaaagaaagaaaggaaacgaaagcacttggagcttattaccttcacttctcacagaaatgcattcatttggcccttatcgag

SEQ ID NO: 173646 - DNA, 581 bp, Homo sapiens
acgcgtgacttatccagagaggccagccttccagggacagtgattgtcaccatctccaattcctggcttcctcttcagaattgtatcgtggtgtggcttcattgctcagagaagagccgtgcaagggtacaaccatcttcttggaggtgggtctgctcctctcctgctggacaatgagctactgtggcattttgtcctgggctggagtgtggtccccttgatcctagaaaagaagccgctcaggatgcggatgagactttgattgctctgggaccgacgcgtctcctcaagtgatcaaggccttcacaaacccaaagtggaaccgccgtgaaaacgatggacaaccggccacaggacccaggcagagatgcagaaggaggctcaccaaacactggccaacattcaaaaaatcgcattttggcgaacagagcacagtcgtccaaagacacacacgcacatgggcatacacacagaaaaacacacacacacagagaccgacagagagagggaaagaaacacacagagggtgagagacagagagagaagagagaatgggagacacacacacacacacacacaca

SEQ ID NO: 173647 - DNA, 153 bp, Homo sapiens
gcaggtgaacacccacatgcacgtgggaacaggaagatatcacaggggtccggatgagtggcacacccctgcccttcaccctcactctgtccttggatgtccaaagaacaaacacagcataggggacaaatgggtacaaacatacacctccag

SEQ ID NO: 173648 - DNA, 878 bp, Homo sapiens
ttttttttattaactcaggtgatccaaatgtgcaaccaggtttgaaaaaccactagcccaacagaataacaaaataggatggagaccttaattatacagtaaactgtttttggtttgtttttgttatttttttaccaatttaatgcaaccacctcttctcgttagggagaaaagattcctttaaaaatcacgtttgtaacttaatttgaaaatatgttcagattaaaagttctaaaaactgatgcatgacacttttagccaaatcagagtatgttagcagaatgtcaaacccaaacccaaatacagtacaaaataaatgtctagttcataaaaaggaaccgccagttagttcatttaattgacctttctctaaaagtatcaaatgcttgtttggaataagccactcatgaaaataatcatattgagatcattttagaattatacttgctgtttcatgattttatttttatatcaaagaccactacactaaggcatgagaaatgacaaacaaaattcagagactagaaaagatgattaatccaatccttttttttttttttttttttttaagccttccttctaaatccaacttcctgggccatatcctcccccggtgtctccttctttatacttctaattcctttttttcccctttcccttttttttccccttcctttaatccttctacccttcagggggccaaggctacatgggcgcctccctgaagtgcggaggattgtggtagcgcccttctttacgcctgacagggttcccgtgctccctttctagactagaagctgctcacaagagatttagcatttggtcttttccctttggaaacggaccaagtttgagactcctgcgtccccttgggaaaa

SEQ ID NO: 173649 - DNA, 191 bp, Homo sapiens
cttagagctacctcaaacttaacatgtacaaaatcaaattctaagacttggaactgtgaaactaccagaaaaaaaacattggggaaatgctccagaacactggatggacaaagattttttgtgtagaacctcaaaaacataggcaacaaaagcaaaaatagacaaacaggattacattaagctaaaaagct

SEQ ID NO: 173650 - DNA, 219 bp, Homo sapiens
ttaagatggaggcatatagtggagaaggccaccccatgtggcaaacaacagaaaacttctgaagacttttgaataggggagtgatttgtattttagaaattaatctgtgagcagcaggagagactggagaggaagggacaaggaggaccactgaagcagcagaatgaacagacattgttaaagtgctgaaggaagcgtcatggttgcttgcctctggtg

SEQ ID NO: 173651 - DNA, 874 bp, Homo sapiens
ggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggttcggactaaggatcaccgctttgaaagtgtcagtcaccttatcagctaccacatggacaatcacttgcccatcatctctgcgggcagcgaactgtctacagcaacctgtggagcggaaactgtgatctgccctagcgctctcttccagaagatgccctccaatcctttccaccctattccctaactctcgggacctcgtttgggagtgttctgtgggcttggccttgtgtcagagctgggagtagcatggactctgggtttcatatccagctgagtgagaggggagagtcaaaagcctgggtgagaatcctgcctctccccaaacattaatcaccaaagtatgaatgtacagagttggccctcacctgggactttgctgtgccaactgatgcaacttccacaagaaggtgagtgcttggtcatggacaatgtccagtggatgacaggcccagggaaacaggcagcactctggagcagggggaacacaacacagctcagggactcaggaaacccagaacgcgagagagaaccgacaaacacaggcaaagcagagactaaacaaccacagggaaaagacaa

SEQ ID NO: 173652 - DNA, 649 bp, Homo sapiens
ggccccccaatcctgctatcaatggcagtgcaccccgggacctgtttgacatgaagcccttcgaagatgctcttcgcgtgcctccacctccccagtcggtgtccatggctgagcagctccgaggggagccctggttccatgggaagctgagccggcgggaggctgaggcactgctgcagctcaatggggacttcctggtacgggagagcacgaccacacctggccagtatgtgctcactggcttgcagagtgggcagcctaagcatttgctactggtggaccctgagggtgtggtgagtgtggcagaggtgtgggtgaggggtggcaaaaaggaaggtacagtaccctacagtgtatccctcttccttccctcattgctttgtagacattcccgctgggcagctgtctatgggcctctcttgctctttaaagtgtctggcatcttcctccagaggctcatcccttagcctgaactatgttctttatagtcctggcacagggccaggcgtggtggctcacacctgtaatcccagcgctttgggaggctgaggcaggagaattgcttgaacctaggatgcagaggttgcaatgagctgagatcacaccactgcactccagcctgggcgacagagtaacagagtaagactct

SEQ ID NO: 173653 - DNA, 481 bp, Homo sapiens
aaggccggtgaagagaagaggatggcacctctgtagaatgctaaggagttggtgtgggcaagggcagtccaagacaaagagcaagggacaaggccagatcacgcagggccttgcagcctggtcagggttagttgggctttaacctgagagtaatagaaatttgtcagggcaaggaatggtctaggaaaaacaggatgatctgggactgggggagggagaggcagagtggatgatccaggatcgggggaggaagaggctgactgagctgtgtcactataactcctacatttccaagctgagagtagactaagaaaaaggcataaagctgtgtgctctgtcacgttgcctcgcttggcagcttctagtctctaatgactgtctgctgtcctctccaaagccatcagccaggcagcctcttcctcccccgtcctggatcatccactctgcctctccctcccccagtcggtacgagctcgatatg

SEQ ID NO: 173654 - DNA, 461 bp, Homo sapiens
gctttaacctgagagtaatagaaatttgtcagggcaaggaatggtctaggaaaaacaggatgatctgggactgggggagggagaggcagagtggatgatccaggatcgggggaggaagaggctgactgagctgtgtcactataactcctacatttccaagctgagagtagactaagaaaaaggcataaagctgtgtgctctgtcacgttgcctcgcttggcagcttctagtctctaatgactgtctgctgtcctctccaaagccatcagccaggcagggcccattccaaactgacaaagaaagtgacatgaacaagcaagaagtggccataggtgatggcaagaaataaaaggcaaggaatgagatgggaaccttagatgactttacaggattatttcattcaaccacttctaggtacccagttcctccttcatcagtttctttccctttcttttattttc

SEQ ID NO: 173655 - DNA, 639 bp, Homo sapiens
atttcagttactggacccaaagtgacttctgcctgcattctcgggtgggaggtccatctatagcaggggaaagagactggggcatcatccattctttcgtatattcacagatatgtatggtatgtcctgccccaggtgatgttctaggcgctagaaacacagtggtaattacaggcaaagcctctgctcttatgctgcttgcccatcagtgtgggagacagacaaggaacaaacaaataaaaagaacaaatacaccaagagacaactgtcactgtcacaggctcagttggaagaaaaatgcatttcactgttttttcttttttttttgagacagggtcttactctgtcactcaggctggagtgcagtggcacattcatggcccaatgtagcctcgaatccctgggctcaagcaatcctctcacctaagcttcttgagtagctgggactataggcatgcaccaccttgcctggcaaatttttaattttttttgtagagacaaggtcttgctgtgttgcccaggctggttgctaactcctggccttcagtgatcctcctgcctcagcctccaaaactgttgagattacaggtgtgagccactgtgctcaatgcattttttttttttttgagacaagatttg

SEQ ID NO: 173656 - DNA, 512 bp, Homo sapiens
  misc_feature (35)..(35): n is a, c, g, or t
gtgactctagcaggatccttgtgcctgttgtcagntggtaattacaggcaaagcctctgctcttatgctgcttgcccatcagtgtgggagacagacaaggaacaaacaaataaaaagaacaaatacaccaagagacaactgtcactgtcacaggctcagttggaagaaaaatgcatttcactgttttttcttttttttttgagacagggtcttactctgtcactcaggctggagtgcagtggcacattcatggcccaatgtagcctcgaatccctgggctcaagcaatcctctcacctaagcttcttgagtagctgggactataggcatgcaccaccttgcctggcaaatttttaattttttttgtagagacaaggtcttgctgtgttgcccaggctggttgctaactcctggccttcagtgatcctcctgcctcagcctccaaaactgttgagattacaggtgtgagccactgtgctcaatgcattttttttttttttgagacaagatttg

SEQ ID NO: 173657 - DNA, 496 bp, Homo sapiens
gctacatgatcatctagttctgtcccttttcagctttacagagaggcttgctacttagatggttctctctagctatggggcttggagagtaaatgggcaggagtgggagtgtgggaaggggccatgctctgttgatctcagccagttgaagctgatgcctctgtcctggtgtttataaggggctccatcacacatgtacccgtcctctattgtgtgggaggtaccccaggcaatgaaacggagaggtgtctcctggtgttgcagtggggaggagacctctggaccaggacgtgctgtggggcgtcagctaccaaccttgtggtctcgggaaagtgacctatcaagggggcatacaacagggacaccaccttgaaatctgaagtcactgagtagcaggggaggttggagcctggggcaccccatggcctgcccttgggtttcatttaactgtgacctccccaggatgttacacgtactggccttcttcctgcagaaa

SEQ ID NO: 173658 - DNA, 368 bp, Homo sapiens
aagcatttgtaaagttacagcaaaagatgtacctgttaatacacagaatgtgtacagattatttgttatgacaataaaacactcaaaataaatggtctttagcatctcaaattccaactgaaatcattttagtattaactcttcttcccaaagcaatgtctcatttcttggctgtgcaggtgatgccatgttatatccaataactagaaaaatcactgtgctgaacttttatgtttagcttccaagtatttttctaatgttttgcatttcaagtggtatcactgttaaatgccatttgttttcagattgtggccttttattattggctgctagatcctggtgtttctatgttcttttttaagcaccaa

SEQ ID NO: 173659 - DNA, 462 bp, Homo sapiens
aaaataaaatagaggggataaataaaataaaacaaagtaaagtaaaataaaatagaaaagaggctgcagtgagccgtgattgtgccactgcattcccacctaggcaacagagcaagaccctgtcttaaaaaaaaattatatatatatgtgtatatattatacatatatatatggtgtcatattatacatgtaactctgaaatttacacaagaggcagtcaattctagacatctaacacctcaccaggagctgttcttagtgaaaactcagggaggaaaaacaggggcactaatatttatcacagttcctgtaggcactagacactgcactaaactacttatcacaaatctcagaggtctccgatttgagccaaagtcatatttacattcgggtaaaccggtaatatattcctcactgtagtctacttaaaataataatttaataagccgaataatcctatga

SEQ ID NO: 173660 - DNA, 458 bp, Homo sapiens
aattgaacgtattgcaccagcttctcccggcctccagactctccctctggtccatctttgacacgaccccagagggttctttctacacccagagctgcccctacttcttcactgctcacactcctgctgcagctccccagcgccctgaggaaagagactcaacactctctgacttttctgctgaactctgcacctaggtatctagctgcctcctaaacgtccctgggacccctcaaagtcactgccttctaacccagcttatcatctgcccccggctctttctctcaggctccttatttcggtgatgacccaccgcccaacaggcacagagcaggacctgtctcagatgctgttctctatgcttcccaaaacagcccagcagacctaactctctggccctggcccttctccaccttcacggccccagcccccactcgggcctccgctctggcctggac

SEQ ID NO: 173661 - DNA, 857 bp, Homo sapiens
tgccccaagtggcagagcagcttgcagagcagcctggagctgttgcagagcattttcttattctggaccccactcaaaactagcagcttctcaggtcgcttcataaataggccagagtaacaaagccatatgaggaatatgttgcctccaaaatccaaggaggtcctatgtattagtctgttctcacactgctaatgaagatatacctgagactgggtaatttataaagaaaagagatttaattgactcccagttccacatggctggggaggcctcacaatcacagtgaaaggagaatgaggagcaaagtcacatcttacatagtggcaggcaagagagcttctgcaggagaactcccattgataaaaccatcagatctcgtgagacttatttgctaccacagaacagtatgggggaaactgcccccatgattcagttagctccacctagccccatcctttacacgtggggatgattacaattcaaagtgagatttggatggggacacagccaaaccatgttaccctactaggtgttgtgcctcattttttggttttaggagggcccagatgcaacaacttacccttcattttagagggaatatctctggccaggcacagtggttcatgccggtaatcttagcactttgggaggccaagtcaggcagatcacttgaccttaagagtttgagaccagcctgcacaacatactgagactctgtctcaaaaaaattaaaaattcaggctgggcatggtggctcatgcctgtaatcccagcactttgggaggccgaggcaggcagatcacttgaggtcaggagttcgagatcagcctgaccaacatggtgaaaccctgtct

SEQ ID NO: 173662 - DNA, 179 bp, Homo sapiens
aggccagggggctgtggaatcagaggctaattctccagagaaggggccgtattttgttagcagtcactgcagcagatgggagtgggtgcagcagccaggtagaggcgcacagcagtgcctttgacagtgcccaatttcatattccctgagtaccatggaatttccagtactgtgtgtga

SEQ ID NO: 173663 - DNA, 441 bp, Homo sapiens
acacaggaaatactgaacgtcattttaacttttctgccagcaaataatgtaaacacacctcactaacttccaaatgttttagagcagcggtccctaccctttttggcaccagggactgctcttgtggggaactatttttccacggactagggtcttggggaagggggtgttcataatgattcaagcacattacatttattgtgtactttataattattaaactgtaatatataatcaaatagttatacaattcaccataatgtagaatcagtgggagccctaagcttgttttcctgcaactagacggtcctacctgggggtgatgagagacagtgatagactatcaggcattagattcttgtaaggagcaggcaacacagatcccttgcatgtgcaattcacaacagggttcacaagcctacgagaatctaatgctaccat

SEQ ID NO: 173664 - DNA, 344 bp, Homo sapiens
aaaaaaaaaaaaaagttgcctatctgcactgagaaagtaaaagacagttaatgtccactggtttagaaatagtttccttactcctttgataaatatttctataaatagaggataaaataatctttttatcttaattatggtgactgcatttaacagaagccaacatagggagtgcaaaggtagtaaattcattcccaaacccagtgtttatgccacacaaaaagttaacttaaggcttatttaggtacctgttattttgtgcaacctggaattacttaaaatacataaacaaataagctcactttgaatcttgactgaatatcagacattttcttcttcaagtg

SEQ ID NO: 173665 - DNA, 239 bp, Homo sapiens
cggcacgaggagctgtcatttggctccctgttaaactctgcacaggctggctctgtctgcagcaccctatgggataggacaggccgaggcagataatagggctgtggtcgctcagggcccaccagatggggttcagtttgaagcctctggtacttccccttcccaaacccagtcacaggaaacactgccctggggaccccaggggtcagaagaatgtcctgcaggccaagaggattcca

SEQ ID NO: 173666 - DNA, 354 bp, Homo sapiens
taggaaggcatcgctgtagactcagtatccaagattggcctcgaggcattgctgggattgacccaaaaggaaattagggaaatgggcagttagggaatggggcagttctgcacagcataaactaagtcagatgggtcttcctgtaaccttcatacaaggctggagggcagacattaaaggctccttttctttctaacttccttgttactgctcttatttttcaagtatttcaccctggtttattaattctacctcctggtgcctcagctggtttcttctaggaaaagtttctcattagcatttctatagggagcagctgctaccctatctacccctattatctgatggccaggg

SEQ ID NO: 173667 - DNA, 250 bp, Homo sapiens
aactagctggtgatcttgagcagatatctttatttaactgatttgtaaaatgacggtaatgtacatatctcatgggatgcttggagattaaatgccaccggatctctaaagtttttagcacagtgtatgaaacattagctattttttccctttggtgagtttctctttattttcctctatttcacgacttctgttcattcatatacctacttccttttcttctgcgtcaggacttcgcttagagccttct

SEQ ID NO: 173668 - DNA, 1083 bp, Homo sapiens
  misc_feature (752)..(752): n is a, c, g, or t
  misc_feature (981)..(981): n is a, c, g, or t
acaggcccgccgccgcgccggcgcctagcccgccgggtcagcgcggccaggcctcgccgccggccccgctcccagggtgcaccgcggctagcgctggggtgggagcgggcgagatgcgccgggcgggcggtgcccactgacctccctcggcggcccggcccgggcagcgcccgagcccaggcagccccgcccgccgcgccccgcccagcccatgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttccttcagcgggagcatgccagcacgctcaaggggctgcactccgagatcaggcggctgcagcagcactgcacagatttaacatatgagctgacagtcaaaagttcggaacagacaggagacgggacttctaaaagcagtgaattaaacgaaaacgatgtgaagagctggaagcccaactgaaagtgacaagagaacgaaaatgctgagttgttgaacagaactggagcagaaaaacgcgatgatcacagtgctggagaacaccatcaaggagcgagagacagaagtncctggaggagctgaaggccaagagtcacaagctgaccctgctgtctagcgagctggagcagcgggccagcaccatcgcctacctgacctcccagctgcacgccgccaagaagaagctcatgagctccagcgggacctcagatgccagcccgtcaggagacccgtgctggccagctacaagccagcgccccccaaagacaagctacccgaaacgcctcgccgccgcatgnaaaaagagcctctcagcccccttgcacccggaatttgaagaagtctacagattcggggcagagagcaggaaattcttttgcgggaacagtggatgctatgcc

SEQ ID NO: 173669 - DNA, 482 bp, Homo sapiens
gcaccaggagcgccccggggcctagcccggctttgtctgggatgctgtggggaggaggccgtctgaatccacatcgcctttttaaatgcttgttaccacccggggaaccttagagaccctccctgacaagttgtatcgcctcccgtcctggtagcctttcctatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctccctcctggagacccttgtcacctcccgagctcctcctggagacccctgtcacctcctgaccaacctttcccagggcggcaccgatcaccgagcagccgtgcgtgtatctcaaggaactaaataagatgacgctactcctcatagcaccactacctaaatt

SEQ ID NO: 173670 - DNA, 523 bp, Homo sapiens
tggaggcggtctcaggcaaggtgtcacttcctacaggcagaccaccgagattcccccaggctgggtcaggtgtctctgctatgcgcctcccgcctggccttagtaccccagctaataagtgcctgattagaggtctttatcctcactggactgtgagctctaggagggcctgggttgtatcttgttcatcatggtgtcccagtgaccagcataagggaaggaagaaagagaaggaggaaagaaggaagttccaggtccgaagggattctttcttcccagaattcccagcttctgattttctcctctgcccagctgcacgtaagaaacagaaccgtagaacaagtactgggctgggggttgtagagcttggcacctatatctgtgccagtctgtgggcaagccccttctctctgggccttcctttgctcatctgtacaatggagatgagcatgccttccctccctacttcaccgagcctttgtgagagtaaagcagaaacgcatttggggctttgtaaactgta

SEQ ID NO: 173671 - DNA, 803 bp, Homo sapiens
caaaatacgtctagagaggctgggtgttaatcggacgagggcaccttgaagcaattagcacccactgtctcggtgtctgtggatcagggatctggacacgatgccactgggtgcctcttcttcaaggtctttcaaggctgcaggcaaggtattggccagggctgctgtctcctctgaaggctcatcttcaggaggatccccttccaagcttcttcacatgataggattcaggtcctcataggctgttggactgaagacttagtttcccactggctcttgggtgggggcctctctacagagcagcttacaacctggcagctggtttctttcagagcaagcgaacaagagagagaggccatacaagacagatgccatgtcttggaagtgatattcctttacttttgccatattctcttagcgagaagtgagtcctgaggtccggcccacactgaaggagaggagatcctagcagggctggggattatcaggagccctcccaaaggccactgaagagagcagtcaagatggtggatggggtcagctggctgcccagaggtcatctgataaggactaggagctgttagtggccctggcgatagcagatctgggctggccggtgtgtctggagtcagacactacattgaagtgtgttgacaggtaggatgcagggaagtgagaagggtgaatgtgagttactagttggaggctggagtgcttttatgtcacccaaagatgtatgggtcagagaggcattcccaggtgtggaatggactgtgagagctgggacaggcactggagtggga

SEQ ID NO: 173672 - DNA, 681 bp, Homo sapiens
tttgcaaattaacgacggcagagcaagtgaaggaattccatgcatgtataaataattttgccttaaggtttgaaactgttgtcatggtcagaggtatttgctgttgctttgctagatcatttttttgcactaattattgtggagtcctttatcaatttgggaacctatgaagccagttttgccagtttggctgtgtatatccatgagctaatttttagatattgctggtagcaacttgatatccccagtgcttagcaaaatgcctgaccatgcctagctctcagtgaatattgttgaactgaaattaaatggcctggtgggagtgttcatattccttataatttaaaagggaaataaaaaggtatttcttttcactttacatgtcctccttaagaaatgtaggaatagaaaatttgagattctgaaatatttcagtggggccaggcacagtgtctcacgtttgtaatctcagccctttaggaggcctaggtaagaagatagattgaggccaggagttttgagagcagcgtgggcaacatagtgagatcctgtttccataaaatgacataataaaactttacatccaactcaatattagagagagattttggcagagtcatcttcttccactgtatttttccaataggggaaatcccacttttataattgaaatcagtgaga

SEQ ID NO: 173673 - DNA, 605 bp, Homo sapiens
tcttagaaatatttaatcaagtagtatccactagaacttaacatttcatcctgtggatcatcacacacaaaatacccaaccctgctgtcattcagggtcctagcaggaacaggtagcatcaaataggataattgatgagagcttaagaaaggaactatttacaaatatgtggccagattaggggaaaccagtaaggttgggaatgccgcccaggattctaacaagagtgagaatctatttctactcttgacctaaaggggcaaggagggaaagctgcagctgtggctgtgggagagccggcctgcaaagctgtggccttcacagaggaagacagccactgccgaggtatggctagggaaggaggggaggagatgatgccctgaaccccatcgtcattctcactgggcaagcccaaccaggagccaaagcacagggcagcccattggatgcagttcattaggggactgcttctgggtagagggcagacctggaggggcagagagaatgcacagcgctagtgactatctcctcaagagcagactcacagactgtgtttcctggctttacttccatttcccagaagcgcatacccagtgagaggaatg

SEQ ID NO: 173674 - DNA, 236 bp, Homo sapiens
agacagattttacaaacttcaacaatcagcatggtgttaggcaaagctctctcttttggggaaaacatcctaggaatcatcaatcaattaggaagacaagaatgttgtgttgattattttaggggaaaacacatgacacttctttcctcttggctgacaaatgctaaacaacacattcagcggggttatcagacaatcggtgttggcctgtgctgaccagaaatgagagtgatggg

SEQ ID NO: 173675 - DNA, 650 bp, Homo sapiens
tgccacacaggctggagtgcagtggggcagtcttggctcactgcaacctccacctcctgggttcaagtgatcctcccatctcagtctcccaagtagctgggactagtacatgcgccaccacacctagctaatttttgtatttttgttagagacagggtttcaccacgttgccccagactggtctcaaactcctcaactcaagcgatcctcccaccttggcctcccaaagtgctgggattacaggcacgagccactgcacccagccttgtgtcagctttttacactcttcttttcatgaggttcttctaggtaacacttgtagtcagctaacaaagccataggtttccttttgaaaggtataacagttggtgaaggaggttaattaaccttctgaatgattccttggggctgaaataaagtgatcattgtttttaaagttagttcatagccacctgtcttgcttaatatgtcactctgtttggaattgtcaggctttaaaactgggaagtagaataatctgatccgcagcagcgatatccctccctcttacctcagcacagtgtgtaaccacgctgccattaacacagtgaatgaagtaaaagatgagtcttctgaaggtgcttctgtaatgtctcatggggttgttttat

SEQ ID NO: 173676 - DNA, 321 bp, Homo sapiens
tgctgggattacaggtgtgagccaccatgcctggcctgattgctttttctgtagtaaaatataagaatcatatgaataaatgaaaaattccctaacttaatattagccaagaacttcctctccagcagagcttagctcttaccaaatatatatgattgatttgcattctacctattttgtttttttcctttcccttttgtgggataaacttgaaacaggacctagaaattgtaagactctgaatgcttttcagtttctttctgcatttctttagagtggtgtgtgaaaaacttcagcctctgttccttaaacatctttccc

SEQ ID NO: 173677 - DNA, 517 bp, Homo sapiens
atagacgatccccagtacgctacatgatcatctacaaaaataagcatcccttctgaaatggctttaaccatgattccagatgccgaccagaaaaacaaggacagatcctcatgacacaatgcctgaagacttcccttcaggttgacaaatgatccatttattaacatgttttggatacagttattcagcccattgtaaattcataacctgtacctgtgatattaatattatggcaaatgttcaactaccctgcttacatcagatatacagtctatatcattcctctaatccagaggctggcaaactttttctgtgaagagccagatagtaaatttttttggcttcacaggttatatggtcttagtagcaggtcctgaacacagccagtcacacacaatgtggaaacaaatgggcgtggctttgttccaataaaactttatttacaaaaacaggtggcatgcagacccctgaaaatctatgggtctgataaagctaaccaaaaagagaactaggctgg

SEQ ID NO: 173678 - DNA, 383 bp, Homo sapiens
ttttcatgtgttgcatgttttggggagataatttcaagtcaggtgcatgcgcctccacaagcacactgttggtgagcctaggggtgaggaagccagagctgccctgccaggctgcttggtgaaggcctggtgacagacagcctggccagaaatccagtcactggctgctgggaataactatcgtttggtaacatagtttggtccaccttgcagtgaaaaacgtttataatttaaaggcatttgcttcagagacattcactgtagtaacatatcttttctttctcttgagacggggtcttacgacattgcccaggctggccttgaactcctgtgctccagcaattctctcgccttggcccacggagtagctgtgactacaggtg

SEQ ID NO: 173679 - DNA, 142 bp, Homo sapiens
tttactttttcaaaaggttagacgattgcattttgtactcatttagatacattaaatactctcaatgcacaagtgatgaggcggttctgatcacaggagatgctcattccggtgtaaccatctcctctggaattttaaagaa

SEQ ID NO: 173680 - DNA, 226 bp, Homo sapiens
ctatcttataccaccatcttcatcatgtggactccacattacctcctggttgacaatatcccttccacttccagcaaactcattctggccagcaggaaagattttttgttgttgttttaaaggattctcccattcttccctctaatgacacctctcagcggatgcaccaagcacagtcatttgtacactcttggccaaaacttagtcttgtgtccataggactagc

SEQ ID NO: 173681 - DNA, 134 bp, Homo sapiens
ataaaaaaataataaatgattaatacatgtatatggaaatctataatttacaaaatacttttaactatattccttatttgaccttcaaaacaatcccatagcattgaaataagcaacacaacactttggtatat

SEQ ID NO: 173682 - DNA, 351 bp, Homo sapiens
tgggcaaacaccacaccagcagggagccccaagcccagcccaagccccacaaagtctccagccaggaaggggaaggcaggataccactgcctgggaaggcggaagtgagagaggcaggccaacccattcctgtttctcttctacttctttctccaaagaaagccctcactctcctcgctacagcccagggaggtcacgaggggctgggaagactcctgtggcaaagtggcccactccagcccaggcctgagaaaaaaggaccccgaaatccttctggctaccagtatcttctgccctcatgagctggcctctctccagaccacccgccagcattaagaggcgagagaggga

SEQ ID NO: 173683 - DNA, 321 bp, Homo sapiens
  misc_feature (25)..(25): n is a, c, g, or t
gcttctgccccccccacgcccaggntcttggatgaggaagggaaggcaggataccactgcctgggaaggcggaagtgagagaggcaggccaacccattcctgtttctcttctacttctttctccaaagaaagccctcactctcctcgctacagcccagggaggtcacgaggggctgggaagactcctgtggcaaagtggcccactccagcccaggcctgagaaaaaaggaccccgaaatccttctggctaccagtatcttctgccctcatgagctggcctctctccagaccacccgccagcattaagaggcgagagaggga

SEQ ID NO: 173684 - DNA, 340 bp, Homo sapiens
tactaatcgcatcagttagcggttttaaaaaataattcagcacagcttatgaagacaaatgtactagtacaggggcccatgattgcgtaaccaaaacatcagaacagcatgagctggtaccagcttttgcggtaattaccttctgtgaaagcagacgcctacccttccccaaaactgtccctgcaaagagagtgttaagtgtgtggatgaaagtcatccggtaataactaatccacaagagaaaaagtgcacctgtgctgaggtcttcttccaaccgcagctttctgtttcctcccctgcctcccttttcctgggacttctctttccacctgcatcccac

SEQ ID NO: 173685 - DNA, 563 bp, Homo sapiens
gtctgggtgtggaattttgagaatctcttgatccttttcagtttaattctgaaacagggttcttccttccttccagattacagtgtggacactcacacacagtaagggacaaagaaagtgtatccccttccaaagatccgcccaccaggccccggacccgtaatcaaagcctgatactgggacaatggacccagcggccgggccagccctcccctagttatcaccccagagctgtggctgggctctctttgttccgaaacggagctgatggagcaggacgctgtcgccaggcactgcggggagggggttatcagcccctggcccgcgtcccaccccagaggtgaagtcttcgccccagacaggccctatcaggccctcccagctgctgttattttagatatggcaggaagtagggcctggaaaccgcacggctcccagcccttggcagcagctcagttcccgaggctgcactcagagctggtggcagggagggagaaggcacagcagcctggactgcgggttagagggctgtgccggggccggtggagccatgcgagcggccg

SEQ ID NO: 173686 - DNA, 523 bp, Homo sapiens
gaatggctgtaattacaaagactgacagaaccatgtgttggtgaagatgtggggctattagaactcttaccgctggtgggagtaaactaatttggaaaattgcctttaactactaaagttaaatatacatacattctatgacccatattttcactcaaaggtatacagaactgcacatatattccaccaaaagacctgtacagcaatattcagtatagtttattcaaaatagcccaaacagaaaatattccaaatgcatagcaataactaaattataacattcatacaatgaactacagaagaaaatgtcactttaagataaaaacagagtatcactaaacttcaaaattagagaaaaaaaaagttccaaggggtattatctgaaggacacttcaatacgctacaatacattttaaatattttagattaaaaaataaaggcattcctgccaattctacttcaatgtttttactttttttttttttttttggaaacggagtctctctttgtggcccaaatggga

SEQ ID NO: 173687 - DNA, 196 bp, Homo sapiens
acacagatgggaagcaagagaagatggtcaaaatcaggactgaggagcatgtcagaaagtatgcgaggtgctaataacctagatgccgagtgtctggaaaggacaggttaggagaagggctggaacaaacaccgtggccaaagtccagaggcccaggccacacccagagcccccaaaatgaaggatactaaaccaa

SEQ ID NO: 173688 - DNA, 496 bp, Homo sapiens
cattttaaaaatatgcacgttattttctctattatacttcataaaaccaagttcaacatcagattctccagtatctcctacagtccagctactcaacatgtggtctgggaccagcagtatctgtatcacctgggaccccaccccagctagacctagagagtcagaatctgtaacttaccaagatccccaggagattagtgtccacattaaagtttgagaagcactgtcctaaatacaagcagcactggcttgatcagaagcactgtcctaaatacaagcagcactgtctgaccagtggcacaatcatagctcgctgcagccttgaacttctgggctcaagcaattctcccacctcaacctcccaaagcactggtactacaggtgcacattaccatacctggctaatttattgtattttattttctagagacgaagttcttgctatgttgcttagactggtctcgaactccctggcttcaagtgatcctcccggttg

SEQ ID NO: 173689 - DNA, 425 bp, Homo sapiens
caagccatatggttccatccatggaactagtatctgtacaatataatacaaggaacactcaagtttaaaaaaaaatccccttagaaaatatgcaaaagacatgaacagacatttcacccaagaacatgcacagatgccaaagaaaccatgggaaaaagctcaactccatttgctattagggaaatgcatattaaaaccacaatgagttatcactgtacacctatcagaactgctaaaataaaaaacagtgacaactgcaaatttaggtgaggatacagaaaaaccagtttcttagaatactaaaatatgcaactatcataacacccagcgattgtacatatgggcatttatcctagagaaatgaaagcttatgtttagacagagacttctgaaaacctacacatttagcagctttattcataata

SEQ ID NO: 173690 - DNA, 292 bp, Homo sapiens
tataagagcacaaaagtcaaacgcacacacagaaaaaaaactatctccattataagcaattaaaagtttttctcggctgggcgcggtggctcacacctgtaatcccagcactttaggaggtggaagcgggaagatcgtttgaggtgagaagtttgagtccagcctggccgacacagtgaaaccctgtctctactaaaaatacaaaaattagccaggtgtggtggcgcatgcctgtaatccccgctaaggctaaggcaggagaattgcctgaacccaggagatggaggcggca

SEQ ID NO: 173691 - DNA, 397 bp, Homo sapiens
caaacacagcgaatgccatccccatcccctccccagacccccactcaggtgccgatacagacacagcgaagacagcgagtgccatccccagcccctccccagactgcccatcctcaattcctgggaaccacgagcctttcctcaacttcagaatcttctcgcctcataaatgtgacataaaaagaaccacacagtacgcagcctttgggggctgcctgcccactctgcgcagttctcggaggtgtgtgccggtggttttactgctgggtggcgttccgtggtatggacatagctcagtttgttgaacatttatttacccactgaagtacctttggactgtttatggctaatacgaataaagctgctataaacacctgtgtacaggctactgtgtgaa

SEQ ID NO: 173692 - DNA, 462 bp, Homo sapiens
caaaaggaggctgacccaaaatgccatgaagtcttttggatcttatgactgccaaagtcagaaacatacactgctcagaagtgaagagaattagagtagcagaagcacttgactagagaaaaaacatcaatcaattaatctgtggaacccttcctcggatagaatgagacagtgtgagtgtccatttccttgctttctttgtggtccaagcactgcttgcagagatgtgcatgaattaactcttcacaacagttaagtcttcacaacagttgtgtggcagctgaggaacattttgtaagcattaaaaaaaaatcacatgaccctactcatctgacaaagggctaatatcaagaatctacaacgaactcaaacaaatttacaagaaaaggacaaacaaccctaccaaaaagtgggcaaaggacgtgaacagacacttctcaaaagaagacatttatgcagcca

SEQ ID NO: 173693 - DNA, 298 bp, Homo sapiens
aagaactatacaaacacttaaatataatgaagtcaatagataccgtaaggatctaaatccagggaccgcatctagtctgtgtagttagggaatgtcataagcaagtgaagtttctttttatttattttttttaatttttttgtgagacagggtctctctctgtctcccaggctggagtgcatggctcattgcagcctcgatctcccaggctcagtcaatcctcctgctttagcctccctagtagctggggctacaggcacgtgccaccatgcccggctaatttttgaactttttgtag

SEQ ID NO: 173694 - DNA, 555 bp, Homo sapiens
gtgaggaccttaagagcttaaacagttcatggctcatagtaggtactacataagagttaaataaaaattaaatcttagctgagggtcaccttataacaagcactaattttctcattctgatttcttactcatagaatgacttcctgattgtaaccaggctttctggttcatccacctacagaggaagtacggatgtagctattctggcctgtgttgcacagttacatatttcttgtcataaattaatcaatcagtgagttttggttaatgtgctaacaaaatcacagttctgaaccagtaagactgaagcccaagcccagacagtgtcacaaagacacacctcatgtagttgcttgcttagtgacctcctagccaccttctccaaataataccacaactttttattcaaatacctacaacacaagctgtatcactagggataaggaagcactgcctgagaacccttttctctaatcagcagagcatagagagagatgacaggtaggagagtttccagggagaagtgaatgctttgccagcgtcacagccctccct

SEQ ID NO: 173695 - DNA, 1564 bp, Homo sapiens
agccgcagtttggcaccatcttttccatctcctgctccttccgccttcccgccatccgccctccacacgattcagcccggtggtgttagccccctggactcgattcctgaggcaaacagtgccccttaaggtcggcgacagcctcttctgggttcactgcagtccaaccggttccctaccctctgccattatgaacatccgcaacgctcagccagacgacctgatgaatatgcaacactgcaacctcctttgccttcctgagaactaccagatgaaatactatttatatcatggcctttcctggccccagctttcttacatcgctgaggatgaggacgggaagattgtgggctatgttctggccaaaatggaggaggaaccagatgatgtcccgcatggccatatcacctcactggccgtgaagcgttcacaccggcgcctcggcctggcccagaagctgatggaccaggcctccagggccatgatagagaactttaacgccaaatacgtgtctctgcacgtcaggaagagtaaccggccagccttgcacctttattctaacaccctcaactttcagattagtgaggtggaacctaaatactatgcagatggggaagatgcttatgctatgaagcgggatctctcgcagatggcagatgagctgagacgacaaatggacctgaagaagggcgggtatgtggtcctgggctccagggagaaccaggagacccagggcagcacactttctgattctgaagaggcctgtcagcaaaagaacccggctaccgaagaaagtggcagtgacagcaaagaacctaaggagtctgtggagagcaccaacgtccaggacagctcagaaagctcggattccacctcctagagcatgcttaagcatttcaggtcctcatgtctcaaccacatctactctgtgaaccctggcttagtctgtctgctctgcagcatctgctgtggggatcatctcacagtgaccagaatggcttctcactcttaactctataaacaaccacctttcacatatcctgctgggatcatgaaggaatacctggacacaagagccactgcacaacagccaaggaactttgagacctgccattacagaacctttcttggcctactcacactacgctgccattttattctgtttgtagtagtcctctgttgggtgtggttatcctgcaagtttttctccttttagaatgatgaacaggaagcagggcaaactcttgaagatttccagctttcagtttttgtttttgttttttaaccattatttacctgagttttcatccttgaggaggtgaagtagtcaggaccatgaagtcagacctcatgccctcttcctcctctttcctggaagaagtattcagtttccttttcctttctctggtaactcctcctttatactattcccccctcccttttttttgaggaggagggcatcaccttcccagtgggaaaaggtgttaagttaggagcttctactgtacaatcagaacttggagattttaagaaaaggacaaacggtaattaaattggaatctct

SEQ ID NO: 173696 - DNA, 957 bp, Homo sapiens
  misc_feature (790)..(790): n is a, c, g, or t
  misc_feature (813)..(813): n is a, c, g, or t
  misc_feature (820)..(821): n is a, c, g, or t
  misc_feature (834)..(834): n is a, c, g, or t
  misc_feature (842)..(842): n is a, c, g, or t
  misc_feature (851)..(851): n is a, c, g, or t
  misc_feature (855)..(855): n is a, c, g, or t
  misc_feature (857)..(857): n is a, c, g, or t
  misc_feature (863)..(863): n is a, c, g, or t
  misc_feature (866)..(866): n is a, c, g, or t
  misc_feature (868)..(868): n is a, c, g, or t
  misc_feature (875)..(875): n is a, c, g, or t
  misc_feature (884)..(884): n is a, c, g, or t
  misc_feature (892)..(892): n is a, c, g, or t
  misc_feature (894)..(894): n is a, c, g, or t
  misc_feature (900)..(900): n is a, c, g, or t
  misc_feature (902)..(902): n is a, c, g, or t
  misc_feature (906)..(906): n is a, c, g, or t
  misc_feature (911)..(911): n is a, c, g, or t
  misc_feature (914)..(914): n is a, c, g, or t
  misc_feature (917)..(917): n is a, c, g, or t
atgcgactctcctgggatggtgggtgggaggtgcaggagttgcttggaagaattttgctgcagcagccaacactgagaattgtaggtagagccaggaagtcctgggcctcaggatgttactgggtaggtttaccccagatgcacccagtccctctccaatgtgagactgacctctctttatcagatgtctggggcctagggtgagaggtcatatttgtatcaccatcagatcagtgctaagggtgagacagatctgacacttgtcagccaaaagcattcatcccttggctccacaaatatttactgagtagcaccagcctactgagtgccaggctctgttctaggctctggacatatagcagtaaacaagttcatattctagaagggggagacaagaaataaacacaggtataaaataaatagtgtctcagatgatggtaagttctctctaaaataataataataataataataaggcactaaaggagaattgggagcaggggagttggtattgcaatttaaaatagatttgtcagggaactcttactgagaagatgatgtttaagtgaagaccagggttggaggaggagtgagatatgttgatatctgggggaaggaacattccaggccaagagaactgaagaggtaaaggccctggggagggaatgtgcctggtgtgtttgaggatcagcaaaaaggagaggccagtgagattgaagcagagtaagaagaacagtaggagatagggtttagcgataactacctgatcctgcccctcacaatcatggangccaacgcccttatccgtgaccnctatcannaaaaaaatctacntctctatntattcctanaatntncttatntancntcaagcncagaacacnttatattntngaaccntntccnctggntanccngaagaacaccaaggtaagagggaatcattaaccaaggctc

SEQ ID NO: 173697 - DNA, 464 bp, Homo sapiens
cggaaacagggtctcacactgtcacccagggtaaagtgcagtggcacaatcacggctcactccagccttgacctcctgggctcaatctgtcctcccacctcagcctcccaagtagctgggactacagtcacgcaccaccacgcccagctaatttttgtatttttggtagagtttcatcatgttggccaggctggaacaagtacctttcttaatgcctgtgagatggtattgtatttttctctttgcttgttttccttacttagactgagcaccccatgagtgcagagaccatggaccatgtctttcctattccccattcagtccaccatgccgagcatatggaaagctgtcagtgttgactgattaaatgaaagtttcttttttctcttttatgagtttatttttttctttttgtaaatgagtgttttttaactcatgccttttctcatgctgctgtgtctgcc

SEQ ID NO: 173698 - DNA, 382 bp, Homo sapiens
ctcttcaagggaggtattattttcatttttgcagatgaggaactagactcagtgaggttaggcaatgtacccaagatcacacagctataaagtgccaggggaaggaaacctactaatttgcagtgcctttgagtatttgctatgcttggggcaagtattctccaacaaggtcggaatcttacactcaaggaaggaaactcagtgatgagattctgtgagtcacccaaaaggagaggagaagaagacctttgagcagaagctctcagcccttcttggtcgttactctctttgcccactcatcaggccctccctccttttagaattcactctgttgccctctgtctgcaccttgactcaaaatttcacagacacagttggtaga

SEQ ID NO: 173699 - DNA, 177 bp, Homo sapiens
ccctttgtttccctttaagtcttcccatcagagcacagaatgcttcgcggacccagagccagcccccattgaccatcctgtaggggccccagaagcccagcctggcgccatcagtaaaggattatggagaggagcactggatagaacagccccaggggacaggtgcagcataagctt

SEQ ID NO: 173700 - DNA, 257 bp, Homo sapiens
ctgctacctgggacatgaaggagctctggaccgtctgattagcccatgccctaatcagaaaggagtttaaaaagtgctctctgctcaggttggctcaagagggtccggggaccatagattagtccctgggttgagaaggctgggcatggtttgattatgtgtttcctatgccttccaacagtggcaagagtagccagcccataggacggaatgaaaatcaaggtggaccttgctttagggacatctaaaagcatcca

SEQ ID NO: 173701 - DNA, 386 bp, Homo sapiens
atgcagaatggaagctgcagagcagaatgaagcagctgggcagggaaggaggcaaaggagagtcagaaatgccaggagccacagcacatgccactgctcaatgcatccacacagatgctacgcactcggtgacctggttatttctgaaagacagatcaattctaagacaggattccacccagtagttctgggttttgtttgttattatttgttgatttgcgtatttgctaaagtggtgtccagagaagtgaacatgaacctgagtctggagaaccctggaagagagagttggcatctggggaacccatgtttgattctggttgtgggcttaggttcacgaatccagatacatgcctgtcttcatgtgaaaagcagatgccctgggg

SEQ ID NO: 173702 - DNA, 544 bp, Homo sapiens
ttgtagagatgaggtctcgctatattgcccaggctggtctctaactcctgagctcaaacaatctgcccacctcagtctcccgaagtgctgggattgtaggcatgagccacctcgcctgacctctgtaccttattttgaagctattattgttcatagattcttagctcctccactccactgtgctgtgaactcgacattgctacacagatgctcctgttaagctctttgagtgcccatcagattcaatctaattcaaatctcaatcaaattgtgatgagaatctgactgtggaggagtggagagaatgccaccctgccagtatggagactggctctccagttttatagcatatgaattatatctcaataaggctgttcaaagaatctgagacttcagtcactccacaaagttagcaaagagattaaaagtaaatatggcaaaatgttagcttttctgagtgatgggaatcacaaaatattttgtcttctttatacttctctgttttctaaattttctacaaagagcattggttacttttatatga

SEQ ID NO: 173703 - DNA, 526 bp, Homo sapiens
agacatttgtcctaatgctctccctccccatgacccctacccaccaacaggtccagtgtatgatgttcccctccctgtgtccatgtgttctcgttgttcaactcccacttatgagtgagaacatgtggtatttggttttctgttcctgtgttagcttgctgaggatgatggtttccagcttcatccatgtccctgcaaaggacatgaactcattcctttttatggctgcatagtattccatggtgtgtatgtgccacattttctttatccaatctctcattgatgggcattttgatcagttccaagtctttgctattgtaaatagtgctgcaggaattgttcaactctttcagttctgcaaggtagccagaaagtcatattaggagccttatctggaagttctccaccaatcatactcccgaacatcactgcatgtgtttttacagctattgccaaatggtttgttgaattaaaaaataagaatgtgtgaaccagctttcaagtcatggtttctgtatttattaaa

SEQ ID NO: 173704 - DNA, 169 bp, Homo sapiens
actgggctcaggtgaggggccaactggagtgaaccttgggcaactcttcacgggggctaaccttccaccaagagggtcccaagcagaggtaatgggtttacagagcagagctgacttgggtttcacataggccagagggtctcaaagctgccacatattggcctatcag

SEQ ID NO: 173705 - DNA, 714 bp, Homo sapiens
ctcccttaatttcacctcaccttttagagatttggggagaataccagaacgtgtgggaaaaaaaatattagccaaaaatttaagaaaacgagaataaaaaaacaaaaagaaaaatagagatttggggataataaaaactgagacacaggttagggagcctggctctctaactgcctttggttttctactttctacggaaacaacattcacaacagaaaactacatatatcatatatgtacaactctgcattttcataaactgaacacacagttatgtaaatagcatccacaacaatattttagcaaatagtgctcaaataaaaactttgccctccaggggatatttggcagtgtctggggacatttttggttgtcttaccttggagcgaatatgataaaggtatggatgctgtgaaacatcctacaataaactggaccaccccaacaacaaagaattaccctagccccaaataccaatagtgttgttgttgaaaaatcctggttatagcaacccagaaaccttcctgtactgcttctccagaaaggacttttaccacaaaaatgcaagactccttatgctctggtagaaaagctgctgtaacatactgccatgaggaggtggtacagagcataaatgatcacagatgaaactactcacctgcctggaaagacaagagaggctgcaaggagaaaggaaaatagaacaaacatttg

SEQ ID NO: 173706 - DNA, 344 bp, Homo sapiens
taaaatagagacagagtcttacttttttgtctaggctggtctcaaactcctggcctcaaatgatcctcccgccttggcctcccaaagcactaggactacaggcatgaaccaccatacccagccctcatctttgagataaagagataagactaaacctgaggttttcaggtttaaaaacaaaccaatcgataggttgattatagataacagaacaattccttgaaatactgaaaggtcaatgttaaaaaacaaataatcgggttactctgattggagaggatgggagctggagacctacccatcagcttctcaatcaccacccacccttactctaaggcaggcag

SEQ ID NO: 173707 - DNA, 331 bp, Homo sapiens
aggcattatgatatgtgatgaccattttcaatgaacgagacaccagtggagcttacattgtacttaggagaggcagacagttgtgtagcaagccaggcaggctgggggttctcttgtagaaagggggtttgaggaagccttctgtgaggagctgaaattgaaataattagacagaaccaatgtgagtagcaggagaaaggcaagtgtgaaggatggagtcaaaggtgggcttgaggcatttgaagaggacaggtggccagcagggtgaggaagggagaatgctgtgggaagagcatggagagggaggcggcatccagagtgtgcaaggcct

SEQ ID NO: 173708 - DNA, 753 bp, Homo sapiens
caaaacctgtttcccactcaggtggcctaaaccagtgaccttggaattggcattcatcattacaacacaattcttgggctggacgcatgaaataatgaacaacgttggggaactcagggtagttggtatattgcagttgtggaccacccacaggttacttttctgtagtcattatagtgtattgtactggttttagtgttgttctcaccttctggactgaactattctagatcagagacttgtgtttttcatgccccttttccaggaggtattatgaaactttcgtgttgattgaatgagggaagacgagaggttcttcagttttgcgctcaggtaaaggagtgggtcttacagctcagtcatcctgctgggaaacacatggcaacaggtagaggccacttgataggcagctgtgctaagggtagcataattgaagagcaaaggggcacatctctaggtggagaatctctgcccttattagccactgttacggataggaggtgtaagagggtgcctgatctgtcatgtgggtcagagtgaaaaagaggttgagaaccactgatgataacggaaatatttatatgttctaggcattgggctattgtatttcctatatataatccttacagcaatcctatgaaggagataaatacccttttttgaaaagtgagaaactgaggctttgttaccaggtaatacctggtttttgaaatggtcgcatccgggtacgagctcaatcgtacctggcatagt

SEQ ID NO: 173709 - DNA, 584 bp, Homo sapiens
gaaaaggttgttggggcggggcagatacatatagacctgaacattagaagagatggctagattcaagatatagatttatgaggcatctatattaatagttgtctcaactgttttctcagaagacattaattttctgacataaatcaaagaatataaattggaaatatgaatctctacacccttcttgaaatataaacataatataaatatccacataaatggctcagtacaatgcaatcatgagttagctaccagtgccatataaaatgtagagcagaaatggattagaaaggagaatgccttcttgtatgcttagataattttcttatttcagttgatttagatgtctgtttgtactctggttgcttagtctttaaagtgattttatagggaagcaaacagttacagcaatcaactcatgaaagacataaattcactgagctacagaaataaaatgaaatctgcattgctttttccactgaccgacattcttcctctttacttaaacttctgattgtcaaggcttaattctgtgttttattgctaaaatttctaagtacttaacaaatatgatgagaaccaca

SEQ ID NO: 173710 - DNA, 227 bp, Homo sapiens
gccttcagacccttcctgtggggctcagaggccctgttggttagaagggaggcaggtgcaacgccctgcacaaactcagaaacagaaagtcaggttggaaatctggtacaaccctgctttttacatagggtaacaggcaagtccctgatgcttaggggtttggcagaacttctaaagaaactccacaaagtataggtttcccataaacctgattgctgtaggattgc

SEQ ID NO: 173711 - DNA, 369 bp, Homo sapiens
gtgcctggcctggagacggctgacgtgtgccctggtgaggggccatcgaggatgttgaggagacgccagcagatgttctgctcccaggcggacccttctgtgccccagcctggcctggcttttctctctaggcctcagggagatgtgtcaaggaaccacagtcagtgcggctgggcgccctgctcagccaggagtttgtctgcagagcaggcctcttccccagagcagcggcccagcctgttggagaggtgggtcgtttagggctcaggtccctagagttgtctttggctctttgcttccaggctgtgaaactttagataaagtcttaagcagagaaagtgacatccttgctaattagtcctcttaaga

SEQ ID NO: 173712 - DNA, 211 bp, Homo sapiens
tccttctgagttctggaatgcatttgccagtgaggaaccctcttgggaaaggctggctttctactccctgtattccttgggaaatctttggttggaggcatctgaatgaaagtaagaggtctcaaatttttttttctggatacagaactggcctgcctttcctccttcccaaaccccatcttataattcattcatatctgaacatccatgc

SEQ ID NO: 173713 - DNA, 546 bp, Homo sapiens
cggcacgaggctcaaacttttcaccaattctgacatctaaacaactaacgccagagacaggctctgtgggaccagcagctgcgacctcacctccggtcactggaacactgagctgttaaatgaaagacctctgaataagtcgtgggagccctcgggtcctgcagaccacaagggaggagcgactgatgttcactttggagacgcgggcttctgattgcacccttgccccaggccccgtgaactccaggaaaggatcttccagggacacagacaacagaacaaaatacttgtttgtcttcaaggacttcagggtcttcagcatgttcaaacccacaggtgccttcggggaccaagaggcagagagatgggaggagcggctgggtggggcccgggcagagcggaggacacaggtgtgaatttgtgcgcagccgctgctccctccggccagccgtggccaagtggacattcggacccagagcggccagatcttgtaatttccaagaaagccagaaacccagatttttatataaaatttctgaaatgtta

SEQ ID NO: 173714 - DNA, 327 bp, Homo sapiens
cctccgaaagtacaggcatgagccactatgcacagccttgtttacttttaaaatcatgaatggctgatgaattttttccagtgatttttctgagtctattgagatgaccatgtatagtttttactttattttgttaatatggtcaatttaaatgtttgatttttaaatgttagcttgcattcctgtttgtaattgccacttggtcatgatcttatccttgtcgtacattgatggatcaacttgctaatagtttgttaagaatttttatgaacatgatcatgaggggtattgatctttatcttcttgtaataaatttcatacacgtcc

SEQ ID NO: 173715 - DNA, 677 bp, Homo sapiens
tcacttgaacccgggaggcagaggttgcagtgagccaagattgtgtcactgcacttcagcctgggtgacagagtgagactccatctcacacacacacaaaaaaaaaatttagccaggtgtggttgtgcactcgtatagtcttagttactcaggaggctgaggcaggaggatcacttgagcccaggaggtcaaggctgcagtgagtgatgattgcaccactccactccagtctgggtgtcagagcaagaccctgtctctaaaaacaaacaatcaagtgacagtccctaggagagttattccaggcaaaactatgttcccagagcttggtacttactgttgccaaagaccacagcaaatgcataatatgttcatcagagtgaaggagggtgattgaagaaaatcttcaagtttaacaaaataattatttactgtccaaaaattataatcaaaagtttgcttgttgagctgagtcaaaacaaagggaattcattttagataaacatgattccagacatcatcaggctgcagccatatctaccaaagctacatctgttaggtcagatacttgagtcagtctgacaagatcccttcttctaggaacatctgttttatttggcatgaattggtgggtggtggaaggatccttccaaccctgagagtctgtgagtgacctttct

SEQ ID NO: 173716 - DNA, 201 bp, Homo sapiens
tcaaactcaaatttccctggttgtctcaaggttattttttgtagctggtttcttttttttctgaacaaggattcagtaagttcacacactgcatattgctgtagctcagcagtatcctaaggtctagattctagaatagtcccccatttccttttgttttccatgacactgactttttttttttttttttttgacagaggc

SEQ ID NO: 173717 - DNA, 523 bp, Homo sapiens
gaaatgaaaaccagaggtggctagtcattctggcaatatgactggctatccaaaagcaaagactaaaatgctagggttgtacagtaccaaatacatggagtttggagggcaggggtgttgattaccctctaaacatcctattctaacccctctggaattgcatgagcaggagggtgccaacacttggaagacagccccacagagctgcgtaggactccagcaagacagccaggacactcactttctggagaagggcttacccaggtgtaaaatgtgaactgcctgtcagtttagaagagccaccccctttttcctgattatagtagcccaacatggctctactggaaatttctgagacttactgcaacacaaatagataataactaggcttaaagtgattttgtggaataagaaaagtaggtttctaaatctaaaagagaaaaatacacacatagctatagccctgccataaggcagcggggtggactgaataaatctcactccaacattattgagccaggca

SEQ ID NO: 173718 - DNA, 651 bp, Homo sapiens
ggaacaaaggagacagggttatttataacctgacgtgtccaccctaccactctgtccagtttccactggctagaacgggaccttacattctgtatttgtcctgattggctagcaacttagaactttttaaaagaagtaaaggtagatgagaacaaaggaaggaggaagtaacttgtggaatactgagaaaggtaaaaacaccttcaaataaggaagaggaataggctgtgacctaatgcttgcttggaccagtataagcatgctagggcaaatatttaggctaaattgtgggagctaagaacataaagtgtattgatttctttatcatggctagcagatatttaagaatgttagcacaggtctttgaatacattttgcgtctaaccgagaagttactatttattcctaattaaatggggaggaaagtctttgaagaggaacctctatttactttttacaattccccctttttattttataattcctcttcaaacttctttaatatgttttgacttaattgctttgtttgtccttctaagagaagtaatttttccaaatagggtggaggagagttaggagttaactctgtaagagtggtagagacaagtttttgtataaaactttgaaggcagtgaataatataacagccta

SEQ ID NO: 173719 - DNA, 335 bp, Homo sapiens
tcaaggtggaggactacagagagaggaaaatctgcaggctgtgtcggacttggacaccccttttcatcttctcgaggaaggcatggggctgggcacctggctgggggccataaaccatcagtctggctcaaagacttgtcacacaagacctgggggcctggagccagggtggggcagctggagcctgagatgtggcctagtcacagatgtgctatgtcgggtctctaggaaagagcccagcccttaacagggtgagaatgtagacagttccttctcatgaaggcaatcagtagatgttcattaaacccctgttaggtatcagatgctctgcttgc

SEQ ID NO: 173720 - DNA, 366 bp, Homo sapiens
ctcaaccttgtatgggctccattttcccccattctacacacaattaaactgaggcacggaaaggataagtaatgagtacaaggtcactgaggcagtaggtagcagagctgatatctctatttttaaaagtgatccaggtaccacagtttgaaaaacaaaggtcccaacaaatggcatcagacattgggcagcaaatactgctgcaggactttgtatatgtttctccttatttgtctttaggtgtttttcgtatgtaagacacaggcagtgcaggggaaccttactgttttctacagaatgagaggggtctgagtccccgtctctctgaagaaaccacttttgtgtcttttatttaactcatcatgt

SEQ ID NO: 173721 - DNA, 267 bp, Homo sapiens
ctgttgtgttatattcatgagcaattgctaggtgatgaagctttgtatttgaatagcatttgacaatctacaaatgccaagtattattatgtgttaatgagtctcgactttgcatttccaagtctgcgcctctgtcctgaactctaaacttacatatccaactgcctactcaacacttcacgtagaaatcttatggtttgaacttatcctgttcaaaactgagctctcaatattttttcttcttccttcatttccccaagctgctcc

SEQ ID NO: 173722 - DNA, 390 bp, Homo sapiens
gcatacaccagcttctcaactaattctaaatgaaggacagtttaccaccaaaacacatttacacatttctattacttttggtaaatattcgagttctttgtgtcagccacaaatttaacttttcagagcttttccatcccaatccattgtttaaatcactggcttaaaattgctaagtatatcgagaattaacataaggctatgtcaaactacaaaggacaccctgcgttggggaaaagattaagtcccacgggttcctctgtgggaagtcaatataccttttaggtttttagtttctctttcaacctatctcaatcccaagcctgcatagcaatggattaatttaggacccaaaccaaatcctcttgaacagcatgcattaagcccaag

SEQ ID NO: 173723 - DNA, 242 bp, Homo sapiens
ggtagaaatcagaatgccagtacaataacttgcaattagaattattactgtcaagttgattaaaattcctgtgtcttttagctagggcactcaggctgctgtgtcattgagatagatgagttaataatactaattaagactttgtgtattaggttataactttcctttttcaggatgttgaaattttactctaactttctaactccttgagactacatccttgttccctgccttgactgtga

SEQ ID NO: 173724 - DNA, 509 bp, Homo sapiens
aatcaaacccaagttctaccatacagtcacttttgcccggtgagcttaatttagacacatagaggtcaaattacaaatggctgagctcacagaagcttcagtttctggttctagccacagggggagaaagcagagctggagacattcccagtttctaggttctcatacaaaaaccaactggctgccacagcacagtcaccgaagagggaagaagacaaggagaggtcagagttcaaactcaattccgggaattttgtcttgagattgtttgcctttctttaattttcagaattgagattcttcctgcctgggtctattacaattgactttaaactggaggaggttaaaaaaagtttcatagagtgagcaaaaaaacaatgcatctatttacgggccaagctactctcccctcccccatgcaggcacaggcaggcagggaacgatttttctggggaaagatttttctttcttttttaacgcaatgacaaacactatttactaatgttaaa

SEQ ID NO: 173725 - DNA, 106 bp, Homo sapiens
cagaatcaacatgagaatccagatagcttgcctcccacaccaaccaccccctcacatagtctaagctgcagaaaaatctgactcaaaagttatctcagacagaatc

SEQ ID NO: 173726 - DNA, 369 bp, Homo sapiens
catgggtaatatttgttataagtagctattctccaaataataaaaatgggcacttcaggcaaacagccaacattgaggatctgacctgggaaagctggtatgtgaacattaagccttccaattaaggtaaagaacggggtgggggagagggaaaaggtgaggtgcgttgttgataggagatgagatgcaaatccttaataaccgtgtacactcagcactaaggagtttagatcttaacctgtaagtgacaggatccaattgaaggtggcaatagcatagattagactctatcaaggacagaataataaatgagattctgctaagtgagaaccatttaatgagtcttttgcagtaattcggatatactat

SEQ ID NO: 173727 - DNA, 579 bp, Homo sapiens
tgagccggtccaaccctgaagtgccaaatacttgctttggcattgaaagtgttctttattttatcttggtgcctgacacactaatctgtcctgtgctgcttcaaggaagcatttgccaattttaagaacatagggcatcttgaagacttaccatgccagctttgatcactgaagtaagtggacggataggcagttagcaacaattaagttattcttttactctgttgcctttgggaatcagaagtgaatggttttatcttaagtaccaatggcttacataagattctagcctcttgagggctggagtcttttgaatttggcaactttctgctttttttgttttccacctgcagtatctctggttatgggttttatgtgacttagaaaacaaaaataaaaccttttaatccacaggacaatcagaagtgagactcttggcacatttacatgtggattgaatgattagttcaggtccagggtacagtatcaggatacaagtgtctttcagaagtccctgaaactaaatagcttaaaggaatgactgttgctacttgtgcatttagtctgaaagcaaaaaat

SEQ ID NO: 173728 - DNA, 310 bp, Homo sapiens
ggacagtgggctggaacagaccaaatggtttcagaagagataggaggaaatcagaacatttgtgtaggattcaggtggtgcaatcagctgaccttaacacagtggaattggagcctgactgctctttctaattgtattgcttttgtcattattgtttaaattaggttctggcttcttgttaattagtatgcagttagtataacactatctccataaaattcctctgcagatcgcattactaaaacataacttgatacctccttagtcagcataagccccatgtgttaagttcttttccagacaaccacca

SEQ ID NO: 173729 - DNA, 376 bp, Homo sapiens
caagcccccaccaacactgatcctaaaggaaagaaagcatggctgcagcaggcacaacaggacacagccccacccttggaacatcgtgctcctggggacaagacactggatgcggaagctggcatcctagaactgactttttcgttgagtattattactgtgtttcctggattctaaaacactattgattgcaagatgcaccattattcttttctttcaaatctagatctgcaaacgccatcattttaataactgcttttaggcggaggaaaagaaacacaaccacatcaaacgcatgcatcaactgaaacacccatcctgatttcgggaccctgaaaataagaaaaatacagcgcatcttaaaactgaaatggga

SEQ ID NO: 173730 - DNA, 199 bp, Homo sapiens
attcaaattatgattctttttataatccaaacacatcctaaatccaatagggatgatattaatatgtcggatacttataactttttttaaaggttcttaagggaaaaatgggtttgttactgaagaatatatactaatatagtttttgtgatgcttttggctgagttgtttgttttgcctataagcactttagctttac

SEQ ID NO: 173731 - DNA, 451 bp, Homo sapiens
aatgttacatgatagcttgtagggaatatcttctgtcctaaaagactttataatccatgaaacccgaagaagctgaacactgaacaacagactgactacataaaaagtaatacttttctgttttatagaactcttcatattttagagcaagtataaatgcaaatataatacaccaacaaacttacacatttttatttgactggggaattcataagtgttccttttacttttttctggtatggaaataaagaaataatatgctgggaagaaaaaaaaaaacccttttcatagttgttgtattggagtatgtgtggtgaggagactgtctagactcctaatagataatgtaataatgtttgattagttttctgaatttcctcagccactgactgagtggtaaaatctttacaagaattgaagctgaattagtaataggctttggagcacctca

SEQ ID NO: 173732 - DNA, 217 bp, Homo sapiens
caagctcctaagactgcctaaccaaaacaaagacactggtatatattttccattcatttatgagttttcaaaaaatttaggtctttattaagagttaaatataaacattaactcattgtgttacagagaaatagggtctttggaggaactgtttgaacatgggtcacagttacttgtttatgtaacacgatttagaggggtacaaagatccttggca

SEQ ID NO: 173733 - DNA, 584 bp, Homo sapiens
catccaggcaagccatcaacccattcttcagaaagcaggggctaaaatgcaagatgtttaaagccctgcggccacactgtgtcattctgacatcctgggacaaatgagatgattttaaatgtgcctggcgaatttgatcatgagactgcattttctctcgtcggtttcggcatgaattgtcccagagtctcagaaaggggggatccagggcagaattgccagtgtctgtctcgttaagctcagaatcccagcatcaggaagacattgaccggcctttaagattgcagcaagcctcgaggaagccgtccaaagggccagagtgaccggctccagttggccaccggcggcccgcacagaacctcactgcctggcccagaccagagtgagaacgcagcagcctccagcagagctgcacggccatgagggtccctgagtccagaactgagctctagatggtcacacacaagtgcccaggacaggactccaggctggatgttttctgcgaacaccgtggggaccctccctaggcaggattaaggaaaccccatgctcagtggggggcaagaccccagcctggccctgcc

SEQ ID NO: 173734 - DNA, 887 bp, Homo sapiens
tcacacccatcgtgacgctttgaaaatcgtttagattcttcctgcggcgctttcgatcctgtcttctctctggtctgcatatttttgcattattattttaggaataatctataaatgtgccctttgccttattggagcgtattaattccaaaatgcctgaagccaaaaccgtctacagaaggcagatgttagggtctgagaccccaaactagcatctgtttcctatgtcatcacccagttcccgtttttctgttgctgtctcggtcctcttctcacttagctgaaggtctttagtataaatagaatcctgatgggcctgctccgggcttcctcacgtgcgcttgtttcccgtgaaattcgtttcagccctgcggccacactgtgtcattctgacatcctgggacaaatgagatgattttaaatgtgcctggcgaatttgatcatgagactgcattttctctcgtcggtttcggcatgaattgtcccagagtctcagaaaggggggatccagggcagaattgccagtgtctgtctcgttaagctcagaatcccagcatcaggaagacattgaccggcctttaagattgcagcaagcctcgaggaagccgtccaaagggccagagtgaccggctccagttggccaccggcggcccgcacagaacctcactgcctggcccagaccagagtgagaacgcagcagcctccagcagagctgcacggccatgagggtccctgagtccagaactgagctctagatggtcacacacaagtgcccaggacaggactccaggctggatgttttctgcgaacaccgtggggaccctccctaggcaggattaaggaaaccccatgctcagtggggggcaagaccccagcctggccctgcc

SEQ ID NO: 173735 - DNA, 517 bp, Homo sapiens
cttctcattagtgatagtgagtcaaaacaaagttgatttgaagggagttggtgtagattctcacaggggaagttcccttatgctttaccacgtgctggaatcttttgaagattcttaaactgataagcaagagtctgtggatgcgttgtatccttctgcttgatgtaattaatccctgtggtggaatcaggttgatttgtttgaaaaatgccattcagcaggtcttaaaaagcatagtctgattgtggatttagtaaatatgatgtccacttctgtgaaattccctgctcgcttcacttctgtatttcagaaggtctctttctgctgggtacccttttacttagtcgtcaaaaataggtaacttgaacttttctgatagtttctattggggcctagaagaaatggtctcagtaaagacttggggtataatgatgtggctggtgttagagcagggcctgagtgccccatgtggatctaatggtcacctgcatcagtggatggcagggcctggaaggag

SEQ ID NO: 173736 - DNA, 463 bp, Homo sapiens
aatgcgtttaaattttgtggttttcatatataaatattttcctaggtgctatagaatgaactggcacttttcagtaacttaaatctggtttactttttgatgagggggaagaacagacttatctaatgatactattgaactaatagggaggcagatttgagtcaaagaagaaagcactttctaaaatattttttacccttcccaaattgaacagggtgtggtcatccagtagtttgagactacttctcaaaacactagatcattctcctacagatattacagattttatcatggtaaggggaatggctgtacctattaagataattacttttcgaccctgaaaatagcaacaagaattttgagtttcagccggtttacaatatcgagacaatgtaacacacctagaaaaggtagtgctaggttctccattttaaaaaaaactgctctgggttttctttgaatt

SEQ ID NO: 173737 - DNA, 650 bp, Homo sapiens
atgatgtgggtggcatttcactatggactacagcattaaatcagatgccgttgtgtcaggcagggatgctgtgcctccgttttcctcttctaaagttaccatacgaaggagtggtgaggcagcttttccctgctaacacacccatccctcgtctgcaggctggcactttgagacctctcttctacttcattgctgttttcaatcacgtccccacatttgacctggttatgccgggccatctcccagagatcctatcacatgacctgtggatagctcagcttgcagcagctcccattttatcttgttctgactcaggagctttgcagagaacggagtgtagttttctaccaggggtcaagatagggcctgtagaggttgtttgcttcctgggatctacattgcccaccaagaacacatgggcctgtagattttgaggtttttcttgggaaaattggaagagctaactttatgactttgcatgtttggagggatgaatgcaaactgacctttatacttatcggtcctctcttcctcccctctgatgcaacagatgtccctagtctgaggccagtcctcccactatgtcctgtggtccatcccttctcaccttctcaggagcctaacaccactgacttttccttctctctact

SEQ ID NO: 173738 - DNA, 204 bp, Homo sapiens
tatcaaaccaaagcactttaaaaaaaagtaatatgcaagactgtcggagaaaactgtgattgttactgaacagatgagacactttgagaaaagataaacaattattcatttttgtttaagacatcaggagtactaataaagaaccaactggtaaactgctgataattccatataatatatctagcactacaactacactgaatc

SEQ ID NO: 173739 - DNA, 656 bp, Homo sapiens
gctatgctgtaccagccaaggacctcctttgtttagggaaggagccattcttttaagactgggcttggtaacacaggaaaacagaaaatccagaagggaatgcatgaaaaagaaagctttttccttccagacatcaatggtgaatttgaaagagttttatagtgtgtgtgcctaagtagaattgtgaaggcaatagagctaattttcgcagtgtctgattttatgctagtttagaatgtctctctttttaacatttttaaaagtcacccttttatagtctcacaaaaatgctgtaataaagttttggaaatgttcctagacagtttggagtcttttgaactcatggttcatccatagcatcaccattctggactttgcctcaagatggtgacacattgttcagccaaaactcattttctgtgtatctgttgccctctagggactccaatatgaaaagaaacatatgatatggctatttgccaggaatcatcaggcaattgacttttcttcccatcactcattcagagttaatcttggttttcattcttgtaaacttgtatttagcacttgtgtgtcctgaacaaaattaatttttcaaaaaccaacctgaattatcctctcaaatcctagatagatggcaaacattacagtgggtc

SEQ ID NO: 173740 - DNA, 352 bp, Homo sapiens
tatttgctgcaagcttaaatccgtcacggtcactctggacttacaaatggctttaattcatttaatagatcaataattatttctaaaaatagttctaatttttgactagtcatgaggtaagaattattaattcagttcattcaaagggagactgtgtagcagaatggttaagggacacagcttctcaaaggagactacatcctgcgtttgaatctcaagtctactagttactgtgttaacttggtgaagtaacctcccctctctaaacttccacctcattttaaaaatgagtgtaacaacaattcctaatcaatattctaattcatatggttaatgtgacaagtaaatgaat

SEQ ID NO: 173741 - DNA, 1192 bp, Homo sapiens
  misc_feature (641)..(641): n is a, c, g, or t
  misc_feature (648)..(648): n is a, c, g, or t
gcagggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggcggagcagcgcctggtggtccagctgcattgcaagttcggggtgcggaagactcacaactgtccttccaggactgtgagtcctgcagggccgtcttcgacccagctcgtgcccccacatgctccgcgccccagcacgggttctgggggaggctgtttctgccttctctcctgcactggctgaagtgacgctgggcattggccgtggcgcagggtcatcctgcgcagtaccacgaggaggaggcaganagcatgncaaagcatggtgactgagatgtgctggagaggaggatttccagcagctgcaggcccaggaaggggtggccatcactttctgcctcaaggaattccgggggctcctgagcttgcagagtcagcaaacttgaatcttagcattcatttgatgctccaggcaggcccgccatcttcaccatcaaggactctttgctggacggcactttgtcttggcacactctcagacacgactcgcactcgcaggaactgggtccccagagcgtcaccagccagtggctcagctcagggctcacagaacaacccaaccggacgaatttggcaatgacgacttgactcttacatgatcggcatgggaacactataggcaaggaggtccggggtgctgcctcatcttccgggggcgcaagcgccaaaaggccgggcccccagaggagaaagggggccctcggcggggccccccaaaacgggtgtggacaaggggaggacacaggcgcgggcgagagggcgcctctcatccgcgacggtgaccgcgtgccgcaagagga

SEQ ID NO: 173742 - DNA, 915 bp, Homo sapiens
  misc_feature (364)..(364): n is a, c, g, or t
  misc_feature (371)..(371): n is a, c, g, or t
gcagggcggtgcgcgggaagggaccccggacccggaggtcgcggagagctgggcagtgttggccgctggcggagcgctggggcagcatgaagtgcctggtcacgggcggcaacgtgaaggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggcggagcagcgcctggtggtccagctgcattgcaagttcganagcatgncaaagcatggtgactgagatgtgctggagaggaggatttccagcagctgcaggcccaggaaggggtggccatcactttctgcctcaaggaattccgggggctcctgagcttgcagagtcagcaaacttgaatcttagcattcatttgatgctccaggcaggcccgccatcttcaccatcaaggactctttgctggacggcactttgtcttggcacactctcagacacgactcgcactcgcaggaactgggtccccagagcgtcaccagccagtggctcagctcagggctcacagaacaacccaaccggacgaatttggcaatgacgacttgactcttacatgatcggcatgggaacactataggcaaggaggtccggggtgctgcctcatcttccgggggcgcaagcgccaaaaggccgggcccccagaggagaaagggggccctcggcggggccccccaaaacgggtgtggacaaggggaggacacaggcgcgggcgagagggcgcctctcatccgcgacggtgaccgcgtgccgcaagagga

SEQ ID NO: 173743 - DNA, 762 bp, Homo sapiens
aatgttggttcatcagttgtaacaaatgcaccaccccatggaggatgtggataaaggaggaggctgtgcaggtgtggaagtagggaggttgggatctgtatctccctcaattttactgtgaacctaaaactgctctaaaaaaaataaagtcttagaaaaggaactaacgatacctacagaattgtgaggaggaaagatgatgttggcagaaggcctagcacagtgtttgacacatagtaagccctcagtaaatggtagctgctgctaaaaaatatcatctcactatctatcgtattggcttgatctgttttctttaaaacatctttaagatgtcttctacctgctgttttaagctcatggtagggataggtaagcttaaaacaccagccttttgaaaataaccacttgtgtttgatgaggacgtttatgaagcagatccaatatttaaaggaatcttagagtgaaatactttgggaatggttaccctttaattatggtgtctttctttgaactctcaagcttcctttgtatgattttctccccccagcgacccaccgcccttatctgcatgtgcctacatcactgtctgaaccttcttttggctctccctactaattaccacctccctctgctgctcgccctcttcactgctgttctagtctttacattgttgacagacctgattctctaaaacatccttccactcttattttcttaaaatttacattggcttaaaaaaaactgaaacaaacaaaaaagcca

SEQ ID NO: 173744 - DNA, 1296 bp, Homo sapiens
  misc_feature (783)..(783): n is a, c, g, or t
  misc_feature (808)..(808): n is a, c, g, or t
  misc_feature (833)..(833): n is a, c, g, or t
  misc_feature (926)..(926): n is a, c, g, or t
  misc_feature (948)..(948): n is a, c, g, or t
  misc_feature (954)..(954): n is a, c, g, or t
  misc_feature (959)..(959): n is a, c, g, or t
  misc_feature (972)..(972): n is a, c, g, or t
  misc_feature (975)..(975): n is a, c, g, or t
  misc_feature (1012)..(1012): n is a, c, g, or t
gaacagaagcaccccatggctaaggatggggttctgaccctggccaacaatgtgactccagccaaagatgttccaccactctcagaaacagaggcgacaccagttccaaattaaatgacatggaaattgcacaaagcacagaaaaggaataagtgaggattcccatttagaatctctgcaggatgtggggcagtcagctgacacctactttcatgatttcaccatgaaaccatcacatggaacggggaaaagagtgcatgcttgccgggccgaggaggattctgtgttagaaaaactaggggaacacggaaaccatgctacagtcaaccttctgacgctttcttcagatgacctcaggaatagccaggccagaagaaggaaggcctgtggtgagtgggacaggaaatgacatcaccaccccaccgaacaaggagctcccaccaagccagagaagaaaacaaagcctttggccaccactcaacctgcaaagacttcaacatcgaaagccaaaacacagcccacttctctccctaagcagccagctcccaccaccattggtgggttgaagtaaaaaacccatgagccttgcttcaggcttagtgccagctgccccacccaaacgccctgccgtcgcctctgccaggccttccatcttaccttcaaaagacgtgaagccaaagcccattgcagatgcaaaggctcctgagaagcgggcctcaccatccaagccagcttctgccccagcctccagatctgggtccaagagcactcagactgttgcanaaaccacaacagctgctgctgttgnctcaactggcccaagcagtaggagncccctccacgctcctgcccaagaagcccactgccattaagactgagggaaaacctgcagaagtcaagaagatgactgcaagtctgtaccagcngacttgagtcgcccaagagcanctccancagtnccatgaagaaaancancactctcagtgggacagcccccgctgcaggggtggtncccagccgagtcaaggccacaacccagtgccctccacggcacatccacaaaaccatatacatagacaagaagcacaaactacggcacaaaccacagaccaaccaaaacaccggctcaaacggccatggacaccaaaaaactgaacctgatccgaagaatgaccgacccaaggacaaatcagaacaagaacgagacacaaaaggaccacaaatgacggcaaccgaaaatcacaaaacatgggaggaatgcagaagaaacaaagacacagaagccaaacaggaaac

SEQ ID NO: 173745 - DNA, 742 bp, Homo sapiens
gttgtttcagtgtctttattttagcccttctgctagttaagtaatgtctgctttagctgcttacaacactacatttacatatcaggttaaaagattaaagtaaaattaaaaagtaatccatacttattttgtggaaaactgaaaaatacagaaatacataaaaaggaaataaagtcctgtttcttctcttaggaaaaaacccgccacactgctgtttatacctaaatcaacgtacccaactggcagacagcacgaggcaggtgccactgctttcttctcaccccagggctccacttggaactctcctcaccaggatgacaactctgccctgggcctctgctaacatccctgtggccctttgcgtcagagcctcacctgaggctttaccagacatcctcagttctcctcaaaacagacagctgcagccccagttaaagaaagcactgagggctctctcccaaatgtgagccacagacatgtcaacgggacagggcaagtgggtcccagggctccaggcagcggtgcatgcacatgtggggaggagcgccagctcgctccagaacaggtttcctcactgcttattgtcctgtaaaggctttggcagcctagtaaagcctatgggcctctctcagaataacttttttttttttttttatgagatggagtctcgctctgtcgcccaggctagaatgcagtggtgcaatcttggctcactgcaatctctgcctcccaggttcaagtg

SEQ ID NO: 173746 - DNA, 538 bp, Homo sapiens
ggattcaggcttccctggattcctgtccaggccagagccaggtggactgaggatgcctgcattatttctgagcctcagcgttccagtcctcagtgccaactcttagcaactgtgggaccttgcacaagaactcaacctccctgtgcctctgtgttattccattctattctagtctaactccatgaggtttttggaaaacttcgaaagacctaactcagaccatatgccgcttctgtacacaaccctccacggctcctagcatcctaagaattgagggaaaactcctcaccttggcactccaggtatgaaccttcttcactgtgtctccaagagtttagaaacgctggtccctttgcctgtaaccctcttccgtgccccatcacccaagttctggaaatagggaccccacccacgagcccccactgtactggacatgaggatctcgaccgtagtgacccaagaaggcactaatttggggatggagggtgaggcccagtagaggcagcgctcacctgagtcggggccctcagcgcggccg

SEQ ID NO: 173747 - DNA, 587 bp, Homo sapiens
ttatcttccccatgtccttgtggtaatacagtacagaaccaggctagaagtaggttaattcagagggagataccagtagaactgagctccctgattaagggatgtgaatttaattgggttgtgacagtctgtattaagtgtaaatgctactaataggtttaactgactttggtgtgagtgaagggacaacagaacaaaagaagtaatttgccttgaagatgatcctcttttagtgttgaagtcacaagtgatggaggcccttctttcacttaacgaggccaggaaagctgggttggtctttattctcatcatgcatcatcaatattttaggaaaggtcatattgctgtctttcacggtacactgcacaaccaagtatgattatgtgaccagaagtgaagggaaggagaacatttgcccatattctacccacactgaagtagctcaaaaatgaagagatgaagaaaggaaaatggagttgaccatttccatttaagtgctcattcagacatttagtattaaaatgatgaacttcttttgcaatctttttattgaacgcattgaactaggtattagggtgttatccttg

SEQ ID NO: 173748 - DNA, 360 bp, Homo sapiens
ctcgccggtccaatgtctgatatgagttggaggtttgatatgagttgaaggtgtggaagattaagaggaagcccaggagaaagaactgctgagggtgggaataggaggtgtgccaatttagacatgttgactggaggtagccgctggcctgcaggcacagcagggcctcatatgtggggagagcgttcagtgagcatgagagggcgctgacggaagaatcaaggagagacccatggtcacagggaggcaaagggattccaaatctgtctcattcaaaaacattttcctgtgtgaggccactattctaaatcctgagcagttctttctcctgggcttcctcttaatcttccacacctccaa

SEQ ID NO: 173749 - DNA, 231 bp, Homo sapiens
gacatgctgctctgccctgtcaggaggcactctgtgtcagcttgtcccattgctgatgatgctcactttggtcacctggctgaggtgctgtccctcaccaggtctctctattagttttctcatctttgaagtggggcttttatccccacttgcagggtggccttgaacactgactgggacaacagagtgacgtacccagcccagccaaggacaaaagtgtattcagcaggc

SEQ ID NO: 173750 - DNA, 151 bp, Homo sapiens
ttgccaggagaagctgaagctcttttctagatagagccaaggtcctattcttttcccacttggttctatgccatcttccaatatctctgtggcccacacttgtgtgcaccagcctgactgtgtccttgaattagaactgatacagaaattg

SEQ ID NO: 173751 - DNA, 136 bp, Homo sapiens
aaagaagaaaagaaaagaaagagagagaaaatttaggagaagatatagctcattatctctgaaattatgctttgaattcaaagcacagtaagggtagctaacaaagtctgttttaagcattcatactcctcttctt

SEQ ID NO: 173752 - DNA, 238 bp, Homo sapiens
aaaaaaaaaaaggcaagtctacagttttattgaggataaggttagatacaaatcagagtgctcccaaaaaatgacatcctgagtaggacaaaggtactgtggatttaagtggtcactgatgatcttaaaaaaaagttttggctgggtgcagcggctcatgcctgtaattccagcactttgggaggccaaggcgggtggatcacctgaggtcaggagtttgaggccagcctggccaaaa

SEQ ID NO: 173753 - DNA, 234 bp, Homo sapiens
aaacaactgaaatgcacatctaaaggatgaagaaattggagtgtatttcttcagtggactacaatgcagcaggaaaaggaatgtttggcatctgtgtgtatcaacatggatcaatctcacgatgtcaatcaaaaaaagcagccgcagaacgattctcatagttgactactatttgtgtaaagttacattttttggttgtggtaaaatacatataacatacaattgactatctta

SEQ ID NO: 173754 - DNA, 194 bp, Homo sapiens
tgcacccacacagactgctcttgcacacacacacactcacacacatacacagagactgcccttgcacacacacacacagagactacccttgcgcacacacagagactgcccctgtaccccacacagactgcccctgctgcctctgcttgcctatttttttttttttgggggagcggggacccactcatgtgggt

SEQ ID NO: 173755 - DNA, 5409 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggcggtgcacacggcttgagatgcctgacaacctttacacctttgtgctgaaggtgaaggaccggacagacatcatctttgaggtgggagacgagcagcagctgaattcatggatggctgagctctcggagtgcacaggccgaggcaggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173756 - DNA, 246 bp, Homo sapiens
tgataacataaagtgctgtatattctaaccaaacacaggatgtcagatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173757 - DNA, 397 bp, Homo sapiens
cggaggcgttgaatagcgggcatgtgagaggagggaacctaaagcccccacagctgctgacacagcccccaggtttgagcttgtctcccctatcacccatccccccatatagcttaatctgatgggcatctggtggtccttccctgcagtggccagagcctgagctgtccaggctgaggtttcgactgaagcaggggttgtcctgcgcccatgtgcccacacgctgcaacctggctggagcctctggcataggacacccataccaccaggtagctgtggcggaccccggctctgatacttggcaggcttgggttgagattgtggctctaggcctgggcggctctcaagggctgctgtggggagttggggaagaaccctgggttgtgctcagccagca

SEQ ID NO: 173758 - DNA, 568 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcaggtgagcccgcgtttgcccgcgctcccctcctccggggccgggagggcttttgtggggaaagaggaggccccgtgtccagttctgcccgggctctgcgcgtcacccccagcccaaaatactgccctgcagccaactcggatggaggcgttccggggtgacggctcccagcgcctacgaccccccactcagccactacccccacccacacacgtgttagggagagcgttggggtaactga

SEQ ID NO: 173759 - DNA, 222 bp, Homo sapiens
gggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaaggcttgttcctgatgctctttcttccaccagcctgagttgtctatatctcccag

SEQ ID NO: 173760 - DNA, 4548 bp, Homo sapiens
gggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaggcctggctggaagaaagagcatcaggaacaagccttgagtaccccaacttggtctcgtagagttcaaggcccaagctacaagcagcttgctccagcatccaggaggtccggcggtgcacacggcttgagatgcctgacaacctttacacctttgtgctgaaggtgaaggaccggacagacatcatctttgaggtgggagacgagcagcagctgaattcatggatggctgagctctcggagtgcacaggccgaggcaggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173761 - DNA, 5179 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggcggtgcacacggcttgagatgcctgacaacctttacacctttgtgctgaaggtgaaggaccggacagacatcatctttgaggtgggagacgagcagcagctgaattcatggatggctgagctctcggagtgcacaggccgaggcaggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaatcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173762 - DNA, 1584 bp, Homo sapiens
ggaacgcgtgggtcgacccacgcgtcggcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173763 - DNA, 936 bp, Homo sapiens
cgctgactatgtgtgtgctatatatctcatcgtctgggatactaatggaggacgtgcttcctgtaaaacctgtgaatcaatggattcaataacatctggtctattaccaggcatctcatcatgcaaaggtctatgcaaatctgtagttttgattttgttctcctgcaaataactatgtcctctgacatcaatgatggtcacagggacccaatccacatagttcagcgtctgagtcagacgctgaactatgttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173764 - DNA, 1337 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagtggccagagcctgagctgtccaggctgaggtttcgactgaagcaggggttgtcctgcgcccatgtgcccacacgctgcaacctggctggagcctctggcataggacacccataccaccaggtagctgtggcggaccccggctctgatacttggcaggcttgggttgagattgtggctctaggcctgggcggctctcaagggctgctgtggggagttggggaagaaccctgggttgtgctcagccagca

SEQ ID NO: 173765 - DNA, 488 bp, Homo sapiens
gggctggccttctgccagcacatgcttcttgggatctcagtgtgaatggtgttcaggaggctaggggaaggcaccctggacctcactacaggctcagagcctgcccagcaacaccatggatactctctctaaaagggggactcctggggagactatagacaaactcaggcctggctggaagaaagagcatcaggaacaagccttgagtaccccaacttggtctcgtagagttcaaggcccaagctacaagcagcttgctccagcatccaggaggtccggcggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcaaagaccccaaaagagcaaagaccccaaaagagcaaagaccccaaaag

SEQ ID NO: 173766 - DNA, 5152 bp, Homo sapiens
gtgtgtaatggggcctacacctgcttgcccacctgcttactccttgtcgcccccccacccacgtgtctttcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggcggtgcacacggcttgagatgcctgacaacctttacacctttgtgctgaaggtgaaggaccggacagacatcatctttgaggtgggagacgagcagcagctgaattcatggatggctgagctctcggagtgcacaggccgaggcaggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173767 - DNA, 3565 bp, Homo sapiens
aaatagctaggtacgagctgcgtgtacatcggccgagggggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 173768 - DNA, 1284 bp, Homo sapiens
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaaggtaagtaagccctgcccgcggggttgcgcactgcactgcgcccttcgccttcacccaggggagagcgcgggctggggaggtgtgatggctttccagctggtggccacagagtgtccagagggaactaggccctcttaaaaaagaacttttaggccgagtgcaatggcttatgcctgtaatcccagcactttggga

SEQ ID NO: 173769 - DNA, 613 bp, Homo sapiens
  misc_feature (55)..(55): n is a, c, g, or t
ggtattcaggcacagataggatgatgaataggaatagcatctcatatctcaatantaaaccttgaatgtaaatggcctaaatgctccactgaaaagatacagaattgcaaaatagataagaattcaccaagcaactatctgctgccttcaagagactcacctaacacataaggactcaaataaacttaaggtaaatggggttgaaaagatattccatgcaaatggacaccaatagcaagcagaggtagctattcttgtatcagacaaaacaaactttaaagcaacatcatttaaaaagacaagaggaacactaaataaagatagaaggccttgacagctgggtgcagtggcttacccctgtaatcccagcaatttgggaggctaaggcaggaggatcactggaggcctacagttcaagtcaggcttggggaaagtagtgagaccctgtctccagccaaaaaaaaaaaatttaatttaaaatatactgtactataatagtgttaattgtaagcacagtgtagtgcaaccgatctttagaatatttcaccttgaaagctgaaactctgtgcccctttcacaaaaatccttattacctggaggttttacctgacag

SEQ ID NO: 173770 - DNA, 495 bp, Homo sapiens
gggaattctagctccacaacgtgatgagaatgaatgtctggaagatgctagatacaatcctggcatattttctttgttgaataaatggtatgattgtcattacatataatattttccattgtcaaataacaggttgactttcctagttctctaacttggatgaaaattcacatgtatttaattgacattatttgagttcctgatctataaaaatagctaacacttattgaaaactgattacgcaccaacacagttctgaatgcttcacatagtcctactctacagctggtgtcattgaggcatagaggtaggtcagattaccccaggtaactcagctaggaagtgatggggccaggtatgaaaccaaacagtttgaactgttagccatctgctatgtggtctccccgagggccagcgaaataccttcaaggagcttatgaaggcaactgcctcgtggtgatgtaatagcaatgcattaagattatgtgagcagta

SEQ ID NO: 173771 - DNA, 401 bp, Homo sapiens
tgcttggttgttcaggctggagtacacttgtacaatcatggcttactgcggcctcgaactcctgggtttcaatgtgatcctcctgacctcagcctcccaagtagctgggaccacaggcacgtgccaccatgcctggctaatttttagatttttttgacatggagtctcactctgttgcccaggctggagtgcagtgacacgatctcggctcactgcaataaatcccttctaatttattagcaaatgttgttggttcaaatatatatcctaaatccatccacttctctatatttttgttaccacctccctggtccaagtcaccatcatctcccacctaaaatactgcaaccattccctgctatctttccgcttccactgttgctccctacaacctattctcc

SEQ ID NO: 173772 - DNA, 640 bp, Homo sapiens
ccatgtgagacccaggtattgcagggctggttgcttctgaggctgagatgtgtcccgtcttgctccaggcccttccccagctgttcttctccctacatttgcagacggatggcccatccgatgttgacatcatctcctttgtgtctgtctctgtgtccattggatttaatgttttagagacagatttcactgtgttgcttaggctggcctccaaccgctaggctcaagcagtcttccttcctcagcctcccaagtaactgatcacaggcatgagccactgtgcccagccacaagttccccctttttataaggacatcatttatattggcttagtgcccactgtaatgatttcatcttaacttgataatctataaagagcctgttcccagtaaggtcacattcacaggtactggggattaggactctaatttaatcttttttggggaccatgattcaaccactttaacatcatatttctaacgggtagatttttgtgctagtctttgaaattcacagccaagcagctacttgagaggctgaggcaggagaattgcttgaatccgggaggtggaggttgcagtgagccgagatcgcaccactgctctccagtctgggtgacagagagagaccgtctccaaaa

SEQ ID NO: 173773 - DNA, 139 bp, Homo sapiens
gaggaaggaaggaaggaaggaaataagggaagaatatgaagggggagaagtaagaagtgaataggcatggcttcctggagagagagaagctgggtgctcaggaatctggagtctgtgcctcagtttacccttaagactg

SEQ ID NO: 173774 - DNA, 2849 bp, Homo sapiens
  misc_feature (1)..(2): n is a, c, g, or t
  misc_feature (160)..(160): n is a, c, g, or t
  misc_feature (768)..(768): n is a, c, g, or t
  misc_feature (1772)..(1772): n is a, c, g, or t
  misc_feature (1834)..(1834): n is a, c, g, or t
nnaatgcatgtacattctctgatattattccttatatcctcgggggatgtgacttctaatgtcacacagcgtgttctccctgtgttctctttcataatatcctagtgcaattgtactcttaatgacgcagggggtgtaggcattgtgatattattcatgntattctagaaggatgctactcctaatgtcacaggggtgtacaccctgtgatagtattcataatttcccaggggtctatactcctaatgtcacagaagataacaccctgtgacattattcgtaatattctgatgagatgattctcctaatatcacagggggtgtacaccctgtgataatattcttactcctccagggggatgtcactcttaatgtcacaggtgtgttccttctgtgatattattgaaaatatgctagctgggtactactactaatgtcacaatgcgtgtacaccttgtgatattattagtaatattgtggggggatgttacccctaatgttacaggggtgtacaccgtgtgatattgctcccaatattgtagggggatgctactcctaatgtcacaggtggtgtacagccttcggtattatttgcaatctgatagagagatattactttaatgatcacagtgggtgtacatacatgggctacacccactgggataatatttgtaatatcttagggagatataactcctaatatcacagttggtgtaccccatgtgtgtacatcctgtgatattatttgtaatatccatggtaaacattncttctaatatcccacagagggtacaccctgtgatatttttcataatatcatagggagatattgcttctaataacacagtgggtgtacaccatgtgtgtacactctgtgatgtgatagcttatatcctagggagatattccttccaatatcagagtgagtgtacaccttgtgatatcattcgtaatctcctagaaagatgttgctgctaatatcacagagggtgtgcccccagtgacatcattcgaaatatcctagggagatgttaccgtaatgtcacaggggttgtacaccctgttatattattgtaatattctagggggggtgttacttttaaagtcacaggggtgtacaccctgtgatgttattcgtaatatcctaggaaggggttactcctaatatcacatgggttatcctaggaagagcttactcctaatatcacactcctaatatcacaccctgtgatagcattcggaatatccaaaagggatgttacttttaatgtcacatggggtgtacaccctttgataatattcgtaagatcctagggacatatgacttcaaatatcacgttgagtgtacacacatggtgtacacattgtgtgtgaacacctcctgtgatattatccataatatcctaggaaaatgggactcctaatatcacggtcagtggacaacctgtgatattattggtaatatcctaaagagatgttaccactaaggtcacaatgtatgtgcaccccctgatattattcgttatatccttgggggatgttactcctaatgtcacacggggtgtactccctgtgatattattcgtaatgtcctaggggtatgttactttcaatggcaccagggtgtatatcatgtgtattcaacacctgtgatactattcttaacatcctaggggcatgttcctcctaatgtcacatggggtgaacaccatatatgtacacctgctgtgatattattcgtaatatcctaggggaatattactcctgatggcncaggagatgtacaccatgtgtgtcaaccgcctgtgtcattattcttaatatcctagggagangtttccttgaatggcacaaagtgtgcgcaaaaggtcacagaagctgtgcaccttgtgatgttatctgcaataccctagaaggatgttactcctaatatgtcacaggggtgtacacactttgatattatttgtcatctcatagagagatatgacttcaaatgtcacagtggatgttcacacatagtgtataccctgtgatattattcataatatcctagggagatgcaactcctgatatcacagtgtgtgtacccggtgtgtgtacacccttgatatgagtcgtgatatccagggaaaatatgactcctcatatcacacagtatgcacaccctgtgatatttttcatcatactttagggagatattgcttctaatatcacagtgggtgtaccccatgtgtgtgtactctgtgacagtatattctgtatcctaggaaggtattactcgtaatgacacaatgggtgttcaccctgtgatatcattcttatttgaccttgctgccttttttaacccatcctacaaaaggaatggaacagataagaagatattgagattagactgcgctgctgtgcggccgccgcaggacacttttcatatccctgtttctcaggctgtagatgaaggggttcagcatgggggtgaccaccgtgtacatcactgaggccactgcacgctttctcggggaagatgacacatctgaaccgaggtaccctccaacgcctgttccataaaatcagcaaacaactgacaggtgagacccacaggtggtgaaggtttatacttcccacctgatgatgaaaccctcagaatggaggaaacaattttacagtaagagaaaagggtccccgagatgggaagaaaaccaaatacggcagcagggaaatacatgttgatgttcctggtgaaggtgtcacagaaggttcccagaagaaattaggaatttccacatccttgaagcaggtcatttgtaaggcaatcaagttgtgcagctgagagtctaaaagactgaggaaaaa

SEQ ID NO: 173775 - DNA, 342 bp, Homo sapiens
ttaaattagctaagcttgatttttctctgcaagagactgattccaaattagtgagttttctaagacgcatgaacagcaagcaatatgtgaaatgaactttatatattgtctggctccaggggcagccagtgtttctaaatgattcctgtggaccttggttaaaatttatactgcaatgtcatatgcacctaaaaatatactgactatgtcatgtctttcaggggaccttgaaggaaaagtgaagtggctggacaatttccaaaaatttagatatctacaggagattatagtgtggccaccgctttgggatagagataaaaggtttttcattccagaggtaca

SEQ ID NO: 173776 - DNA, 652 bp, Homo sapiens
taattggaatgctcgtgaatctcttacattctgtaatcaaatgaatgatatcaaagaaagaagtaatttaacataacaattgtggcttacactgaaaatatgttcctgttaataagttgcatcatgatctttaaggacttgtatgtagttagtacattttggttcatttgatatccatggtttttcttcatttttattagtgagttgttacagtggttaacaagaaatacacagatttaagctgcaatagttttcccagggttatatgatctaacttcacaagcttcttgaacatatgtagatgcttttctattttgctttacttatgacatacaattgatataggcaagcatgaaagcttgggcagattttcattgctttttctggatcttgctcaggttctgtggtatttatgtaaagcacaattttgttacttgggaatgcatgttgaaattatcatgtgcactattttgctgtaggcccgttggcactgccacaaaggtaatacactgctagtaggccatttccttgtcgactgcatttacaatttaatagaaatattacatgactttttaaacaagtgttttggcagggaggaaatggcagattccatacaaacaagcatagcttcctttcctaaaccacactccag

SEQ ID NO: 173777 - DNA, 431 bp, Homo sapiens
ccaccgctcctggcccccagttaaatatttctggaaaagagttctgttcacaaaaaattttggaatcaagggaaaaccttattaattaagatctttgataatgtggattctaaataatttcgggctaagttgaatgaaaacttaccttttcacccatgaaaaaaggagctctgtaactatattagtagcacaaacgggttcatgtgaatgtttaccctgcttaagagtaaacttttcagagttagcagcagcatttgcatacaataaatgttctaattactaatgatccttgccaattaattaaaagtatgtctgtcatggcgctgctgttcttggcagtgcttttattgacgatgagcttgtgtgcatattaaataatacagtgacatttctttttaatgtttcctaacccaggctttgtatggcagaac

SEQ ID NO: 173778 - DNA, 2708 bp, Homo sapiens
  misc_feature (20)..(20): n is a, c, g, or t
  misc_feature (205)..(205): n is a, c, g, or t
  misc_feature (213)..(213): n is a, c, g, or t
ctaaaatagatcagccacangtgcagcaaatatttttacactctctttgaatagaatcccaaccaccctcccccatgattttagaaataaaggcttcctaaaataatagaacaaattggcaaacaatcactaattggaccagtaggttcttacttaaatatctctcctagatttttagtgtatgttttgggattttatgggtttntttatttntttttttttaagcagacgttacagtttgttttaatctactatagatacgtttttgttttttggcttagttggggataaaataatttatttgtaagttagctttctaaaacttagagaaagtaatttaattcacgtatcttaaaaataaaattccaaagttaaaaaatttctgacttagtaggaagttaacaaaactactgctgatgcatttcagtttccaaaatctgtaccctccccccataaaaaagggagttaagatgtgctagtttaagtagttagctgaattatagattgatcctcttaaaatctggagtttgtaaaggggcctacataaacagtagatagacttggagggattttgtgggggaattgaaactaatagtattctatctagtttgtcagtgtttactttttgatttttatttttcagaaaattttcctttcccaggacaccctcttgtattagaatatcctcttctgtatcacattaaaaacagattttactgttagaccaaataagatgggcaaatagcaacactagagcatctcacccagtttgaactaggatgttcgtggaagttatgacaccaatatattcctgaaatgaaaattaacctaaattttaaagtgaatctatttgaaaatttacttagataatgaaacctcgttttaattgtgctttttgtgaatccaacacttgtttgcttagaaagtatcttatccagtattaatattttgttcttttgggttttaaagttgagcttattcagcctcaatcacattacagcaagcataaagtaacagttgactcaatgaaagacccaaattgcctgtacagataaaattcactgaatcaaaggcacaatagctatcttttcacttgagctcagaaaagtaaaatggcttaatttgaactattaattttcagtggcctctaattaaacaaaaacaaaaaaccacaaatactggctaggtaagatattcctgaggtcattttaaaagaagtgtggcacctaggattcaatatttaatgctaacagtattatattttagtgaaatttattttggtggtgacagtttattaaacctaattagacttctttcaatagcttgttgtagagacaatctcaagggctggaaagtgttgctaaaatgaatgtcatacatttctgatatactaaggagcttataaagtaattctttcatagtgcaagaattattaatttcttagaggatgtttttaaaggagctacttaattgggaaaatgttctttaaatatcagtaatagttcattaagtaacatagtagctaagaacatggactatattttcacagcatagttcagcttaggcacacctttagtttggattattggcattctcttacgtaggaattatatcattgtagatatgtaattatggtaataagcaattttcataaccatgctcactcagactatatcatttgaaactgccatgtttccatttttgacaattcatgttcacaaaacaacaggaacaatttcctatttggtataaagagcaaaatttccaactttgccccaaaatgccatgggtggcatattgccatatgattatatcatatatttaatcatgtatgggaaagattttggattttttttcttatttaaaaaagtgctaaatataagaatatagttttaaatcagcaagtctaataacactattgcagctgtacacagagagaaccttttgtgcctttttgcctgcagtaagcatttatttctattttacatgagttctaagaatgttgatgattattgcaccttgttcttctgtatataaacttgattaaggaatttttttttttaaagcaaggagccgttttttgttactaggtggataccttagtaaacatgaggggaattatcagatagatgtctttggagcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagaatgtgaagccactggttggcttatgccttctgatctatcattcttgcctctttttttgtaaaggggttttcttcttgttgttctgttttttaatagggtttacagctagaattttgaatgccaaagttctatttattaaattaagaaaaaagttttcaatgttaatggctagtatttttccactggactattgtttgttgatgttggaatttgtatttacagagaaataaattttttataaaaagaaaaaaaaa

SEQ ID NO: 173779 - DNA, 848 bp, Homo sapiens
tgctgattaaaaatgaatcttctttattcattaaatcaagggtgcattgtaagaatttaggattactattgccatatttctatattataatataactacatttcttttaaatatcccgtaattctgaatattcactaatttacacagacaaccctccaggtcatccaaaatggaagctgaatcataacaggtggactacgttttgtaaaactgatttgacactaagaaaacttactgattgaaatgactgaactctgctctttcaagatattccttttaatttttttggcaaagctagatatactttttgatgtggaataatatatctcaatgaattcattaataaggtcatatagttcatttgtattctgattctaggtataaattttcactttttagattttcttaagttataattatgcttataatttgttttggcatctcttatgactatcaaactgatgatttaaaatacttattcccaatgtaagtgacatgatttactcacactacattatgaaataattttttcattcaaaattaaacttcagttgtcctttcaaaaaaaaaaaaacaacaacaaaaaacaacaagccctcaacaagaaacacgcaaaaaaaaaacatgttcgggggcgcccgcgcccaaaaatctttaaaccacatcgtgggcgcggcgcccagtgtataaacagttgacaaggtccaaagaacggtccgacaggcgggttccacaaaaatgcgcggcggttgcacacgggctcggctggtaaaggcgcgaaccgccgccgcggaaatcgaacacatcagcaacaacaaaagcagaaaaaaagcagaaacacacaaacc

SEQ ID NO: 173780 - DNA, 632 bp, Homo sapiens
ccttgcgccccctggccccagcctccttcgttgagacactatttgttgagtctttcctcttttcctggccctgacctagcgtggggcgacagaagagcaatagccgggtgggggctgtgagaacggctggggttgggagcgaatttcggaaacccggaggacgagtatagccttgcaagatggaaaatgccctcccgggctggcgcggtggcctgtaatcccacctactcggggtccgaggagggaggattgcctaggcccaggactttgagaacacgcctctacagagatttacattttaagaaaattagctgagttcgggtcgggcgcagtggctcacgcctgtaatcccagcactttgggaggccgaggctggcggatcacctgaggtcaggaattcgagaccagcctgaccaaaacggcgaaacccgttctctactaaaaatacaaacactagccgggcgtggtggcagtcgcctgtaatcccagctactccagaagctgaggcaggagaatcgcttgaacccaggaggcggaggttgcagtgagccgcgatcgcgccactgccctgcagcctgggccacagagcaagactctgtctcaaaaaaaaaaaccaaaaaacaaagcaacaa

SEQ ID NO: 173781 - DNA, 669 bp, Homo sapiens
agcagcaggatgcagcaatagaattatgggacatgctaattactagaatcagaatcaaaaaatctggattaaagttccagctagcctagcgttgtgggaaagccattccctcactttctgtttcttcatgtatagagtggaacctgttctacataccaaacaagttgtaagtctcaaaaaagaaagagagagagcttgagaatgtgaaagtgttgtgaggtagtatagttatggaactgtttgacccatttatgtcctttttttgggaactcttgacaaccaaggaaagagaatacaagaaatattaaattttactaacatagattctttgtgagtgctcttaaagctgtttgataatcccactacttatctctgtttgattcccaacccactgctttctcataacaccaatttcaactcttgtcatccttctcaagccccaggcccagttccttctattttagtctcagtagataagttcttccccaattttgccaggaaggttgagcaaagcccttgagtttccctggccaccatctcaaaatgtatttcttcacttaatttccatctcactttctgtctcttcctcgcaaaggtaacctgtatccttatcacattctcatcccatttcttctctaacctttcttcatcaattatttcatgtctttc

SEQ ID NO: 173782 - DNA, 780 bp, Homo sapiens
tcgggggccccgggaagtcccctttcctctgcaggctcagaagtgcctgctccagatgcgtggcttctccagactcccagtgtctgctccgggactgagcaaagttttggtcaagtccgggcgctttgcaacccggccgggtgtgcgtacactcggggcagccctgccatgccagccccctgccgcctctgccccctccagactttgggtgccaacgagcacggggaggaaggctgaaaggggcctgcaggtcccccatggcacggatagccagggcattgcggtggacaaacctgtcaatggcagcaggaggcagataggttcccgggtggaaaggggcggtcccggtgaagccccactttgaagacagggacgacctgaggcctggggcctgtcggttcccagtggagtccaccgcgggagtgagaacttttggtgttttttccagccccgccgatggccacccatggaccaatcagcacacacttcctcccttcaaaacccgtagaagtcccagactcagctagactcgcagagagatgtcaggatgacctgcctgcggataagagcttctcactccgggtctcctctcccctgagagctggacactcctcaggaccacgtgcctgcagaaaggaactacccacttcaggtctcctgagagctgttctgtcactcaatgaagctcctctctgccttgctcaccctccagttttccatatacctcattcttcctggacttgcgacaagaactcggacccgctgaatggcgggactgaa

SEQ ID NO: 173783 - DNA, 538 bp, Homo sapiens
  misc_feature (198)..(198): n is a, c, g, or t
  misc_feature (386)..(386): n is a, c, g, or t
taaaggaatacctgaggctgggtaatttgtaaagaaaagaggtttatttgggcttgtggttctgcaggctgtacaagcctggcaccaacatctgcttggcttctgttaagggcctcagaaagtgtacaatcatggcagaatgcaaagggggaagcaggtgtatcacatggtgaaagagcaagcaagagatagagattnggggaagtgccacagtcttaaccagatctcatgtaaactcagagcaagaaataactcattccttcgaggacagcactgggccattcatgagggatctgcccccatgacccaaacacctcccaccaggcctcacctccaacattgaggattacatttcaacatgaaatttggagaggacaaaacatccnaaaccatatcagcattccaagttattgtagggtaatcatgcataagtaggtaaaaaaacccacatggtttcattcctgtcattttcctgtggtgttttttgtgtgcaacattcttaccttcccacttctccatctgacttctgcttgtcctt

SEQ ID NO: 173784 - DNA, 574 bp, Homo sapiens
acgacttcctactggcatatctgactgtaaccgaccacctcagggtccattccgatctgtatatatgtatcatgtaaacatgatttcctactggcatatctgactataactgaccacctcagggttcattccgatctgtatataagtatcatgtaaacacgagttcctgctggcatatctgactgtaaccgacctcctcagggtccattctgatctgtatatatgtatcatgtaaacacgagttcctgctggcatatctgactataaccgaccacctcagggtccattctgatctgtatatatgtatcatgtaaacatgagttcctactggcatatctgactataactgaccacctcagggtccattctgatctgtatgtatgtatcatgtaaacacgagttcctactggcatatctgactataactgaccacctcagggtccattccgatctgtatataagtatcatgtaaacacgagttcctgctggcatatctgactgtaaccgaccacctcagggtccattctgatctgtatatatgtatacatgacatctgggttcctgctggcatatc

SEQ ID NO: 173785 - DNA, 367 bp, Homo sapiens
tattgttgtatgtgtcagaattccttcctttttaaagcagaacaatattccacttatgtatatatcccattttgttcatccatccatcagtggacccttggtttgctttcacctcttagctgttataaataattctgctatgaacatgggtatacagatacctctttgagatcctgctttcagttcttttttgtgtatacctagaaatggaattgttggatcatatggtaatcctgtttttaagtttttgagaaattatcagactttgccacatcagctgcatcattttacagtgctaccagcaaggctaaagggttccaatttttccgcattgttgccctcatttgttttcttccgtgggtgtatt

SEQ ID NO: 173786 - DNA, 218 bp, Homo sapiens
cctctctcgaatcactcactctgggggaagagaagtgctatgctgtgaggatactcaggcagctgacggtgaggtccacgtggtgaggcactgaggcctcatgccaacagccaagaggaaatgaacctgccagcaaccacatgagcaagcttagaggcagggccctcccaggcaagcctcagatgaccacagccccagccaacagcttgactgcaacc

SEQ ID NO: 173787 - DNA, 302 bp, Homo sapiens
ctgtaatcccccttgcatggctgaggcacaagaatcgctcgaacctgggaggtggaggttgcagtgagcccagattgcgccactgcactccatcctgggtgacagagtgagagactctatctcaaaaaaaaaaaaaaaaaaaagacattttctacctaaccatagtgctgttatcacacccaagaagtttttaattgatgtagtattattgaatatatagtctatattcatgttttccccaattgttccaataatggttctttttagccttttttttttttttttaaaacaaaaaatctagg

SEQ ID NO: 173788 - DNA, 828 bp, Homo sapiens
  misc_feature (1)..(1): n is a, c, g, or t
  misc_feature (3)..(3): n is a, c, g, or t
  misc_feature (5)..(7): n is a, c, g, or t
ngncnnntgcctctgccatgttagaagtgcctttcgcctcccaccatgactctgaggcctacacagccacgtcgaactgcaagtccacttaaacctcttttcgttcccagtttcagtgtggtggaaaaggaagagagagctgaggcagacgatgtaagatctgctgttacttcttgctgtgtgaccttgggaaaatcaggccatgtttgtgtccacaaacaagagtgaagataatctctcctatctgagaaatccaggagtggaggaatccaatgggaactctggccaagactctactacccagacaccaaaagaagaaatgattaaccctggaggctgccttggtctaggtgaaaaaatatatgtacgatgacagtgcaatcatactagaactcaggattaagaaactcactcaaaactgctcaactacatggaaactgaacaacctgctcctgaatgactactgggtacataacaaaatgaaggcagaagtaaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagaggaaacacattcaaaagctagcagaaggcaagaaataactaaaatcagagcagaactgaaggaaatagagacacacaagaacccttcaaaaaaatcaatgaatccaggggctggttttttgaaaagatcaataaaattgatagaccgctagcaagattaat

SEQ ID NO: 173789 - DNA, 813 bp, Homo sapiens
  misc_feature (1)..(1): n is a, c, g, or t
  misc_feature (3)..(3): n is a, c, g, or t
  misc_feature (5)..(7): n is a, c, g, or t
ngncnnntgcctctgccatgttagaagtgcctttcgcctcccaccatgactctgaggcctacacagccacgtcgaactgcaagtccacttaaacctcttttcgttcccagtttcagtgtggtggaaaaggaagagagagctgaggcagacgatgtaagatctgctgttacttcttgctgtgtgaccttggggaagtgggtgtgcctgggatcacacacagctgctaaaagaaggtctcaagagccacagatgtcttggatatttctgtatttcagactctactacccagacaccaaaagaagaaatgattaaccctggaggctgccttggtctaggtgaaaaaatatatgtacgatgacagtgcaatcatactagaactcaggattaagaaactcactcaaaactgctcaactacatggaaactgaacaacctgctcctgaatgactactgggtacataacaaaatgaaggcagaagtaaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaagcaagaggaaacacattcaaaagctagcagaaggcaagaaataactaaaatcagagcagaactgaaggaaatagagacacacaagaacccttcaaaaaaatcaatgaatccaggggctggttttttgaaaagatcaataaaattgatagaccgctagcaagattaat

SEQ ID NO: 173790 - DNA, 227 bp, Homo sapiens
cctgtctccacaagctcctccactttctaatttcctgcttgtagtctaccttgggcttaaaaaaaaaaaaaatcagacaactaagccttttgggatcctatcaaaaatatgaagaaaaagactttcgggtcatcagacaggtcagctttggactaatgagtttggtgacatcctgtactgacagctcacaggccaccttggttctggacggggatccggatgctggg

SEQ ID NO: 173791 - DNA, 722 bp, Homo sapiens
tttctttttttattgtgtctcttcccagttttggtatcagaatgatgctgtttttatataatgagctgaaaaagaagtccctttttctcaatattttgaaataatattagaagtggtaccagctcttctttgtacatctggtagaattaatctgtaaatttgtctggttctttgctatttgtgattggtggccatttaagaccaattcagttttggcacttgttattggtctattcagggattcaatttcttatttgttcagtctttggaagatgtatttttgctccaaggttacagtcctcaagcttggcccagatgaactctctacttatattcatgttgcctcagttttttcttttagttagacatattatttagaatgtgccagagcagcctctatgaggggagctctcctttgattgtagtctgtttgctgtaacacccaaggatgcagagtcagattgatcccacctagaatctgcacataaggtctggcctctgcctaggatttacaagacagggccagaagactttggattgagaatgtactgaaaaccaacagaaggcattttctgtattgtgagatgtcagtgtagaaatcttgaagcccccatttgagagtgtggctcttcaagcttttcagatcttgtttagtgagtgacctgctacagttatgtgagagactccaggtataaatagaatttgatgacagaatctgtaag

SEQ ID NO: 173792 - DNA, 408 bp, Homo sapiens
aaatgggtgaattatatggtatgtgaattatatctcaatcaagctgcttaaaacgcgtgtgtgtatgtacgtacttgaaatcagcctatacgtaagatagtgtgttgtgttttctttccctgtcgtatcatgtatctttctcagtatctattacaaattttgggaactgtctaaatggcactgtttcaactgtacctaagcccacatattatagatgtctagagtaagcaacggatttggagttgcttctccagatgaattggaacgctccctggggctcttctaagagaggcaggtgggtagcagagtctgttcaggaagctgggcagacgccctggctgctgtccgtaccgcttgatggccacacagaggcttctctttctggcttaggatctgcctagggagggc

SEQ ID NO: 173793 - DNA, 235 bp, Homo sapiens
gccatatttatctggtattggttggctgtagccagactggagttctaagtaataaggggactatgctttcctttcacctcaggtaagaaattgtattcaacacatgcttaaacccaataataagtataattaatgctgtatagatctggcaggcaaattagcatcctaaatttgagtcaagtaaaaaaagtaccaaaagaaaatagttcccccaagaaacctagccaaatctgtg

SEQ ID NO: 173794 - DNA, 103 bp, Homo sapiens
gatttcaaagctccttttggctggccccagaaatacatttcttagaagaaatgctagaagtacctaatttggaacagaagatttacatatttggtggggaaag

SEQ ID NO: 173795 - DNA, 637 bp, Homo sapiens
ctcacatgaatggacagtcactgagggaacttcatatgtaggcttgagttcaggtatatgaaatgcaggctaagttttaattagaatttatttacagctcgaagctgctcctttgtttttctgcctgaagtcagtaatgaaccattcctctttgcctagtcattagtattcagagctccatcagcctgcagttcaaaccctttcccttgtttttgtcagagaagatgatggagcaaggttgcttagaaacacttagccacactctcaacgggaattatcaatctgtgctgtatgttcacccccacacgcaggggagaaaattgagttttactgctgatgacgttaattgattgcaagttgttttagtgggagtgtgatgttgaaaactagatttcctttcatttttatgcattagatgcagagaagctatacagtgacatgttcattccactgtaactaaaaatatcatagaggtatctaaatttggttttgtatgttttatattcagatcttgacactggtcagcttacaggattatctttgggttggagactgtttctgtagtgatttctttagttcccagtaaattcacacagtcatctccttcaatagagttctgattagtgcagtcaggggg

SEQ ID NO: 173796 - DNA, 346 bp, Homo sapiens
cttagaacttacattctagtttcatgaagctgcaggcttcttctcctcacctcagggtctcaccacatgctacattgtgcttagccaatttcaactcattcttcaggtctcagcttagacatccttcctcagggaattattctctgaccctaccctactaagttagttccttcttacatgatccatgactctgaactgtttagtgttactcaatgcaactaaaattatttattcaacatccaccttcttatatccccaggccctcacacagtacctggcacacagaaggcattcaaaatatttgtttattggccaggcacagtggttaatgcctgcaatcctagca

SEQ ID NO: 173797 - DNA, 239 bp, Homo sapiens
tgagctctggccatccctctgacgttgctgtagccacgctggcctcattgtcctggaacattccagggatactcccctgacttagggcttctgtgctagctctcgctgcctgatgtcttctgtggatatcctcgaggccctggatatccctcccccaggctcggctcagacaccacaactccaaagtggcccagtgccctccctgagcgtcggtccagaacggcactctcgtccctcct

SEQ ID NO: 173798 - DNA, 510 bp, Homo sapiens
cagagcctttaagaggtgattgggtcatgagggtactgtcctcatgaatgaatgaatgttgttatcttgggattgggctagtgatttggagactgagtttgttataaagatgagtttggcttgatttcctctctgtcttgcgtgctcttttctgccttcagccttccaccatgggatgaccctcaccagatgccagtgccatctgttacaataaatacaatacatacattctgttacagcaatagaaaatggactaagacagacttactgtgagtcactgtgagtgttcaatgtggcacagtaaacttaaaatgcccacctcagtgcctggccatggcagatgttccagaactgtccattccttgcccttctctacttccaacatgggattaggggatggcattgatattggcacaagtgttctggctagtgagtttccatgtggcttaatcctgaaatccatccttctcatttcctataaactaagttttacaatttccttaaagttta

SEQ ID NO: 173799 - DNA, 313 bp, Homo sapiens
gtaagctgttgtaggttgtgttcccaggcagctgatcctgagatggagattagcatgcaggaagttgattagggatatcaatcatattggattagagggagaaaaaagaaagaaagttgactagggagtgctctcatgatcaacacctgcaggaaagggagggaagcagggttggtgggggagaagctgggttggtatgtagcctctgcaaaagcctcctctgatccctgaagaactttgaatccagggtgacccttcaaagctattccaggtatcattgggggagggggcctttatatcccccacccttaca

SEQ ID NO: 173800 - DNA, 241 bp, Homo sapiens
ctaactgctgcttctcagagggcaccatccgctcacatgcctgtgtatctttgcttagtaaccctgaccacttagggagttcctgctcatcttttattcagttcaaatgataacatcatgaagtctttcccagccaccctctttgcttattccacacaattatttcgtgtaattatgtacttacagtgtcttttctgctaggcagtgaacttctctttcatttattttgtaagtatttgtt

SEQ ID NO: 173801 - DNA, 385 bp, Homo sapiens
ccacacctgtagccccttctgactccactcaaatcacagttctgctctcgacttgctgtgtggcctttgggaagttactctgctcatcctcggagacctcatccatgggacagggggtaatggtacctagcttttgggtttttcttaggatggactgggctcattgtgcatggaaagtgctagcccagggttgggctacggaagcactctgttacctgctgctgtttctcagaagtgagccctttggcatggagagctggaggaagaggacgaatgctcaaggtctcagggctggagaggaaatcatgatcatggggtggcaaaggacctcaaggcactgccagacactctgggctcttggagaactgttcagtgttggggataa

SEQ ID NO: 173802 - DNA, 658 bp, Homo sapiens
gcatcagagtgagaccctgcctctaaaaagaataaagttaaaaaacaaaaatagaacacacctccccaggtaaacaaatgcaggggtagtagctaaagcactgtcactgtaaatgaacagccacacctggtgactagtaggcccccaggtatccccctgggctgggtttcagggatggggccctgccattccttctggcacaatcctagagctggcctagggtccactgagctcacttgcctcttttggccccgatgcagtgggcacttctccacctgcacatgttcacctccaggaggcaggctgggaaagaagcttgttacaaagaacaaacgtttccaggtaaacactgtcagctgtgatggcataaaacaggtccccatgtctgatcatacggttttttttccccacacacgttttttctattgtacttttggcttcacgcttctctattttcaatgaagtgaagaagaaccttatttcaataagctttttgaaaaattagaatcaggggctgagttgaaagaatagaatgaaatagagctctacaatgtattaatatgggaaatctacaagatacagtaagtaatgaaaacaatgactcgatgtcatttgttaggaagataggtacttatacacgctggcacaaaaaacaaac

SEQ ID NO: 173803 - DNA, 316 bp, Homo sapiens
ttacagtctttaaggagatgggaatgttttactaagtgttttgagtgtatttggaatattaataagttcttatggaaacaaagtttgggtgtacatggaaccaggagtttttcagagctaaaagaaggtagtacattttatttaaataaattgtcagaaagagaaaagggctaaaaacaaagctgaaaatgtgatagaaacctagaatttttatttctaggagggttactcattcaagccagtcttcttattatctttgaggaaacagaggcttatgagtcaagtatgtcatttacccagagctttgaccacatct

SEQ ID NO: 173804 - DNA, 504 bp, Homo sapiens
aatcaagagatttattaaattgtaaacattaaaatggaaaaaaaaattcggtcttaaatttctgcttcactgctattccggactcttctgcggatttacaagctatgtactgtctaacctctagtacggtttataacatcacaagggtggcttatcgcattgcctggagggattgaccatgactatcaagaagaataaaaatattgccatacaattggtagagcaatattttggaacttaaaaacccctaccaccacccctaccatagaccaagcttgaaaggcagaaatttaacacagaatgattacagccttatagaaacaaagacaggaccaatcaccagaagctcagccctttcagaataaagtttggtatcacatccttgctcaaacaaatccaatcatccgttgaggtgtgctggatcacggatggtaaaagaagaaagtcatatatatttgactgtatattagctgcagctttatgactacttgcaaatcttgctta

SEQ ID NO: 173805 - DNA, 536 bp, Homo sapiens
gacaagtttgccttgggcccacaattccttgagccttcccacttccagctcaatgtattcgcttttattcctacttaaaaaccttccccatatgattcaacttttggcctttatccacattcctctcaaattcttcccccgttcttgcctctttcgcagatcaaaactatgcaatatcttcctccttatgatgcatatgttctaaaacttctttgattaaacttttttatattactgaacataaacattcgacttctgcctgtatatttttgaaaatatttccaaacatatgtggccatcttgtatgtgtatgtacatgttagcctaacacattttttttttgagacagagacttgctctgttgcccaggctggagtgcagtggcaccatctcggctcactgcagcctctacctcctgggttcaagcgattctcctacctcagcctcctgagtagctgggatgacaggtgtatgccaccacgcctggctaatttttgtatttttagtagagatgaggttttgccattttagctggg

SEQ ID NO: 173806 - DNA, 211 bp, Homo sapiens
gttttaattgatagtgtagcagctactttgaaattgtatcattttgcctaagggaggaaatattctgtgaaatatcttgtttggttggttcgagaaagttatttgtctgggcacagtggctcatgcctgtaatcccaacacttccggaggctgaggtgggaggatggcttgaggatagaagttgggcaacatagtgagacctcatctccac

SEQ ID NO: 173807 - DNA, 246 bp, Homo sapiens
cttacccacctgtaaggccaggaacccttttaaaccagaccagtttctcaagtctgagtgtgttgtttctgttcctaaaaaccacaaaagaaagaaaacagtgatattacattcaacgtggtaacaactctgaatctttgttctaacagtggaaatataatatctctagggattaagcccggtctccagaatgtacccgggccataggaaaataacatccagatgttttttaacagcacctacaag

SEQ ID NO: 173808 - DNA, 292 bp, Homo sapiens
tgcagcacaggcttcccttgcttcaggagatcaagagagaggagaatgagggaagtgaagatagtaattccctgaaccccctccctgtagcatcactgtggactggctgtgttacgtgaccaaatgccccaaacacagcttctttgtgttttgtaactacactctctcctttctgctttcagcttaggcgtgatttgggggccccaatgttactgcgtctcccttgtgatctttttaatccctgcccatacctctgtttatagtcttttattaaactcttcaatgtttccta

SEQ ID NO: 173809 - DNA, 107 bp, Homo sapiens
agctcaaaccaaacctgcctaaaatccatcctgtcactttccttcctaaactaagccttctgatgtttttaattctgtcattagaaaattcaatttcggcagggcac

SEQ ID NO: 173810 - DNA, 294 bp, Homo sapiens
ccatgtgtcgatttactagtagatcctactcctccctggcataactctcaagaaagtcatctccctcaccatacccccttgtcttcccccataatatcacccccttttccctatctatcctcagatggaaagagacagacacataaattaatctgttctcagctcctaactcccaagctctccagtgctcaggttgttccacagcacctaatccttccctatagtttccgcccaatcctggcatcctcagcccctcactccaaaccccaacctttttccccactccccaaatcc

SEQ ID NO: 173811 - DNA, 146 bp, Homo sapiens
ccttccagtttcttaagcatccgctcaatccttctctaagtaggtgtagttccatagagagaggaaactttggggaaggaattaatcaaaagtctctgggatatatacttttaagtttcctaaaaataacatgctctctcttgcct

SEQ ID NO: 173812 - DNA, 259 bp, Homo sapiens
ataatttgttgacacccttccataaatcctgtattctggggccacctttaaagctgtaatacttaaggaacaccctccaaccaaatacatcactaggtttgaattttgccatgtatgtggtagtggtctttgccataccctctgtttgtacaaataatcaagagttgtatttgtagacattaataagatctctctttatggcttagaaaataagtccaaactgatgggtctttggtaacgcatttattggaaggcaaga

SEQ ID NO: 173813 - DNA, 224 bp, Homo sapiens
ttgtaactatactagaatgattggtgatttgtttgtttgattgtttgtttgtttgtttttcctctgaggcaggtttatcttaacttagaggtggaaaccctttgttacttagtccagtgttacaatgggtttgcatgctctctgcatgcatcaggagatggcagcaggagggggccaggagcacgctgcgtggtaggagaacatgatcctagaattaaacattc

SEQ ID NO: 173814 - DNA, 460 bp, Homo sapiens
tgcgaagcgggtcgcagagagagatgggcgttgcagaatcagctggggtcacttatttccggtctcactccagatgaaggagccactagccggcgagagttcaccgagggaacgtgacactcatatctcatcgagggaccgtgttgagggagcccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaaggtgggcagagggttcaagaaaggaaggatttgggatcagcgtaccagggttggggagacagggcaggagcccagctttttctgcat

SEQ ID NO: 173815 - DNA, 339 bp, Homo sapiens
cgtgacatctccgcttacgtgaaacaatctccccctacagagaggccaaaggaggagagggcctacggagaaatgaacctctgtaaaagctgctctttagggatcagtctttttgtgactctagcttcatagcttggtctctccattactccagccttcctttcaatcatacactgcctctctccagcaccaccaatggatacttcttttctaaaaatgtttttctgtgggttgctgccgtgtctgtgagaaggtgggcagagggttcaagaaaggaaggatttgggatcagcgtaccagggttggggagacagggcaggagcccagctttttctgcat

SEQ ID NO: 173816 - DNA, 365 bp, Homo sapiens
caggtacttccatctcccattgcttcattcctactttgtcagctgtttaacctgcacccaacagacgtacttgcaacgagttcccaggaccatcattcactctttccctgattccgtcaatgaagccactgccctccaaatctcctccattggagaccacagatttgtaaacagatgcaaggaagcaaggtaaagagcatggtctctggaatctagcaggcccagattaagatcccagcttcaccactcactgcggggtaacactgagaaatgtacttcacctttttgcttctggttcctcatctgtaaagtggcatgtaacccactggactgttccaaaattacatcatacgatgtacataaag

SEQ ID NO: 173817 - DNA, 187 bp, Homo sapiens
gaagagcctacacaatcacctttatttccttatttctgctaatttcttggtctactgcaatctggctttcggctgctataactccacggacactgctatcaaggtcatcttcattttatcaacacattgtctaattgccacatctggattgatttaaaaaatctacaaaatcacttgtgacctttgg

SEQ ID NO: 173818 - DNA, 204 bp, Homo sapiens
ctcaagtagtcctgacaccaagcctcctcctaaaccgcccacctccatatatacacatatgtgaacacacaaacctgctttgatcacaccagttgcctcacttgcaatgcaccttcgcccaagttattggctgaagccaggactttcatggggattcaagcagaaagtctgggttatgggaaagaaggcatttagttggccggg

SEQ ID NO: 173819 - DNA, 440 bp, Homo sapiens
cccagcctaagatgcattttattcacttaagagagctaacctgttcagattatgaattgacaagtcatatcaattctagttttgagtgactttcagaagacaatcacacacctcatctataaatcagcatatgtctgtaacatcttccaaaactcaggagggcagatgaaagccattctcacacatgtcgttcacatcatcagcagaaactgtgcgttagtgggtggaattccttttgcttagttgtatgatggtgatagctaataaaaatggcatttaaaaatgaatgtctaaaacttgggctaacccaggaaattacaggcatcttaggaataaaaagacaaaaagagacaaagaactgttctttaaaagtgcaaggaacagagtgagggcaaaggaaaaggtttcttctggaggagggaggaaaaacaacaacaaca

SEQ ID NO: 173820 - DNA, 549 bp, Homo sapiens
  misc_feature (522)..(522): n is a, c, g, or t
atgtggtctacctcctctcctgaaaaataccatccaccgaagcagagcttaaatcaaaggacacagagtgtaatgcacttgtctaacacaattgctttctaggcctgatgtaagttgtttgaaacccagtggtacccggtcacctttggcctagttagtacttttcctctccgtgtgattgtttgagataaaacctgtttgttcttcatcccactgacccaaaactctgcaaagcccacagctgctgaccatgataaaacataatggtcagcccgagtcatgtaaataagctcttccccttgcatgtgcaatccacaacccccacaggaaggcccaagggatcacgtccatggcttagtcccacaggtccccactctctctctccttctctctctcacccaccacccatcacttggctctctgtttgtctgttattagtgtataagaatgcttgtgattttggcacattgcttttttatcctgagactttgctgaagttgcttatcagcataaggagatttngggctgagatgatagggttttctagat

SEQ ID NO: 173821 - DNA, 330 bp, Homo sapiens
ttcaccagcccagcctccaccttcctgtgtccactcgggccatgcctgtcctcaggcgcttggctacgcccagactagagagcatttcctgcacctggtagataccaaacccccgtccaggtgccactccccctggacaatccctggctttgccactcacacattccctttctgaagtcccaatgcctctcccttcttcttgcctatctacacgtttctgggacatctactttgttctaggctctgttctagggattccgcagtaaataaatgagataaaatcctctgccccccccggaaatgaaactctatttgagaagaataataaca

SEQ ID NO: 173822 - DNA, 280 bp, Homo sapiens
tcttcacagagttctcagtactggaggctgaggataaagaacagaggttcagtgccctacgcctgactcttcccagctgagtacctggtacctgcatggttctgacttcataaagcagaggacgctcaaggaggcagctggacagatgttctaggaccatcgtcttccaataggcagaccaaagcctgactggagtaacagagcatccccccaaccccatcccaatggatgccctgctctggggccgggtgggcattttataaacccagaccagaggatg

SEQ ID NO: 173823 - DNA, 589 bp, Homo sapiens
atgtttctgctattctgcacattatggaacagccagaaattcaaagtgaggaaatactgatggtgtcagtgatttagaagttgtgatatgattggtttgacttgctgatgagataaaaagaagagctggtactggtgatcagagacaagtcctgcttataccaaaatggagaaatattagttaaagtagaaaagatgaagaggaagacaaaggaaagcagaaaagaaaaaagtcctaagtgatgagaagcagcccaatgtcactggcatcatatggccagaaaacaggatcttgaagaacatatgatttgggaaaatctctcaatagagtaacagagctgacttggaaaattgtgtgaaaggataagtcaagctatttactactttttaaatagcctttaaaggaatcgcaacataaaagatgtttcattttaagtctgacaacagttgaaaaagttgagttcaatagctctgcaagtttaaatggttcattaggcatcaatattaataattcaatatggcatttctcttgcagtttgactaaagaaaaatgttggctctaattcactttattaattaaacacaatttg

SEQ ID NO: 173824 - DNA, 226 bp, Homo sapiens
ccagagttaaaaaatagctacaccaagaaaaataatatttataaatgcagttttttaatcatttttattccattctccttttctctgtgctttctatagtcacattgtgctgtataatattttatagaaatatagaacttgctttttcctaaaaataagtagcaattacattttaaagggagcatgaataaattaattcagagcacataaaatgttcacaactact

SEQ ID NO: 173825 - DNA, 183 bp, Homo sapiens
aacaccaaagccatcatcttgtcaccattcagaaaaaggaggccttgatttttgctgctgttccttctccatcccccaggacagcatgtgagtctatttagataatcacagtcccaggtgaatctgcactgagcattttttccattctcttactcgtgaaatgttcatttgggaaaaagaagt

SEQ ID NO: 173826 - DNA, 443 bp, Homo sapiens
ccccacgtcactccccacattggttcctcccggaacaatctctttcacacacacacacacctccccactcccagttcctgtgtccctaactgtggtggtgagccactctcgccacctccagttttcttttcctaactgacttggcgagccactcttgcatcctatgttggttggggtgtgagtttcatccgaattggcgagccactcttgctgcccccaacctctctgggtcagactactagttacaccatgggaggtgatcaggctccccttctgtccttatgggaagggtcctgccttgggccccaaaaccttaccgcggtccagtagcacactgttcctagtaatcatctggtagcccctctcaggttccattgcactgctgggtggggatgcctggtcacagaagagctgatttcccctccaggctgaagttctcctgg

SEQ ID NO: 173827 - DNA, 503 bp, Homo sapiens
gaggtatgaataagatactggtttctggagtgtggcaggtgcttttgtcctttttcaccttgaacctccagtaccattctccaccatcagtaatagaatcacatgcatcattttgtgatgtacctaggtcctcagtgattacagtcactttggctttactagaattctagtaggttaaaaaataaaatgtggttgcactgcaaatgaatttgctcccatagagatgtacacatttacaacacaggttaatttatgactagccttttttgtttttttagtcagtgagcctcgtttaaacattttatgctgccaaataaagatcatagactatcagtttaggttcttatgtataaggtttccagtaaggcacatagataatttttactttaaaattgtgtggcctcaggtattcatttattcagcaaatatttattgagcaatggctatgtcagccaatatgcaatattaattatctttcatttttaacatggaagacagctcta

SEQ ID NO: 173828 - DNA, 729 bp, Homo sapiens
cagcctcctggtgactctcgcctcctcttttccagcggacgctaccagaggacgaaggtctgactctggccaacggcccagaatttctggcccagttttgcctgaggaagccaactgtgcaggaggtcaggatcccggtagggtgagagtgggaaagttaacattcccaagagactccaagcaacaggatttcctgacctgggactattacctttctcacattacatggccagatttacttcctgctattattaaaagtacgaaaaagatgaagatatgtgtttaatggaaacaagggcaagagtttgcctgactggactttgaggaggctgtaggatcatggcgctaacggcatttggagggctgggaagggactctagccctggctttacctgcctttgtcatcagctggagcaagcaactccgcaacctcggagcctcagtttccttttctgtaaaaggcggggagggtgggtggtaagtgcaatgctgaatcagaactcatagagctgctgggtggacatgtgaagtaaaagaggagacagcttttgctcctgaaggatgccatttgcgttttcctcatcagtttgatctcctccaatcatccagcacctccatctgaccttctcagctgagaggtcctcagtgtttctgtggcctccaggagaaaggtccccctccccggtgaggccaggtgatggaggctgcacggccagccttccacagtca

SEQ ID NO: 173829 - DNA, 463 bp, Homo sapiens
aggacagtctatgactgcatgatgattttaactaccttccttcttctccagatcctccaaggcagaaaatcagaaaagcaactagagagatggaaatggattttttttttaagtaaagcatttaacattgaaccacaagacttactgagttatgtaatagcagaaatatcattgttgattttgtgacatgtcagtgctttcctaaaagtgcagtgtggcatattttttaaagattaaattgaattaaatatcaatttctattttaagaatttgagtagtgtgagataattggaaaggccccggagtgtttcagtaatggttgagaatcattgttcttaataatagaagtgaactctgaaatgccaagcattttatatactctggctaacctatctttaaagtaataatgtttctaatgcactggagctcatggcccccattggcaatcaccttgactcttccc

SEQ ID NO: 173830 - DNA, 679 bp, Homo sapiens
gagctctcattcactgctgtgggaatgcaaaatggtacccgctttggaagacagtttggcagtttcttacaaaacaaaacatatttttaccatccgacccagcattcacacttctttgtatttacccaaaggagttgacaacttatgtccacacaaaacctgcacatgggtgtttatagctttattcataattgccgaaacttggaagaaaccaagatgtccttcagtaggtggatagatataaactgtggtacatccagacaatacaagattattcaatgctaaaaagaaatgaggtatcaagccatgaaaagacatggaggaaacacagatgcatattactaagtgaaagaagccaatctgaaattgtgattttcctacaaggaaattccttgtggacaaaggacagacagaactcaaaatcctccttctgctcacgtgagacaaatgcatgtctgatctgcttcctctgacctactgtttcactaagccaaactaaggtagaagtggctattcctctacaccaccccacatgtagattgtgtttttggtgaaaggctggctgatcagagactcaaaagaatgcaaacatttgtctcttacctacctatgacccagaagtcccttcccccactttgagttgtcccacctttccggaccgaaccaatgtacaccttac

SEQ ID NO: 173831 - DNA, 404 bp, Homo sapiens
ggcacccccagagaggttcagctgcaaagatgacagcccattacattattatgatgggtaggtgggatcttccaggacccagattcctccactccaaactagcatgctggcttcacctttgaagaagaaacggacttgaaatgagactggggatgaggggccagcaggggcagattgtgcaggaccgtgaaggcacacagaagctgtgggccacccagaggccaatgctaagccgctgggagtcaccgccactgctcaccaagctcttgccacattggcgtcctttcagttcgtacaagaggccgaggtctttcctgccttcatctctttccacatacagtttcctctgccccctctgctcttgcccccacacctcactttgtgaacttctatttatcctttag

SEQ ID NO: 173832 - DNA, 519 bp, Homo sapiens
ggccttgggtaccatggctgaggtggagagtctggcagcctttctcagagaagagggtcctgtgggcagggactctgagatgctgctgccacccttcctgatgcccagtgctaagagtggaacagtcatcccttcatgccttgtttctcataggtaccctgggggtgagcttatcctcctgcagcgtccctggttccaaacccaccttcgagctctcagccgacgaggtggagctgggcctgggtaagcttgtggccatccatcccagccctgcctgctccttggccctggactttgcccaccttgcatacccttagagccatcaacctggtcctctccccaggtggtcttagtatttttacctggtcatttgaggcccagcctgggccaacctgcctgatttctacctgctttgctgtctatacccacagctttggccatgtggagctctgtgcactgcccacctcctagcctttgcctgccattcccaggtcctcagagtcctgccaagaatacacc

SEQ ID NO: 173833 - DNA, 2365 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173834 - DNA, 2411 bp, Homo sapiens
  misc_feature (1111)..(1113): n is a, c, g, or t
  misc_feature (1182)..(1182): n is a, c, g, or t
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcgggagtgaacgatttnnncccgttgcccttggattggagccaaccctttccattgttccaggccaaccttgggaagcaaattgcccnttgagccaatttctctccttcatctcacttccttgctaggtgcgatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173835 - DNA, 2991 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttctcagcattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactcaggagttcaagaccagtctgggcaacatggtaaaaccctgtctctaccaaaaaatacaaaattagccaggcatagtagtgtgtgcctatagtcctaacttgggaggctgagttgggaggatggcttgggcccaggaggtcgaggctgcggtgagccataagcatgccactatactccagcctgggcaacaaagcgagaccctgtctcaaaaaa

SEQ ID NO: 173836 - DNA, 2541 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatggctggagtgcaatggcgcaatctcggctcaccacaacctccgcctcccaggttcaagcaattctcctgcctcagcctcccgagtagctggaattacagacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaaggtaggtggtccctctggcacaggccgccctaaggccaaggccccccagatgcagctcattcctggctccctctgacagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173837 - DNA, 1613 bp, Homo sapiens
aatccccaggccttgagtgggtcagcagtgaccacatctatccgcagggatccacggggaagctggtgtgcgccggataaaggtaggtggtccctctggcacaggccgccctaaggccaaggccccccagatgcagctcattcctggctccctctgacagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173838 - DNA, 1412 bp, Homo sapiens
tgcctgccaggaggaaatcaggacatctccctcccgacctcagagccccagcttccaaggtccttgcttttctgttgttttctttccctgatgcccatttttcccttttggactgccacactctggtattgcagagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173839 - DNA, 2041 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaaggtgagtgaggctgggcccagccacctggggagacaggcttctagccagcagactcctgtctccatgtgaccctgagcaagttaataaccttcctggaccgcagtttccttctctgtacaatggagatgagcacctatctcagaaggtggttatgtggctaaggaaatatgtagagccccgcacactgcctgggatgtgacagggcctcagtgaatggtgacccttttccctgctggaagtagat

SEQ ID NO: 173840 - DNA, 1153 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctgggtaagcttgtggccatccatcccagccctgcctgctccttggccctggactttgcccaccttgcatacccttagagccatcaacctggtcctctccccaggtggtcttagtatttttacctggtcatttgaggcccagcctgggccaacctgcctgatttctacctgctttgctgtctatacccacagctttggccatgtggagctctgtgcactgcccacctcctagcctttgcctgccattcccaggtcctcagagtcctgccaagaatacacc

SEQ ID NO: 173841 - DNA, 1049 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatctacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaagaaagacactgcctcctctgagggaccttttcccaagcatgtaaacaagggggcccacagccctggctgcaggcatcatgacccatcttctaccaggcagatctttattacctgagcccctaaggcagtgtctcctcagctgggctgcttccactgagacccccgacccatcccctttccagtacacacacctgatgcatgtaagaatggtagaggggcttttctcagcattgaattaataattcagtggctcctcgggagtcgaatgggcatttgggacaccagaaggaaaagaaatcatcatagtctaaggttcagttgtagatcaaaaaatgcagccaggccgggcacggtggctcacacctgcaatcccagcactttgggaggccaaggcaggcggatcccttacactcaggagttcaagaccagtctgggcaacatggtaaaaccctgtctctaccaaaaaatacaaaattagccaggcatagtagtgtgtgcctatagtcctaacttgggaggctgagttgggaggatggcttgggcccaggaggtcgaggctgcggtgagccataagcatgccactatactccagcctgggcaacaaagcgagaccctgtctcaaaaaa

SEQ ID NO: 173842 - DNA, 423 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatctacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173843 - DNA, 115 bp, Homo sapiens
cttgtatcgttacccactcctgcaggtgctgctgctgcctccactgtactcagacccaggtagcacaggattgtccatcctccagcagctcagtgcaacggtgtgaactcagcct

SEQ ID NO: 173844 - DNA, 804 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctaggctactctgaagcaggtggcttagccctggccctggctggatgcaggacaggttggcagggaggcagcagagccaaattttgtacaaaggagctggtgctagcaagctcaggaagaagccacagccggaagttcaccttgccaggacctggctcagctgcaggttcccaccgggccaccagacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaagggatgctgatggggctcatcgcgaggcagctggtgtacaacccttcccccaggcaagaggagcagaatcacatcggaagaccatccagcgctcgaggagccaacgccaggcacaagtggagaacgcacactaatacggcaacgacataaaatgagcgaatcggataagatccagaactggaaccaag

SEQ ID NO: 173845 - DNA, 2467 bp, Homo sapiens
cgcctctttccgccagcgcccgcaggacccggatgagagcgcacgcttcggggtctccgggaagtcgcggcgccttcggatgtggcggatgcggccgtgagccggcgggggagttcctccagatccagctggtgccctcgcctgacgtttgaacgaccacctgctcacctcctcccttttgcgcgttgattcttcagacttcaaagggcccaccggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173846 - DNA, 2728 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatggctggagtgcaatggcgcaatctcggctcaccacaacctccgcctcccaggttcaagcaattctcctgcctcagcctcccgagtagctggaattacagacctaggctactctgaagcaggtggcttagccctggccctggctggatgcaggacaggttggcagggaggcagcagagccaaattttgtacaaaggagctggtgctagcaagctcaggaagaagccacagccggaagttcaccttgccaggacctggctcagctgcaggttcccaccgggccaccagacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaaggtaggtggtccctctggcacaggccgccctaaggccaaggccccccagatgcagctcattcctggctccctctgacagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173847 - DNA, 1809 bp, Homo sapiens
ggccttgggtaccatggctgaggtggagagtctggcagcctttctcagagaagagggtcctgtgggcagggactctgagatgctgctgccacccttcctgatgcccagtgctaagagtggaacagtcatcccttcatgccttgtttctcataggtaccctgggggtgagcttatcctcctgcagcgtccctggttccaaacccaccttcgagctctcagccgacgaggtggagctgggcctggggatccacggggaagctggtgtgcgccggataaaggtaggtggtccctctggcacaggccgccctaaggccaaggccccccagatgcagctcattcctggctccctctgacagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173848 - DNA, 2310 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccaccaacgcgtcccatgtgcctgtgcagcccggctcctcagttgtgatgatggtcaacaacctgggtggcctgtcattcctggaactgggcatcatagccgacgctaccgtccgctccctggagggccgcggggtgaagattgcccgtgccctggtgggcaccttcatgtcagcactggagatgcctggcatttctctcaccctcctgctggtggatgagcctctcctgaaactgatagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccaccccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173849 - DNA, 1401 bp, Homo sapiens
cactggactagaaggagttggtattaggatcctcctcagagaggcctgaccctttcccagggaccctctctccatacccctgtatacagtaggcactcagtccatgcttgtcgaggtggactcccttcctccagggctgctgagaaagccaggccaccagggtcaggatgggagggtccaagccctgctgaatccctggctggacagccgtgtctaagagagttatcttgctgcccttagatgctgaaaccactgcagcagcctggcctaacgtggctgcagtctccattactgggcggaagcggagccgggtagcccctgccgagccccaggaggcccctgattccactgctgcaggaggctcagcctcgaagcggatggcgctggtgctggaacgggtgtgcagcactctcctgggcctggaggaacacctgaatgccctggaccgggctgctggtgacggcgactgtggcaccacccacagccgtgcggccagagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaa

SEQ ID NO: 173850 - DNA, 999 bp, Homo sapiens
cgcctctttccgccagcgcccgcaggacccggatgagagcgcacgcttcggggtctccgggaagtcgcggcgccttcggatgtggcggatgcggccgtgagccggcgggggaggtgctgctgctgcctccactgtactcagacccaggtagcacaggattgtccatcctccagcagctcagtgcaacggtgtgaactcagcctgtttcagagcctccacaccatgacctccaagaagctggtgaactcggtggctggctgtgctgatgacgctcttgctggcctggtggcctgcaaccccaacctgcagctcctgcagggccaccgcgtggccctccgttctgacctggacagcctcaagggccgggtggcactgctgtcgggtgggggctctggccatgagcctgcccatgctggtttcatagggaaggggatgctgactggggtcatcgcgggagctgtgttcacctccccggcagtgggcagcatcctggcagccatcagggccgtggcccaggccggcacagtggggacgctccttatcgtgaagaactacactggggatcggctcaacttcggcctggcccgggagcaggcccgggctgaaggcatcccggtggagatggtggtgattggggacgacagcgccttcactgtcctgaagaaggcaggccggcgggggctgtgcggcacggtgcttatacacaaggtggcaggtgctctggctgaggctggtgtggggctggaggagatcgcaaagcaggtgaacgtggtcgccaaggccatgggtaccctgggggtgagcttatcctcctgcagcgtccctggttccaaacccaccttcgagctctcagccgacgaggtggagctgggcctggggatccacggggaagctggtgtgcgccggataaagatggcaaccgccgatgagattgtgaaactcatgctcgaccacatgacaaacaccgtgcttatctcaatccggtaccggctcgatctt

SEQ ID NO: 173851 - DNA, 246 bp, Homo sapiens
cacctgcccataaatccttcagagactctgaaaattaagccattttctcgactggcaacgaatcccttaagattcatgcaggaacaaggaagagattgtcccccacgggcactcctggctgggtcggatctgtgtgacagtgaaaaactgtccccaggatcccattcatatatgaaacccatccacatctgccctacggggaggtgtggaatcagacttaaaacctccataaaagaaacactggaa

SEQ ID NO: 173852 - DNA, 176 bp, Homo sapiens
ccccgggccgcctccccccagcgcgcgtccgccccggggctcgcgccgccgccgccgccgccgccgcgcgcgcgcagctcaagtaaaggaggaaaaaaaaaagggggaaaaatagaaagcggcggcggctgcagcagcgatccgccgccggactgggccaagccgggcggcggccg

SEQ ID NO: 173853 - DNA, 473 bp, Homo sapiens
tgaatcaggtcttcacaaagcagctcttcttttgccagtcccatctctgctactctaaatcatgccactcactcttgcttctgcttggccacgttttctcagatccattcaggctccttaaacattagcgtccatctcctttggcccactaacgacgtgagccttcctaaccaatgcccctgctgcaccacttccggctcaacagcccatgggctctactgtgaaagctaaagaggggccaaggtgaaaaccctgccacagctgaaaccgtcgtctctttactctgccttctaaagttctgaagatttcacccttctctctaccctgcagccacaccagcacccttcctgaatgcatcccctgtgcacccagagttctgcacctaagttttatgtcagccacttccctttgaccttcttttctctttgactttacttacccttcattgattggtatatgtttaatgatagtga

SEQ ID NO: 173854 - DNA, 469 bp, Homo sapiens
gcaagtggcctctagaagctggaaaaagcaaggaaacatattttcctctagagcttccagaaggacacagccctgccttgattccattccttaagagtcatttcagacttccaacctctagacagtaagataatagatttgtgtgtgtaagccactgaatttccaataatgtgttacaggagcaatagaaaattaatacatggaacaccacaagttttcccaaacagccagtacccaggactatgtctgggccaaacctactccacaattccctcagatggttgtgactttctacatctggttggatttcacccataaaccattaacacagccacagacactaacagttcacatccaatcacatctcccaggccacctcttgcaccaaaacccttggttatactgcacatctgacttccggtttggagaagatgtttttatacccatatctcagatacacaccaacctc

SEQ ID NO: 173855 - DNA, 132 bp, Homo sapiens
ccctttaaagtaagaacattgcaaccctctcaaaagattgttagtatcaaagtaaggattaagtagaatatagaacagaatatttttattgatttaaaaatggtattacttcaggttttacaaaacctatat

SEQ ID NO: 173856 - DNA, 746 bp, Homo sapiens
ttattataagatacctcatataattagtcatgtttggatattgcattctcatcaagaagaaatcaaaattgttacctgggcatggtggtgtgcatctgtagtagcagctacttggaaggcccaaggccagaggattgactgcttgagcccaggagtcagagactagcctgggcagtatagcaagaccctgtttctaaaaaagaaaaataaaaaaataaaataaattggccaggtgtggtgtttcacacctgtaatcccagcactttgtgagactgaggtggaggatcacttgaacccaggagtttgagctgtgtttgtaccactgcactccagcctgagcgacagagagaggccttgtctcccctgtccccccccaaaaaaattaagatagttttctttttacctagatttctttgaagtaataattttgcatctagtaatagtacatttttttcttttttaaaagtagacttaatttttttagagtagttctaagttcatagcaaaattggacagaaagtacagagatttcccatattcccccttcccctacacataaatagcctcccctgttatcaacatccctcactagtgtggtacatatatatctgttgatgaaccttccttgacagatccttaatacgcaaggtccatagtttacattagggttcaatcttgctgttatacgttctatgggtttggactaatgtatactgacacgtatattgcatttttattggcagaat

SEQ ID NO: 173857 - DNA, 734 bp, Homo sapiens
gctggaaccaaggggcttcgtcatgtcctctctcctgttgctcctgttccccaggaacagcctcagtctgtttctcaactctgctccccaccctagcttcttacacctcctttattccccatccattcttccagtttctccaggcttcagctgaggcttgtgcaccctgcagataacgagaggaggaaggcctcgccagggctgttggctgaggtgggatggcattggctgaggttaagagagaggaacaggcagtcagtggcagagcaggtcagcaggacagtggagcagggcgcacgagattatggctccaggcaatggcaaagcctacttctcggcctgagggggagagcggtgccatgcatgctgggcacttgggtttctgcacacagctcagtgacagacaccctggcctctgtccctgatgcagaagggaaagggaagcatgcagtgaaggtggagagggagccgtgcctcattttcttgcccagtggagaatcaaaccgaggttctttctttcagccacagtcctcaagtgctaactataatgctcatcctgtgtgaagtgtgagggacaccagtgtcctggctttccagagctcacagccctgcaccaccccaagtgataagcctctggccagctggccctcccatttccaagctgtcctcatgttctgcctctgcccctttgcctccctgtgctggagatcacccaggactgctcccactcaggg

SEQ ID NO: 173858 - DNA, 231 bp, Homo sapiens
aatgcaaagaaacctccctgccttcatggagctcacactctaatggggggggataggggagagagctaaatagtaaaaagagctgacgtggtttaacatcacagaccaccaggcgcagtggctctcgcctgtaatcccagcactttgggaggctgaggcaagaggatcacttgagttcagaagttcaagaccagcctgggtaacatagtgagacaccccccaatctctaca

SEQ ID NO: 173859 - DNA, 689 bp, Homo sapiens
aactgaaaaggaaagactcctccctatgcaatctatgaggccagcctcatcctgatagcaaaacctggcagagataaaacaaaaaaagaaaacttcaggccaatatcatgatgaacattgatgcaaaaatcctcaacaaaatactgcaaatcaaatcgagcagcgcatcaaaaagcttatgcaccatgatcaagtaggcttaattcccaggactcaaggttggttcaacatatgcaaatcaataaatatgattcatcacataaacagaactaaagagaaaaaccacatgattatctcaataggtgcgaaaaaaggtttatcagaaaattcaacatccattcatgttaaaaactctcaataaactaggtattgaaggaagatacctcaaaataataagacccatgtacgacaaactcacagccaacatcacactaaatgggaaaaagctgaacacattcccccccgcaaaaaatggcacaagacaaggatgccctctctcaagactcatattcaacatggtaatggaagttctggccaaggaaatcaggcaagagaaagaaataaagggcattgaaatagtctgcaaagaatccccctgtggtttctagattctatatctagaaaaccacattgtctcaacctgaaagcttcttaagctgataaacaacttcagcaaagtttcaggatac

SEQ ID NO: 173860 - DNA, 451 bp, Homo sapiens
gcccccagacaccacccccactcttggatcaagaacccagaaagccccactgcacggggaggaggctcccagacctcatcccccaactctgagcagccccttccatgtcccaaaggtccaggctggtccaggaaggtaactggagagatggaccccagagagggcaaggattccccagccagagagggacagggacagggctaaggtcatgctgtccagggaaggccgagggatccagggttctagtctctgagaccacctgtaggattgaggcgagacagtgggaagaacttccccagaccactagggctggggctccccagagtgagcaggggtgctgccccacccccacccccaccctgaggcttcccggctggggcgggcagccttggaggcgggcggtggcggctgcctgggagaagatgaatctttcatgagtgatttgcggccg

SEQ ID NO: 173861 - DNA, 529 bp, Homo sapiens
tgatttgaagagcgtgctctcattagattgactgcataggatccaggccttaacatggataagtgggcttggatatgccaggctgatgaattccagatttaccttaactggggagttaatgtggcctaagttccacatgtggaataggagcctttgtcacctttttggactgctggcttatattaaatggcctcacatctccatagcaccttgaatggtgttaaatctatagtagcagcagaaataatattagctgacatttactgctttgccaggtcctttatgttccattatctcataaatttataagatgtagtagtgtgcaataattattcccatcttgcacctctgaagcttaaggggacagtatttcaacttcggccttttttataggagaatgagccaagctctggttactttacttactgtgtctctttccacacctcctaggcaggttaaaagcagtgataagagagaagctggcaaacctagttagtcctgagagcccaaagatacgggagagaggaaa

SEQ ID NO: 173862 - DNA, 422 bp, Homo sapiens
gcacactcattcgtttatccaacaagcatttataccaagtgcttattgcttaccaggcactgtaaagtcttcagtgatacatggctggaaaaggaagccacaatctctgctctcataaagcttaaactctattgagaaagccaggcatttaacaagtatttgcataaatggtgagtgctcccaagagttttgcagtctgctgcttaagaggcaccaaacaaaccagcagagcagtcattaaacgcagttatcaccagcacgctgaacaaaggcttctcaggtttcaaagtgcacacaaataacttgaaatcctggtaaagcagatactgattcagttgatgtgcagcggggcttcacattctgcattacttgagtctgaggtgacagggatgctgctggtacaccatccacacttggaatag

SEQ ID NO: 173863 - DNA, 651 bp, Homo sapiens
atccagatgctgtcgtgtttggtgtatgattagggaacacgtcctagttcatgaatgctttttctctgtgccctcacttggcagaaggggtgaaggagatctggggtctgttgtataagagcactaagtactaatcccattcattagggctttgctctcatgaccaactacctgtaaaaatcccccctcctaataccgtcacatctgtgattggctttcagcatataaattttggggaagacaaacattcagaccacagcagatgtttattatttcctttcctctgcttgctttgggtttaagtcactcttcttttatctagttgcttaaggtagaagtcaaagtcattgatttaagactcttctaatgtagacattcagcagtgctaaaaatttgtattcaagtacagctgtagctgcattccacaaattctggttgatgaatttttattcagttcagaatattttctattttctatttctattttcattacctgtttgacccagggttatttagatgtgtgttacttagtttccaaatatttgtgtatttgccagagttatttttgttatcggtctttaatctgattgatttgtggtcagggcacatactttgtatgacttaaatccttctgactcaatcctttgagag

SEQ ID NO: 173864 - DNA, 529 bp, Homo sapiens
ctcggcctcccaaagtgctgggattacagtcttttctgtgagtgtgtttgtgtatgtgcttattgacagttgacatgttctctgttggaagattttagggaaagtaaagtgacttttcagtaattctgtaatgccatttgaccacatgaatttcccctcgccccaaaaggagagaaaaaactgaaactgctggcacagactgtacaagacagtgacgtaagatgccaaagttatgcagataaaatgggatatgtcacaggtggtaaaagagtttttgcaattgcttgtttccaagctaatggcagaactgtgttctgtccagtggaccctggttaagaaagtccttttcataaagatatacaaacaaaaaacgtgaaaggtgaattaagtactttacattccctcctttagtttccaaaagtaggttatgtgtgaaacaaggctttggaatactttttaatatgatttcttgtccttagttatgatttttaactttaaaatgtgattattggtttggatcagtttttaa

SEQ ID NO: 173865 - DNA, 248 bp, Homo sapiens
tgaagaccaggaagagagtcctcacaagaacctgattatgtcggcaccttgacactgaacttccagcctctaaaaattgtgagataatgaatttatgttggttaagtcatctagtctatggtattttgctgtggcactaagctgccatggcagcacaggcatattaagactatatatgtggaaaaatgttctattacacaacatttttccaaaagggatcctcatgaaacttccatccgttgaacacc

SEQ ID NO: 173866 - DNA, 319 bp, Homo sapiens
tggggtacatgtgcactttgttacatgcataggttatgtagtggtcaagtcagggcttttaggatatcccatcacctggataacatacattatacccattaactaatttctcatcatcttcgcctcttcctatcccctcactcttccaaatcttcattatctatcatgccatcattaaaggcattttctgaaatgtagttctgataatgtacttcccttctcataaaagaaagagagggacctccagtcacctgtggaataatctgaagttttaatcttgacattcaaggccttctgtgatttagaccccaacagctcg

SEQ ID NO: 173867 - DNA, 199 bp, Homo sapiens
aactgcagactattttgatattttcagtccacatcacaaacatgtattaaattgactgagtggcacatgttgctaggtcctggtaatatgaaaatgtcatggagtctctgctaacagcctagagattgggaatcagagaccatgtctaggagagatttgtaggggaaatattctcaactaaggcttgaagtatgattag

SEQ ID NO: 173868 - DNA, 257 bp, Homo sapiens
gaaaaaaaaaaaagtgaccatgtgaacacattgatagggtcctccctgggtttttagaagcaggttttacaagcaaggggtcctgaaacaagcttcatcagtttcacagaaaatcctcctctgtgggttactgacagcatacaaaaggacccaacatcacgtgacatttggtcaagatgacccttagtgaatttcccagtattgtaattacataaacctctgtttatttattaattgaatggccctttgacccctta

SEQ ID NO: 173869 - DNA, 152 bp, Homo sapiens
tccacctgcttcggcctcccaaagtgctgggattacaggcgtgagccaccatgcccagcatcatcaatagtttttgagcattctctatgctccaggaaacacactaggtaatacctatcacacagcaacattgtcaggaatgtcttaatttc

SEQ ID NO: 173870 - DNA, 239 bp, Homo sapiens
ttgcaaatgctgttccctctgcctatagtacattgtcctgattcatttcttcttatccttcaggataaaattttgaaacatcacctcctcagaaaagtcttccttgctccccaaccccgaaactaggtcacgtttccctgttatctttaggactttgttacttgctactcaatcctggtactactacaaattttaattatgattgttaaggaaggcttatctgattcagtcagaaccag

SEQ ID NO: 173871 - DNA, 569 bp, Homo sapiens
ctggcccagtgtgtgtctagaactagggcctggaatgagggtttcaggactctgcctgctgccctattctgctgtggttgagctagtatccaagttggaagatgaagtcctctttattgttccctctcctctcctcaagtggaaggaaaaggtctttcctggagctgtgagctgcactgcctgaggttgggggagcagtgacacaagcacccactttactgtaccagcagctggtgtatatatgtaggccacatgcaccccgagtctgctggttctgagcccagacttgcccaggaattgccatccttgtggcctggactgcctttcaagtttatttaggaccccagagtactttagccattaacccaatacattgttgctgtgatcatctggaacaaactgttattttttctgtaaatgggatggcaaagcctggatgacagcgtatcagtttatagcatggtttatgaatattttaagcccactatcgagacctgctgctcaaagaacagattccttccaaaatagtaagaattgacaatttttaatttttaataaattaatttaat

SEQ ID NO: 173872 - DNA, 513 bp, Homo sapiens
tcagggctgcgggctcagggatgtgcgggttctcaaaagagcagcggagtccgagccgagtccgctgacgggctcacgagcgctgcgcctattggctccctggcacgtcggcgtccctcgctcgcgcgggcgcggccaataggggcgcggggccggacgcgcggcctcggtggcgggggcgcgggcccggcgcggcgcggcgcggggagcggcggtagtggccgtgacgtcacgggagggggtcggcgccgcccgccagcagccggattacaagcgaacgcgcccggcagcggccggagtcgcccggcatcgcgtctccgccgcttcctccttctgtgcctgctccttctcgtcgtcctcctcttcctcctcctcctcgggttgccgcaaccgctgcggccgtgtctgccccgcaactttccaagaaagttcagaaactcggctacggggctgccgagtggcgcgcggctgccacctcgggagccgcgggggagttccgagggcgcgcggccg

SEQ ID NO: 173873 - DNA, 673 bp, Homo sapiens
tggagtcacacgatcactgcccagtcattgacagaagcagaggggagaagagctgggggtttcgttgccacaacctcactgtgatccaacatgtaactgatgccaagaggttaccccgacctcctctggctgcttctggagaaatctgccgttcagagcagggaaggggtagacagcccccatgctctgccctgaccaaggcccatcggggtcatgggatgtccagggcactaattagccagtgtcagaagagggtggccaggatgagggggggctctggaggccaacacatgggaaagacccctgaggatgctgggctagaggagagaaagtccaggaacataagggcctccttcaaaaacctgaaggcaacctggggaattactgtgctctcgtttctagaggtgactaagcaaagatgggctatgtgactcttgattccaataggaacttctgctcagtttgggaagccggcccaggccacagccctctggtagagcattaaggctgtgtacaggccctggcacaggccgaccctctgaccaggtccgaagtcccctttcttagactaccagaagtgcttctcaaatccatctcctccctggattctttctggattgactagagaacagctgaagctttcttccaggccacacccaatctcacagccccc

SEQ ID NO: 173874 - DNA, 221 bp, Homo sapiens
ttcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagct

SEQ ID NO: 173875 - DNA, 516 bp, Homo sapiens
ccagcttgaacgacagcgcatggccgtgctggaaggggttgttggttaacaacaggttccctctgccgagaatgccctacctacttgctttctaatgaactactgtactactgtttttaaacgtccacttactgggtaattaggatgtttcaaaaactatattccaagtacttgctccaatttactgtcaagaagagtttagcaaaatctaataacttgcttaagatcacaaccctagaaagtgtcacaaagatttcaacttagttaagtttgagtcaaaagattaatttctcaacttcctcttctattcttcatccttcaagacaggaggcattctggaacagtagaaagagccctggttttgaagtcagacctgagttaaaagcctgactctatcacttattagctatgtaaccccacagtgtgtattctctatatcccaggattaaaagagtaaatgctttaatatgtgtaaaagccctaaccaagcaacatagtaagatgtcaacaaatggc

SEQ ID NO: 173876 - DNA, 793 bp, Homo sapiens
aggtgtatgtttaaagctgttggcaattaaattgttggcaatcatattttcctagtccatttacccttctactctcttaggacaccaatcacattttcctctaaccacaaacttcaaatgtcttctctgttatcctcattttcaactgatgacatcacttcctaacttttctgagaaaaattaaaagaacttccaagaacgaccagaattctagactcataaatccaaccacctacttgacatctcctcttagatgtctgacattcacattaatatgttcaaaatgaattctggctggctttcaggaagacaaacacactcttccctgtttctcccactaaaaacaactaaaagctctgaacattatgtataaaataacacaagaacactctgaaaggtggaaagaactgggtagaacagttagagacctcaggatatgtgaaacaacatggtggtgacttccttaggtttttctttttacctcatatatcccaggctaaagacaaaaaataaaaatggcagacttcagctctaacatatccatagtgcagtaaatgtaaatgacctaaatacatcaattaaaaaacagagactggcagactcaactacatgatgtccatagaaagctcattttatttttttctttttgagacagggtctcgctttgtcacttaggctggagtgctgcacaaacacattcatagcagctttattcataatagccaaaaactggaaacaatcaggcatccttcaacagataaataaagtgtagtctacctataccatagaatat

SEQ ID NO: 173877 - DNA, 528 bp, Homo sapiens
gctgtatccgtacagcgcatgcatataaaagtgcagttataagtttgccttttgcaaatgttaagcctagtttgcaaagttcttgctatcttttactattgacctggtactattaaaatcattcttaggattgagaaattgtatatctgtcttaaagtaagaccctgtagaaattatgagattgtgtacttgtcacaagtgattttttcttttttttggtggggtaggcggttagtataaatatggcatgttcttcagctatttttcaaagtttgattcacggtaattatactcagagtactttgaacattatgtaacacattttttagttcattataatcaattgcaattagtttttacttttgaagtatgctattagatgtgaatttatttgctttgtatgggatatttctttacagaaatgcacgtacccacagactggacaggactttattcttttataactacagacggattatacaggatagtatgtgagcctgctgttctgccatttggtacggataaacg

SEQ ID NO: 173878 - DNA, 178 bp, Homo sapiens
gggtcgtctctagagttccctagacagcggacccctttaatgaaagagatactgcaagactcattcttgggcagtgtaggcaggagagaacgaatacatagtgagaggatagaggattcatgcaataacatcccaaggaggtggatccaaagccagccggggggtcaagagccacagt

SEQ ID NO: 173879 - DNA, 278 bp, Homo sapiens
gggattccaattcaacatgagatttgggcggggacacagattcaaaccatattgttccacctctggtctctcccaaatctcatgtccttctcatatttcaaaatactaccggctgcgtgcagtggttcacgcctgtaatcccagcactttgggtggccgaggcaggcagatcagaaggtcaggagatcgagaccatcctggccaacaaggtgaaacctcatctctacaaaaatacaaaaaattagccaggcatggtgatggaggcctgtagtcccagc

SEQ ID NO: 173880 - DNA, 151 bp, Homo sapiens
ggattacaggcgtgagccaccacgcccggccacattcactttttaaaaaacatgtttttctttcacctgcaaccatattattttttactgttatactgcactttcttcagctcacacaggaaagtaatactggactttgctcctctgtcat

SEQ ID NO: 173881 - DNA, 681 bp, Homo sapiens
caggttccccgaggccgccttttttcttgctaagcccttggcctaccatcccggaagcctgaggcgtcctgtgggaaaggactggctcgccgtcatatttgtgacccaggcagggtggagagaaaactaagctgctttggtaatagtttccgggaattcgggagtcaagaataaagcacttcgacctaaaaatagagatccagagtctagacagggggtcaccgtgggctagcacccctcagggttagttttatcctggggcactgcaggctgtcaggactgcctgggcccttacttggtatttggcattagtcaggcattattgggaacaatatttgagtttttcttgcttgaatgtctgctactggatcgtctcggggccgtcttgttttcacaatctcaaaggtttggcttctgcactcccagcccctaaggtaatttgccctttgctcccctccctggaggggacccttccgaatctaatttattaagcaacaccaggcaattagaatattgagactctatggggcccttgcccttgagcaactaaattttttattgaagacgaaatatacatgcatgaacaatgtaaggacaagggtgtcctaagtgccaaattcctggaagcaataaatgcagaaggattcggatgggtagaaattgttaggtgaagagtggata

SEQ ID NO: 173882 - DNA, 341 bp, Homo sapiens
cactaagcctagtttacgatgctccttgaattctatttctctttagctcttcatcagtctctgtaatcatatccacacagcacattacaatttgattaccaactcacagccggagtaattacttcttcttcaactgacaatacatatatcaaactcacacaacaggagccctccaaaatccatcccagaccttgccctaagcagagcaagagggagcagagccagggaccctgctgagttttcctatcctgggacttaatatcagtatctggagaggttcccacatccagattagagaaacagaacaggatcaccaaggactggggcagaaacaatttagc

SEQ ID NO: 173883 - DNA, 292 bp, Homo sapiens
attgtttgaagagagaggagagtggctggcaaaagagatgccaaagacaaatgaagaaggaaacaaaaatctagagtgttatacaaaaatgatgtatcaaagtcacagtagatcagatcacatataaggccatattaatctgtgtgaaaaaattgaatctatttaggatatatattcaactccacatatatatacacacacacacacacacacacacacacacactcatattcaccaccactcaggtacatacttctcttatggttttgttttggcctcttcaccaagcctt

SEQ ID NO: 173884 - DNA, 536 bp, Homo sapiens
cttctgccacccctctgggccatgcctttgtgccaccttcccgcgcggctcgtacactctgtcccggtccggtaggtgttcgctgaaggttaaccttcgttgaaggaattgagggaaggagagctttgtgttgaagttgagccttgggctcaacaggcggtgtgggtgtaagagccgggtgtgggtcccagctcgacccttcccctgtgtgctccacatctccgagccttggttttggaggctcccgaagcccaattggcaggagagttgggaacaagtgggcgcgtgctgttaagggaggtcttggcatgacagaatttgcttggaatgattagcgttgcccaagggctgtcgctgtcagaaaaacaaaacaaaacaaaaaacaaacggggtccgaagcagctcctggagaaaataggtgttggagagtcgccatgaagtggactctaggtgcatggcacgcagagacctgtgacgggggagggtggccatggcagagtcagataacaggggtgtgggagacacctcttgggaat

SEQ ID NO: 173885 - DNA, 199 bp, Homo sapiens
attagggttcactgtaatccaatatgaccatattttaacttgattacatccttaaagatcctatttccaaataaagtcacattcacaggtaccaggagttaaaacttcagcatatctttttctgggaccaacccacaacagacattctattgtatttttctcatattgtgtttctcaaatttatggtccatatctcaag

SEQ ID NO: 173886 - DNA, 423 bp, Homo sapiens
gtttatcattcacagctgtgtttgtctacttgtttctacgtgtgttgccatcaaatagttcttctgtaagggttatgccctgaagaaaaataacagaaaattttatatataatgaattctaataagatgaaggacacatgactgcactttgcacagtcatgagttatgaatcaagatttttgcggtcgttggaatagagagacgaaagtagcagaaaaatggagttagtgcatggtgcacggtactgaaggcggggctgatatgtagccatagttcctgaggcagcctctggagttgctgatggctagtgtttgtcctgataactctcaatgtcttttctgatttgttgggactgtaccatcctggctgtcaaatttctgagtatcaccctgtgtattcctctgccaaacccaagagaacttg

SEQ ID NO: 173887 - DNA, 582 bp, Homo sapiens
atggtctcagggcagcattctttccgagagggcaagtcccaatgcacaggacttagggagcagatttgccaataccccattggccaaagccgtgaaaatcacatagccagacctagagtcaatcagtgaaagaccagaaaagggcagtgctaaggaacccaaagaggagggaattctaccaggacggtgcccatccaacacttgtgttaccttgggagccagtacctccttaaattcagggcccaaagtgcctcaacttgcttcaccccaattccagcctgaatcctcaggacttggcaactcagaggtcaatttccttaacaccccaacatgaatttcggaagttagtttcacagaaatcttaagcaccaaatacaactgagcgaaagcaattctgcacgtcaaaaacaaggtggtctaaagtttgcaaactttatggcagtctggcttgatgaaatataaagcccacaatgcttttaaacagttttggccaggcacagtggctcacgcctgtaatcccagcattttgggaggctgaggcgggcagatcacctgaggccaggagtttgagaccagccttgc

SEQ ID NO: 173888 - DNA, 516 bp, Homo sapiens
ggagtttgagacaagcctgggcagcataaagagacccccatctctaaaaaaaaaaaaatagaaaaattagccagacatgatgatgccaacctgtagtcctggctacttgggaagctgaggtaggaggatcgcttgagcccaggaatttgaggctgcagtgaactatgattacaccactgtactccagccagggtgacagagcaagaccctatctctaaaactatttttaaaaatcttaaaggattcttttccccaaggatattaactcaaggtaaattataataggattgcagataaattaagcatctttatctttgattacagagatatttagcatatgactatagataatttccccttcatattttcttgggcttctagtatttatgtatcaagaaaattatttccttatgtttgaaatggtgacatttctgaaatgtaccagcagaggatacagggatttttgtttgtttttcattttcttatttactgaagaaataaaggcattttagttta

SEQ ID NO: 173889 - DNA, 570 bp, Homo sapiens
ggagtttgagacaagcctgggcagcataaagagacccccatctctaaaaaaaaaaaaatagaaaaattagccagacatgatgatgccaacctgtagtcctggctacttgggaagctgaggtaggaggatcgcttgagcccaggaatttgaggctgcagtgaactatgattacaccactgtactccagccagggtgacagagcaagaccctatctctaaaactatttttaaaaataaaacaatatgttgttcatattatcctaatgtagtgttttactgaatagaattccttaaaggattcttttccccaaggatattaactcaaggtaaattataataggattgcagataaattaagcatctttatctttgattacagagatatttagcatatgactatagataatttccccttcatattttcttgggcttctagtatttatgtatcaagaaaattatttccttatgtttgaaatggtgacatttctgaaatgtaccagcagaggatacagggatttttgtttgtttttcattttcttatttactgaagaaataaaggcattttagttta

SEQ ID NO: 173890 - DNA, 619 bp, Homo sapiens
ctccgaacttctagaggtcagtccgaaggacaagtgtagcacacgccgaaggtccagactctgaagatgagtgggactcgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtgggttctcggcgtgtgtgcacacgccgagaatccaaactgctcctccaacaagagatggagtctatttcccctcctttccagctgtgctaccctcctgacttgccaggaacaatagaaagtcgcagaagtgctgctttgccagttctgggcctagctcttaagaggactggctgctttttccttcccgctaggtagccaggtgccatgctgaactaaaactggctctatgctgaat

SEQ ID NO: 173891 - DNA, 344 bp, Homo sapiens
actccttcagctgaaataacattctaatttctctgatattcacccccaattaaactaggtggtatcagaaaatgaaaagcacttaatatatttaagaaaataccatagtgaaaaaaaatcactataaattatctattttaagcaaaactatttgatgttgctcaaacaacatagcaaaactagatcatttcactttattatttgttaaaaatcatctcccttcgtcacacactgaatctatgaagtaattaataatgaatacaatgaatgcttatatgtattaggatcatggcaaatctataaaggctgaaaggcttgggttcagccaatgaagttaatattgt

SEQ ID NO: 173892 - DNA, 146 bp, Homo sapiens
ggaaggtctcaaacatatctcttacatttaataatggattgttgacttacacccccaacttcatggttcagtgaattggataattctcagttcatgctgggcagttccagttagtgtctcatggtcaggcattcagtttctacaag

SEQ ID NO: 173893 - DNA, 517 bp, Homo sapiens
atgatgctacctgtggatctgccatatatggcttttattatgttgagctatgtttcttctatgctcagtttttcgagggtttttatcaggaaaggttgaattttatcaaatgcttttcagcatcaatagaaatgatcatataacttttgtctttcattctgttgatctgatgtacacattgattaatttgagaatgttcaaccatcattgcatccctgggataaattccacttggtcatgatgaatgatctttttaatgcacagttaaattcagcttgctattattttaatgaatatttttacataaatgttcatcagagatattgttctataattttccttttttttttttgggatgtgtcttggtcgggtttggtaagcgggtaatagtagccttgtagaatgagtttggaagtattccctcctcctctatttttcagaatagattgagtaggattggtattagttcttctttaaatgtttggtaaaattcagtagcgaagccatcaggtcctgg

SEQ ID NO: 173894 - DNA, 454 bp, Homo sapiens
catttataactaggatagaggctgggtctggaagccaccggggcttctggtgggcagcaggtcaggtagctgggctgagcctcatcatacccaatcttcatttccttattcataaaacacaaaaccttattttacttccaaggccagaggactatttaatttattgttccagcagggtgcttgtgagagaaagaagagcagggctcttccactgactgcacagacagcaagtagacatgaggccttggcagctgggctgtctggtcccctcttgaagggtgctgccagtcctccgggcacagggccttgcagggcggacactccacactgcccagtgccctgctgccccccacatggtgactgagtgatgctttgctcagacagcgagctatggctgacaaactgaactggcagcctgtgcccatgggcacattgggaacccctctgcctctgg

SEQ ID NO: 173895 - DNA, 198 bp, Homo sapiens
aaagcctattattgagtgtttagccaggatgagttatatcattttcgtgaaatattacataaactcgttaagtgaagaaaataagaaaaacataaagaagaacaaaatgaaaggcaggatatagcactgcacatattagtatcacacacacatacacaaatggtaactatcaaaaaaaaagaaaagtctcaagggaaa

SEQ ID NO: 173896 - DNA, 223 bp, Homo sapiens
  misc_feature (195)..(195): n is a, c, g, or t
  misc_feature (201)..(201): n is a, c, g, or t
  misc_feature (204)..(204): n is a, c, g, or t
aaatgagccaccaactgtgtcaaatgctataagaggaaaactgagaagtgacctttggatttagcaacaaggaggtcattgatgaccttgacaagcagttttggtggcatggtagagaagagagccttgctggagtaagatcaaaagagaatgagaggaaatgtaaacaacactctccagtagccttgctgtttntggagntancactggtaccgactcgatt

SEQ ID NO: 173897 - DNA, 1068 bp, Homo sapiens
gttttggattttagccattctaatatgtgtgtggcagtatgccattgttattttcaatttcctaatgacatatgatgttgagcatattttcatatgcttatttgccatgcttatatgttctttagtaaggtatctggatcttttgcaattttataattgggttgttcatttcttattcttgcgttttaagagttctttatttcttgtcgcatattctggataccagtcttttatcagttatgtgttttgcaaatattttcttttattctgtggtttgcatttttattcttttaacagcatctttggcagtgcagaaatgttatttttaaaatagttcaacttagcagattttcctttcatggataatattttgggtgttgtagaaaggagcaaaacctgaggtaattcagattctgatctttgttattttctaaaagttttgtgggttttccttttatattgagctatgatccattttgagtaatttctgtgaaagttgttaggtctgggtttaggattttttttttcttttctcttgcatgtggatgtctagtttttccagtactgttttttgaaaaattattctctctcaattgaattgcctttgccatttcatcaaaaataagctgactatatttgtgtgggtcaatttccgacctttctcttttgtatcgtttatctgtttctctattatttttaacagtaccatgttattttgattactgtagctttatagtagttcttacagttgggtagtgtcattccaactgttctttttgaatattttctgggctattctgggtcttttgccttttcatataaactttagggtcagtttgtcaatatccacaaactaactttgtggaattttgattgggactgcattgaacatgtaaagttgggaggtactgacattttaacaaagttgaatgtttcttgaatgtgaattttctctctatttatttagatcttctttgatgtttttattcacagttttgaagtgaataaagtcctatatttatatttattttgttagatttgcacttaagtattttattgttattggta

SEQ ID NO: 173898 - DNA, 816 bp, Homo sapiens
tcgtttctcccaatgtcactaaatggctgaagctcagaatctttatcatgaaatacaccacgacagtaatggtattgacagcatgggaatagcctgcccacacatactacaagctagctcttgggcttttgggaatcaatctttcaaaactgaacatacaagtcactttaagcttattaaagtttctatctactgatggtctcttttgaaagataagcactctcatgcttgccacataatatcttcaaaaatcatattatttccaatacacacacacacaaaatcccccacttaactataatggccaataattgtgtactaaatttctaataaaataggggagaaaacagagcaaatgttaaaaaatatttctataatatttaacaaccaatacatacaggattttatttagtctacccatagttttcattaaaagtatccttagaggttgggcatagtgactcacatctatcatcctagcactttgagaggattagctggaaggttctcttgagtccaggagtttgagaccagccatgtcaacataacaacacctcatctctaccaaatttgtttctaaattagttgggtgtggtggctcacaccagtagtcccaccaactacttgagaggctgaggtgggaggatcacttaagcctgggaggtcaaggctgcagtgagccaagatcgtgccactgcactccagcctgggcaacagagaccatgtctccaaaaaaaaaagagtgggggggagagggcggagggggaagcattcttggccatgcatgcacagtggctcatgtctataatcccaaca

SEQ ID NO: 173899 - DNA, 296 bp, Homo sapiens
ggaccatactttgagaatcaccacttgttctgagagggtatgtgatggtgggaggaatgcagacaggtctcagttccctccctgctgctctctattactttttccatccttgctgatgtcatgttctaaacttcatgttactgtaatctattctagactgctgacctttgtcagtggctttctccctctttgacctgatgaaagttcctcctgcttctaatgagctgctctttctgaagggattcccctagctgggcctctggtatcccagttctttatatcatagccttctcagg

SEQ ID NO: 173900 - DNA, 420 bp, Homo sapiens
cctgatcgtctccaatgccataacctccctgccaattctttatcacattgctttaatgccttcataatgcttaccatgatctgaaatcatctctgtatttgtctacgaatttatcaccttctttttcttctagaatgtcagctccatgagggcagatactcatctgcctgttcatatgaaccttcctagggcctatgatggtgaggttctagggaaggtgctcactaaatagttttgaataactgaatacagggacacatgatgggatttacaagtgtccacattcactccacaagcctaatgtgcaaaaacacagctacaatagagatttggttaactatagcactggtgcaccaacttctctggaagtaatccctggcctaccttggcaaggactttttcataggaggttattggcat

SEQ ID NO: 173901 - DNA, 257 bp, Homo sapiens
actatagcatctagggacacatacttgagtaataaaaccaaaaacttaattcattttcagaaaacccaggacagtggttactttttaaaggacagggttacacaggtgctagccttataattcactaagttacacatttgttttgtgtggttttctgcatttgtttcactttacaattaaaaaaaaaagaatttaggaaaataaactgctgctattaatttaaatctacctctagcccaggcacagtggctcacacc

SEQ ID NO: 173902 - DNA, 991 bp, Homo sapiens
gaaacctgaccaggaagctgaggaccaaaccagcctctttttccgttcccggtttttttcctgaacccaacgcgtgccgtgccccgtttcccccaatatgtgttggggaggggtgtcctgaatggggtggtagattttttttcttaaaaaaatttttttgttttttttaatactcagaggagagggacataggaaaggtaaagtggatgtaatcgggtggttgttagggtttggggctaggtggggccaattgcataagcagtggagtgtgttcttcccctccctgcagtgttccttcccgtgggatgatcactctttagctgtatttggggctagaatgagatttgaaggaggccatggaacttctctttagaaagcctgccttggctgggcctggtggctcacctctaatcccagcactttgggaggccaaggtgggaggattgcttgagcccaggaatttgagactagctggggcagtgtagtgagactttgtctctaccagaaaaaccgggcgtggtggcgcatgcctgtagtcccagctacttgggaagctgaggcaggagggtttgcttgagcccgggacgtggaggtggcagtaagctgtaattgtgccactgtactccagcctgggtgatagagtgagaccctgtatcaaaacaaaacaaaaaacaaaacctgccttctgggattgggcttctggtttttttcccatgacacacacatcctttcctattttgtcctctgggtcttcatattaactatcttcccccaggatagtataaaaagtgttaggaaagttgggctttggagttgtggtaatttctgtctttgttactttcctccccttcagggggttttttaattttaaagatgaatgcagtgaggtataatggtgtgtgcctgtagtcccagctattcaggagactgaagcaggaggatcacttgagcccaggaatttgaggctatagtgtgctatgattgtgccagt

SEQ ID NO: 173903 - DNA, 291 bp, Homo sapiens
ctcgtgagctccaccgaggatctatttggaaggcagaatctgagatgaccccttagcttctgcctggataaatgccaggtgtaatctcctctccctggagtgtaggcaggacccgtggcttgcttctaatctatacctatggaaaagttgaagggattttgcagatgtaactaagcccctaatctgttcgctttgagttaatcaaaagggagattattcagggtgggcctgacatcttcaggtgagatcttcaatgagggtctggaggagagagactccttcctcctcgtt

SEQ ID NO: 173904 - DNA, 421 bp, Homo sapiens
tgccatcctactaaactcagaaggccgaggtgagcagcacatggagccaggtgacagagcccagcagagagcccgagcccattcctgtggcccagggaagcctgttaggagctccccatcacatatgggtttcttgagcctgtttcttcctctgtggaatggaggttgtgcaggtggtttcagatgctcctcctaaccaggtgctctgggcactgtggctgcaggtggaggtactcaggagcatgaggcacgctgtgcaaataggactgactgaggagccttaagaccatcctggggattatgaagcatcactcctttctcacacaagtcctgacgtggtttcccagcttctggaatgggttttgcccagggacccatgcacctcacctagagaggatgtgaggtctgggtacagcagttc

SEQ ID NO: 173905 - DNA, 150 bp, Homo sapiens
ggtgtgacctgaggatgatgaggaagggatggtgacaggaagaggggtggcctgacctgtggatgctgaggaagtgtccgtgacaggaagacgggtggtgtcacctgtggatgctgaggaagtgtcggtgacaggaagaggggtggcgtg

SEQ ID NO: 173906 - DNA, 384 bp, Homo sapiens
gattacaggcgtgaggcaccgcgcccggcccacatggggaaatctttggcttaagcgtccacatgctcctctccatgatcattccccctggtccctggaggtcttgtgtggccctgggatatacaggcgaatgacccttttgtcccagtctcttggtcctgggctgctgcagctacaattccgtgcctgtggaaagggggtgatcatttcctggggttgcacttcccattcagagtggggagagaagcagcactgaacaggacagaggggcagcaggtggcacatgtcctgcacggatcacatgcctcagtggtgtgattaattgccgggataatgagtcattcgcttccccaccttccctaggcgaccgcaaaagcagccagg

SEQ ID NO: 173907 - DNA, 272 bp, Homo sapiens
gtgtgtgtgtctcctattggttctgcttctctgaagaatccatgcacccatggaggacaaaataatgtacccatgcaggacaaaaatattgtacacataaattacctgaactcataaaaaataaacttttctttctatgtaccagcaacaaagctagcaaacaaaatttttaggccaggtgcggtggctcactcctgtaatcccagcactttgggaagctgaggcgggaggatcgctcgagcccaggagttcaagaccagtctgggcaacac

SEQ ID NO: 173908 - DNA, 243 bp, Homo sapiens
tggagtagtcaaatgtacacgggagttagcaaaacgggagataaagatggtgccaagatttcttgcttgtgtcataaagaatgtcattaatggacataggaactcatgcaggagcagcagacttaaggagaaaatcatgaataacatttgggacatgctggagttcaggtgcttgtaggagagctccacaaagcataagaaaataagcgacttgagattaggagggatgatggggttcacaga

SEQ ID NO: 173909 - DNA, 326 bp, Homo sapiens
gcttggttctgaagaatagcatgtgagtaaggtcatgacatcagggctctattcaaattatgccatagacctcttctatttgactagtattttcatgccaatagaagtagccccactttatgtctttccttccccattcttgagagtgccagtttattagtcctacaccttgttgcttctgctgttacatccagcccaggactaattttcatatatctggactccacgtctcacctatttttctcacggctctgtctgcagtggtcttcaatattggctcatgtattttgtattacgaagtatatacccattcttttttttttttt

SEQ ID NO: 173910 - DNA, 141 bp, Homo sapiens
aacgtcgattaactggtgattattaccataaaatgcatgttaaaataatgtaacacacatacaattatgtgctgtgattttaaaatctacttaattttcatgatattaagatgtgttagtattttttttttttacttggcg

SEQ ID NO: 173911 - DNA, 261 bp, Homo sapiens
aaaaactcaaatttaaattgtaaaagaactaacattaagaaaaaaagtctagcttgtcatacttagctaaaacaaagtctttcaatcatttattagtatatgaaacaaaccaccaaaagaatctaaaactagcataccatttaccactccagttgaatgtcactatattgttttcactaagactcactttaaccattttttttttccatcaagacatccagacccccagccctgatttgatgtcatcccaggatgtgtctc

SEQ ID NO: 173912 - DNA, 606 bp, Homo sapiens
agttgagaaagtacccattcattaggccagtgacgatcagagactgggtggccagcaagaaccacaaaaggtccttcagccagccctgctcttaggccccagatgcctggcagcaggacagtgacagggataggggtttattctcttgagccagaccccagaccctggctctgcctcttaccaggtgtttgagctgacacaaattatttaacctccttgtgcctcagttcctcatctgtaaaaccagaaaacaggaatacttaccttcatggggcggctatgagtactcactgagcaaattcatgacacccagcagccctgtgtaattgttagtgtctgttattcactctttttatcaccagtgattatttctagtttaggcattctaactcctctctccactaaaccagccatctctctatgatcacatctaatattattctgagttacttgtcccggaaaaagaataactttccaatttacaaactggcagagggaaagtgcattgctgtgctggaaaaacccgtggagtgataagcaggggctctggagtgggacagtccctgggctgcgcactggctctgccactcactcactgtgtgagcc

SEQ ID NO: 173913 - DNA, 528 bp, Homo sapiens
gccctctgttcctcctgcatgagcggggcttccacccaagaacagattcttttcattgaaggatttccactggactttcttagagtctagcggtcatagctgacagcctgtaattttaagttaacgaagtcgcaccgcacagcaaagttaagttttgtttagcaactagggcaaaagacaaaactgagtgggcataaagtatgtctggagacctcagttcttatctagaccgttttttatgctcatcattgtatctccaatgtctggaatagtgcctagtgtatggtaatcagtccgtaaatatttactgaatgaaggatggtaaccacggagggattgtgagtggagatacctctgatctttgacaaatctcctatccatgcttggtaccaacatgagctaactccatggctcaaaccaacaggacaatttgctaaggtctaggagcaccccctccagagaatccctgatctcccaaaatttggtcgagatctaaagttcattttgttgtacaactccctctattat

SEQ ID NO: 173914 - DNA, 539 bp, Homo sapiens
gttatagcgctagtataggcagtgctatgctaatagatgcatgtatgatcttgtatcctgaaatatagcagaaattgctatatcagctcaaggacatatacagattacatgatggggttttcttaatatacaatcatgtcatctgcaaacagggacaatttgacttcctcttttcctaattgaataccctttatttctttctcttgcctgattgccctggccagaacttccaacactatgttgaataggagtggtgagagagggcatccctgtcttgtgccagttttcaaagggaatgcttccagtttttgcccattcagtatgaaattggctgtgggtttgtcataaacaggtcttattattttgagatatgtcccatcaatacctagtttattaagagtttttagcatgaagggctgttgaattttgtcaaaggccttttctgcatctatagagataatcatgtggatttgtctttggttctgtttatatgatggaatatgtttattgatttgcatatcttgaaccagccttgcatc

SEQ ID NO: 173915 - DNA, 700 bp, Homo sapiens
tggcatttgagagtgtttgatatctggcaggatgctattcggaaaagagaatgtaaatattcctgcatgttgtcttagaagcatttaatgtaactgactgagataatttgccatttatttcatggcttcttaaagggattttgagcctccttatctatgtgcattgttagagtgaagctgacaacaggttattttgtttgctttgtaaaacttaacaggaggaggccatccttggctttccttgaggtgctggtatcttggaagggaagctagccaaacttttcctcccagaggctgtcttttgacacagaacattttagttcctaccagatttctctgagaggctttcatggagcccagttaccccttcccagttaccccttttagcaaatgatattcatgaatactgtgctcacaaagaaatttaggtcaataaatggaaagcatttgagatatctggactcttttcatgttctagaaccccagatgctagggaaattttgggagaaagcctagaagtggtagaatttaaatattagttaggtttcttatggccatctttcctaaggaaactctagaaatagctcatgggatataatttaattacatggtcttagataaatcctcatcagtcttttatagctggttatgatatttgatgagataaaacaaacgaactttttttcagatttattgaata

SEQ ID NO: 173916 - DNA, 338 bp, Homo sapiens
tttgtatgtatagtagccttttgccctcatcacaacttagtgtgaggtatgtgttcctgtcctaattctacagagaaggaaattggaattcagtgagttcatgttcttacagctagtgactggtcgatccagaattagagcacaggtccgtctgactccaaaacctatatgtgcttttcactataccacaataacaacgaatatttgttctgtacaattcacaactctttggtctaccttattattattattattattactaccactacttacatcttcactagtcagtaggtacagccaagattatcacgacccccatttcactggtagggaaactg

SEQ ID NO: 173917 - DNA, 402 bp, Homo sapiens
tatgtatacagaatgaattagaagaaatatactggctcaaatgctctgccgtgagttaggcttgagctacatgggtctgggcaaggatgttggcagttggaattagtagatggaacaaatttaagagttgcctcagaggaccaatcatgaagcttgatgatagactggctacggaggcgcaaggaaggaagtaatcaaggataaatgacgtgtgtctcaagagttgctacctttgtgtctgggataatacatggctgtcagtgggaatgggaatgctgggctagagattctggagagaagggagaatgtgtagtttggtttcgaatgtgtggagagttgacaagagattatccaaatatcaatcataggcagcgatgcaggagaacagttagcattggagga

SEQ ID NO: 173918 - DNA, 343 bp, Homo sapiens
atgttttttgtctcacaaggtggagaggtaagaaagaatcagtgaattaacagccatataacacaagataaattattgtaatacatgctaaattcttaaaatgatagatgtatgtacacatttttgtgggatcacagaggaagaagtgattaattcttcggggaagcataaagggatgaggttgggccttgaaagtggaataaaatttcccaaggcagggaaggacattcattcattccataaatatggcactgtgtcagtggtggaaaaaaaagcccatcaacattgttctaccttcatgaatcttagaactaggaagagagataagtaatggacaagtaca

SEQ ID NO: 173919 - DNA, 216 bp, Homo sapiens
gctgggactacagacgcatgccaccacacttggctaatttttgtattttttgtcgagatggggttttgccatgttgcccgagctggtctcaaatgactacttcatttttaagcctaaattttctcatctgtttagtgggaattatattgggacggggttgagaattcagtgcaagttcaggtgtccacagggcctggcagaatgtaagccttcgat

SEQ ID NO: 173920 - DNA, 306 bp, Homo sapiens
attaaatagaatagtcatggtgggcctccagaaggaggtgatttttggcagagatttgaatggagaggagccggattcataaattctgtgctggggtgtgaccacagcagtctggcttgccaaatctactcctaatctctacatttactgcctcccacatgttgtattttggctacacctcattagtccccaaaaagtagattacgaggtgggaggatcacttaaggccaggaatttgagactagcctgggcaatatagtgagactccatctctaatttatgaaagagagagagagagagaaagca

SEQ ID NO: 173921 - DNA, 629 bp, Homo sapiens
gtcactattgtcatggtttctcttaacagcattcttccagaatccgacacagtgctttcagtgtgatctgcctggaacactgcattttgattaatgcaaccaaaggtcgatttttgggtaaccatatcacctgctggctctgagttcagactcagtttaaatcctcataccttttctttacacattaagccacgttttgttcatatacttaaaaaaaaattcttgtttttaatttgagacttaaatgcaggacttttaatttattcctactggacttcaccttaaataaacaaaacaaaaggattcctaaactgttagagagattagataattagagctcattttgttattcaatgctctaacttgcataatttattaatctgtttgtttgcaatacaggtaaaaaataagccatcagttgtaactgcagtgttgttttattatttttttttaatcctcctactgcctaatatacactataccattccaccatataagggtacttctcttctacagtaagaacaggatcaacttcaatagcgtaatattttttctttagttgcaataactaggaagatttgataacttattcatgaagattacctgaaaataaatttggttgggtttat

SEQ ID NO: 173922 - DNA, 613 bp, Homo sapiens
gaaggctgctacgaggagtacagaggccgctcgcccgacgcccacagcgggggccgcaacagttccagcaacagttacggccagagccaccactatggaggagaaggccgctatgaggagtaccgaggccgctcacacgaggcccgcagcgggggccgctccactgatgcccacagcaggggccggtccgacgacgcctacagtgggggccatgacagttccagctggagcgactgctgcggaggaggaggccgttatgaggagtaccaaggccgctcgctggatgccaacagtggaggctgctcgcccgaggcctacagtgggggccacgacaattccagctggagcgaccgctacggagtaggaggccactatgaggagaaccgaggccactctctggatgccaacagcggaggccgttcacccgacacccacagtgggggccacagcagttccagcaacagttacggccagagccaccgctatggaggagaaggccgctatgagtaccgaggccgctcgcatgacgcccacagtgggggctgctctgccgacgcctacagtgggggccacgacagttccagccagagcaaccgctacggaggaggaggct

SEQ ID NO: 173923 - DNA, 562 bp, Homo sapiens
tgctatttctttggagtgtataatgtaaatttaaatactgaaggtatctgatgtcacgaatactcattcgataacctaaattatacccctttttcaatttggcttgtaaattaatgttagcaattattttggtatgttagacctcatcactaaaatcaaaatgtgtaatttaccctatttctgataataatgacttgctaatgtgtgaattttaactgaatttccaagtacaataagtcctcacttcatgtcgtcaataggttcttggagcctctgactttaagtgaggctacatacagcagttccttgaataatatcatttccttcaatatcgttttgttatgacattgatgaggaaagaatattggccatgttgtatgttgttttgcttaaagtcacaattttcaagaacttacctatgagtttaagtgaagatgtactgtacatacctctttcctatttgagatattttgttaaataatgtaaagtctatcaagtatgcgcattagcttccttccttctccttccactgcgctgtatcatcttattccatacatgatct

SEQ ID NO: 173924 - DNA, 436 bp, Homo sapiens
ccccaattgaattcttgatattctgcttctaaatctggccttttgataatcatccttgtctcataatacagtagtatcccttatccatagcctcactttcagtggtttcagataccttcagcaaactgtggtctgaaaatattaaatggaaaatgctaataataccacttcataagttttaaattgcacacagttctgaattgtgtgataaaatctcacaccatcccactctgtcctaactggaatgtgaatcattgctttgttcagcatattcttgctgtgcacaccacctgcctattagtcacttactgcccagcttgttgagtatcactgtatcactgtgttctgttcaattagcccttattttaattaataatggcctcaaagcacaagagtaatgatgctgacaacttggatacactaaagagaaactgta

SEQ ID NO: 173925 - DNA, 621 bp, Homo sapiens
gtcatccgcccgcctcggcctcccaaagtgctgggattacaggcgtgagccaccgcgcctggcaatttttgtatttttagtagagacgggaatttcatcatgttggccaggatggtctcaatctcctgacctagtgatccacctcctgggcctcccaaagtgcttggattaccagtgtgagccaccggtcccggcttaatcatttttagtatattcacaggattgtgcaaccatcactacaacccaagaacattttgatcatccaacaaagaaacacctcttgcccattggcagccatgccccattctcacgttcactctcagccccaagcaatgtatgtacttttcacctctgtagaattgactattctagatatttcacataaatagaatcttacagtatgtggtctttaatgactggcttctttcaattagcataatatttccaaggttcatccatgttgtagcatgtgttagtactcttttttttattgccaaataatatttcattgtgtatatataccacattttgtttattcattcaccagttgatggacatttgggttgtttctgtgttttagctatcatgcataatgctgctatgaatatttgtttatacgtt

SEQ ID NO: 173926 - DNA, 105 bp, Homo sapiens
gggggccctggccgccggccactgccgggcctagaagtccaaatgagaagttttttcctctgggcaccgttgattcgcgaagctgtcagtgactcacactggcgg

SEQ ID NO: 173927 - DNA, 481 bp, Homo sapiens
tatgctctgtcttgagtagggttcactttcaggttaaagcaaatattgttatttcagtaatagctcctaaattagtgatatatcttaaacttacagcaaattctactgctgctaagaatttgaattgtcctaagtcggctttttgtaaagagtattaaaagagtttatttcacagttggctagttttttaatgttttaagtgtttcctatagagcagtgccgtatctgcaggtggtaagggattgggattgaacagttttcagattggaagtggttactttcctgaagtgacaccccaggccttttgcttctaatatttttttccatcgatgtctgtgactgacttccctgcttccaagaagatagctccatgacctcaaaatcctcctccgaaatttttataaacttctaatctttgttcctttactgcacaagtggtgactgcgttcaccctccttgtgaaataaagcaaaagtgagct

SEQ ID NO: 173928 - DNA, 653 bp, Homo sapiens
ccctacctcctaaccccagacaactgtcctaatgaaaagatttttaagaaagatgtcaaagaaaatagagtttttaaagaaagatgtcaaaggaaattgttgaatgaggcacaggggcagcatgagaccagagtggaggaaagtgataaaggcactttttagaagttaagcccagaaaactggggcaagaatcaaagcgacgctacaggcagggatgaggtaaccagggtcctgaagataatcataaggagctggagtctgaggcaggaaaaaaggcaagtctggttaagaggtttaaggcagaggatgacctacttagaaaaagatcttttcaacagccagacttcggactagaggggaagtaggtcaagaggcctgagagtaggttacattcgtctgagaggaagttgttttgactaaacaagaagttgtaattataccaaattatgagatcgttaaattaagtagtcatgtgcaataacatttcctccttaaatatttttaaacatttttttagcagagttgttcatcatacatcaaattttaatttgcattatgttgtgtagtacaacttcatttagactacttcagtggaagaacaatcgaaatttacgaacattctgaaagagttggaattttgcttcttgtccgta

SEQ ID NO: 173929 - DNA, 711 bp, Homo sapiens
gctcaaaaaggaaagggaaacagatttttttggtgtgcattttactcatccctcctcatgtccctgtatgggccaccaaaatgatgcaggattttttgctccttagctccactaaatctgggttcttgtctcacaactaggaaaaattaggcacacagacacctgtgaaaggtgaggagagcagaatttattaaaagaaagctctcatctcagcaaaaaagagagggtcctgccaacaggctcccacctcacagattgaataccaggccaacacacatgagctgaagaggccaggctcctctcccagcataaggggtgaattcctggtggctccacccccattcttcagtgcgcatgcgggccgttagtctgagccactccacattgatttcccttactgcatttgtgttaagggacagaatttttcaccatgggcatgtttagggaagtaccctgtgcaccatgacctgtgcggcatatggctgtctcctatctctatcagtagtatcagtaaagagatagaaaacctacaaagaaaccgaaaaataattctggagctgaaaagtataataacaaataaaaaatgcactggagggattcaaagcaaatttgaacagagaaaagaatctgtgaacttggagatagaacaatggaaattaccaaatctgaggaacaaaaccatctggggatgcagtccagtaggtctcagcc

SEQ ID NO: 173930 - DNA, 481 bp, Homo sapiens
gactgtggtgaggattcaatgataaaaggcaggataagtgctcaagaggatgccttgaacatagtaagccctcaataaaggggagctgcggttactactaagacagtgttggagaaagtacaagagccacagtttttccagggtaagaggtagattattaaaggctgatactgtatatgttctcttagctcctctcttgaacataaacatctgtggtttgtcaaagacattttcaggatccggttttctttttagaaagaggaaggaaaaaaaacccaaggcctgaatctataggaagtccaaatgcacccaggattcttaagtcacaagataaaaagtggagatgcttgaagaggcatctgatagtggaattcatggaagaggaaaaggtcagttccatctctagtgactccaacagagggatgaaacatccaagaatgaagaaaattatttccaggaatggcaaatgaggatggaacca

SEQ ID NO: 173931 - DNA, 287 bp, Homo sapiens
cttggcctcatacaactttccttgtcattctcatttagagctggttgaggaggagctgagatttatcagggagcattaaggagatgttaagagaattattattgtaagtggaagtaataggtttactcccatgaaagcagacacctcactctgtttttcagaagtgtccttatcatgagtgtcttactttggacgtaattgactttcaagtgaatgctgcccctagggctcagaagttccattctctcctgtttgtctcatttggagatgaagaccataagtccaga

SEQ ID NO: 173932 - DNA, 486 bp, Homo sapiens
ttatttttcagaggtgtggaggtgcagtgcagttgtcttacagagatatattacatagtggtgaagttggccaccccatttaaatgagataattctaatgtgcagccagggttgagaaccatagccttagaatttcttgtatactgtaaatcatgttctaagcttccacttgtccctgagagctctgaaccaggaagtcttaatatttttttttcacttccctattttctcccataattcagcatctcttcttccttgtctcaatcatactagttcgatgcctgttttacattcacctcactttgacctctaagtattctcaaaacagcattaagacctgaaattccttccctttcaaaccaaacaaatagtatatcataccatgtcaattatccagaagtcccaaatgcccacaggtatcctcctgggttaagcacgtacataacctcccccaccccaaatcctattgcaactccaacagcctct

SEQ ID NO: 173933 - DNA, 420 bp, Homo sapiens
gggctgtggtttcagaggctgacgcagctggctggccttctgctccttgtctcccggaggctccctgccctcagcaatagaaggtaagacaaggatcacatcccaaggtgggagggggctcgtgccagccctgaaggtggttggaaggtctttttgtagcagccaggaagggctggctctgcttctagatccacaaagctgcttggatgggggccgtctcaggcggagggccacgagggctgaggagtgcaggtctactctgcctcgggctgcccaggcgacatgcccaggggtctgtgtttctcctggagcctgtcaggtttgggagcacccagtgtggtggcccaaggtccgaggtccaatctagggaggcagtggtgttggtgaacctggccatgctaactttgcttaactctacca

SEQ ID NO: 173934 - DNA, 354 bp, Homo sapiens
taccccctaccaaacataaaatctctaataaacatggtattcactgggaagtagagggaagaggtcagaggagccctggaaggttaaggagtcaatcaagagcaaaattactcaagctaccaatccaggactaaatgccctgaaggaaataaagcctacccttgacattcagacagagaaacctgagtaagagaacttaagttgaagatctcaatgcttctcctccagtgaggaagccctgccattaggccagctggtttctgagaggccaagatgccacatccatcatcacttttaaaaaggcattgggagtggaggagagggaaggcattagggctttctatctggactccc

SEQ ID NO: 173935 - DNA, 596 bp, Homo sapiens
ccttcctcctgcctctgaaaagacatctccccagcccatctccttttgcctgcctggcactatagtaggcacttaatacatatgggtagacagaggctgtgtttcattgcttcttcccataggcagaaggcctgaataatggaagaaccaataagaggaagttacaaaggtttagaaactcttaccaaacccttaagtcattgtccctgactgcctgtttcctgagaagttccctggcacccccagggctcatctttgcctctgtgatcctgaaggagatgcatttattcttccttcctcttccattctaccttcagcctttccttggtccttctctccaggatacctaggccctgccccacagcctacatgagagtctgccaaaagggaaatgggcaggtcgtgctggctgaaatcctggctccaagacacacgagccgcgtgacctagggcaagctgccctggcccctgcaagagatcatacagctctcttgggggttgctgtgaggtcttggaagaatgtgcataaaatggctggcaaacagtaggtgcacaatgagtggttgttattgttatcatttaataaagagtgcaga

SEQ ID NO: 173936 - DNA, 552 bp, Homo sapiens
cctctcaagtagctggatttacaggctcccgccaccatacccggctaatttttgtagttttagtggagacagggtttcaccatattggccaggttggtctcaaactcctgacgccaggtgatctgcctgccttggcctcccaaagtgctaggattacaggcgcgagccactgcgcccagctggaacatgattcttaaaaactacagattcaattcagctttaggaattaaaaaaaaaaagatttgatataaataaaatcaaatttttaaaataaaacatgaaattgttttaattaatactttattaatctaagtgctactctgacatatacttcagttctttggtttgatttggtatttatatttttgtatttgatttgatttgattttagtatttatatttttatatttggcctttttagacctttttggtagttcagaagcttatcaaccattattctcataaaaccttgacagtgttttataattttagctttcatttattattttatttttttggagacagagtcttgctctgtcgcccaggctggag

SEQ ID NO: 173937 - DNA, 268 bp, Homo sapiens
cgcgctcccggggcgccgccgcctgcgcccgcgggccgaggggcttggctcctgcgccgccgtcctcctcgggcccctggccgcccaggaggtgactcgcctccgggggcgcggggaaggacctcgaggtgttgatcttgccagtgaacctctggtacagcgaagccatcgggcaccgcgctcctgctggctgtctttggggctttttaatattttgctttctctccggttcccactccccaccccgctccagattaaaaaaaaaaaa

SEQ ID NO: 173938 - DNA, 234 bp, Homo sapiens
tgacccatctagttactgggtgggtttcagtcttttgttgacattgttgttaatgaaagcagcccagacgagctgtgagcagctgggctggataattgtgaaggattcatgcttgttgctgttacccccagtgtttgcagtgggttgtttgctttgacttttgttgaactgttgacaaaagcattagatacaaatgggaacaaataaagtggtgagatgccaggagggcttggc

SEQ ID NO: 173939 - DNA, 123 bp, Homo sapiens
ttttcatgtttattataaatatttctcctagttgtttatcgttttacttcatttatcatgcttttgccacgtatagaaaaattcttaagttttttatcactaaattcatctatcttttttttt

SEQ ID NO: 173940 - DNA, 560 bp, Homo sapiens
aagaatctgagactatgttgggatgcttgtacatcctggaagatgccagcacaaaatgctgggtaaatgctcattgtgaatgtcacctaggaagaaagcagtggaaaggaggggatggacctgaatttaactgagttggaatttcaaataattgagaaattactggacttgactgtgtttacccggattatctacttataagaaaatgaagttacatttttacataacagaatttataagtttttaaattatctactaaacattacttaatgtcatacggcctggttcatcatctgttaaataggaagaataataccaacttcacaaaattgtataaggcttcaaggagaagattgagaaagaaaaagaaaacttcatacacttaaaagaaaaatgtaacagacaatgttaggtaagcttgggtttttaaaccaatgagctctctgttgttttggcagaattactctggctccagtgtgtgagatgaatttgagaagggacagctgttagaaggagaccagttaggaggctttgcaatcattcaggcaacagggaatgag

SEQ ID NO: 173941 - DNA, 407 bp, Homo sapiens
tcttttgcatggtcatttagtctatttatctattgggattctatctaaaacttctttgtaaaaagattccttctgctacagcaccgaaaccccttttcccctaagtacgtgaagcctgaaagtctcataaaaggagtcaatacacatgtaagtaggataaaaacatcaacaggtcacgaactggatgtcatacatgtaaccgtgttaagttgtcgggcagcaacaatattttcataaacaaagcccatagtaccaccaaattcgaaaccatcctgattcttcatatcttttacaattaagagttctgctaaaactctatgggcaagaaaagtagcagaatttttagagtgttattttaataaccagtgaatatgacagcatgattttgtgttactaggtctagattg

SEQ ID NO: 173942 - DNA, 591 bp, Homo sapiens
atcttctggctcagtttaattgaagaatactctgagactgcaagttgagctgtttaaatccagggactgtttgcactgtttacctgtgtgaatttgaattttgttaatatagggcaacaaaaacaaagtacacgaacgaatttggatagtaaggttgaaataagactataactataatctaaatttcagatggttatatttataaaaacagctatatattttcattgattgtcaaagtaactatacattttttatttttattttttaaatttattattatttttgaaaccgagtcttatactctgttgcccaggctggagtgcagtggcgcaatctcggcttactgcaacctccgcctcctgggttcacgtggttctcctgcctcagcctcccgggtggctgggattacaggcgcgtgccaccatgcccggttaattttttctatttttagtgggaacaggtttcaccatgttggccaggatggtctcaatctcctgacctggtgatacacccgcctcggcctccaaaagtgctgggattacaggcgtgagccaccatgcccggccagtcactatacatttaaatataaac

SEQ ID NO: 173943 - DNA, 366 bp, Homo sapiens
ctggcccgagtgctcctcctccctgtaccccatcacagaccgtatcacacttgtccaatcaatagttctgtgaagccttccttctcaacctccatgtccccccaccccacacacggtaaatccctcctccttttgttccatcctccctgccaccccatgccacttaggacactactatccttgtgggcagggacttgtattttttatccaggtcccctggcacctacacagtgtgagatactgatttaggtgcttagcattcagcagtgaacctagcaaacaaaaatccctgtcctcatgaagcacacattgtgattgtgaggggtgggggaacagatcgaaaataagtaaaatgtagagcatatt

SEQ ID NO: 173944 - DNA, 389 bp, Homo sapiens
tggggcaaggaaaggtacaagccgagcatggggcatcttattgtgtaagaaagcaaagaagttctggaggactggtggggacctctgggacagaagagccagcttagaggggtgctcactgtccaaatctaggaatatttgaacgtcaaaatgttgtgtacatgccttagcgaccaacccacatttaaaacaaattcctgaatgagggctgtaactgtagtcccaagtcattcttttttgtagctcataatagcccataatattactataccatatgtttgcatttacctatttttattttattttatttttttgagacagagttttgcttttgtcacccaggctggagtgcaatggtacaatctcagctcatggcaacctctgcctcc

SEQ ID NO: 173945 - DNA, 237 bp, Homo sapiens
ctcctcctctgaaggcatcattagttctgtggttagcaagagtcaggctcccctttcaccctccccaatcttccctgcagtggtgagcccatctcattcattcattcattcattcatttcctacttgcaagaggctgcacgcaggcccacagacacaaggcagtccaggccctgcagctcaggagggacatggggagacagagagagctacctgctagggttgatcagcatcaccag

SEQ ID NO: 173946 - DNA, 256 bp, Homo sapiens
actagctcttatctggcaatttaaaaaatagtccccattttgttatgcacatcaacctaatgcataaaactactgagcttaaaggtataaagatacacagatttatttttcaaaaatgactgtgaaatgaaatgaatacttaattgaacagtttccagttacagaatatgctgatgtggccctccattattatcataagcagcaggatatttccactgctgtgtctctcacttatgtcttgatttgacactctggt

SEQ ID NO: 173947 - DNA, 319 bp, Homo sapiens
gggattacaggcgcacaccatcacacctggctaatttttgtatttttagtggagatggggtttcgccatgttggccaggctggtctcgaactcctgacctcatgtgatccacccgccttggcctcccaaggtgctgggtctataggcatgagccactgtgcctggccagttagtctgtatttttgaagatctgtttctgctacctctagtgtgtttcattgatccgtttgtctatgcctgctctaatacctcactgtcttttttttttttttttttttggtagagatgaggtctttctatgttgcccagtctagtcttg

SEQ ID NO: 173948 - DNA, 522 bp, Homo sapiens
cggccgctcctggttttccgcggggccgggagggggcggggcagtgggcggggctccggatttgagtccgatttggggagtggcgcgagttaggaactggctggaagatggggtgtgtgtgcgtatatgggagcgaggaaagcgctgtaggaagcatgcaggccgctttattttacagctgtgggagtggtggacaagggcggcggctctgcgagaagcacgtgggcgcggcgggccgcctcagggatggagtaggctgtggtcttgccaactcccgttatcaaaggcccaaggacgccattcactcagccccgggcgggcgtgggtctgggggccggaaacccgaagtcctgtgggtgccgtggaatgcacgagcagccggcggagcaaacctgccccatagatttttctaaaccgttcgccacagaaacgctactctgtcttctctgaccgactctgtgcactgcagccttgcacaaagaaaacaggaggtactccaagtctgagatactgttccgacta

SEQ ID NO: 173949 - DNA, 684 bp, Homo sapiens
cggccgctcctggttttccgcggggccgggagggggcggggcagtgggcggggctccggatttgagtccgatttggggagtggcgcgagttaggaactggctggaagatggggtgtgtgtgcgtatatgggagcgaggaaagcgctgtaggaagcatgcaggccgctttattttacagctgtgggagtggtggacaagggcggcggctctgcgagaagcacgtgggcgcggcgggccgcctcagggatggagtaggctgtggtcttgccaactcccgttatcaaaggcccaaggacgccattcactcagccccgggcgggcgtgggtctgggggccggaaacccgaagtcctgtgggtgccgtggaatgcacgagcagccggcggagcaaacctgccccatagatttttctaaaccgttcgccacagaaacgctactctgtcttctctgaccgactctgtgcactgcagccttgcacaaagaaaacaggagaaaaccaaatacagcaagaatgagagaaattgcactgttgcattaaaaagaattttcctgccgggcgcagtgactcacgcctgtaatctcagcacttggggaggccgaggcgggtggatcacgaggtcaagagatcaagaccatcctcgccaacatggtgaaaccccgtctctactaaaaatacaaaaaatta

SEQ ID NO: 173950 - DNA, 672 bp, Homo sapiens
tcaattgtttaatatttaaatagagtacagacagggagagtatacgatttgtcatgcaaaacaggacatttttcgagtacaatgggtacagttaatgattatgttgggataatgggcacaaaccagaatgtaatttctaaagtgaaatatcatcaaaaaaacttatgccatccttctcccactatgaaaaatgtctctttccagccaagtgcagtggttcacgcttgtaaccccagcactttgggaggccgaggtgggcagatcacaaggtcaagagattgagaacatcctggccaacatggtgaaaccccgtctctactaaaagtacaaaaaaattagctggtgtggtggtgtgcacctgtagtcccagctacttgggaggctgaggcaggagaatcgtgaacccgggaggtggaggttgcagtgagccaagatcacgccactgcactccagcttggcaacagagggagactctgtctaaaaaaaaaaaaaaaaaaagaaaagaaaaaagaaaaaggtctctttccaaaacactattgaaatctttcttggccgggcgtggtggctcacgcctgtaataccagcactttgggaggctgaggcaggcggatcacctgaggtcacgagttcgagatcagccaactcaacatggtgaaactctgtctctactaa

SEQ ID NO: 173951 - DNA, 631 bp, Homo sapiens
gtaaggaaaaaaaattttattaaaaatattataatgtcctaatttagattctgtgtaaggaaaaataatgctgcttttaaaatgtttagatatattaaactggggtagccaaagaaattgtcccatccccccaagcactagatgagaacttcaaggagctgtttagtcattattcttttattggtgccaatttagactttgggaagagtgagttagtcctagagcaaaataagagagaaaaagagatttagctctgtagaatgctaagttgcttgtgactatgtgtagatgttgtgcctttttaggcatacaatttttacttttactgaaatgaataataactgtattgtctcttaatgtatgaaattggctatgtttgtaaactagaataatataacttgtggtaccttgacttgtttaaatagtctgtgtataaacaattagaatgtattaaataatcaggcctgtgggtacaggagctttttattgttttatgaatgattcttattatggttcatttgtcttaaaggaactttatagatctgtagaaccaggtttccactttgtgttttcattaataccttgttaatttgaagtgcctgtaaaactttgacactcataattctgttct

SEQ ID NO: 173952 - DNA, 774 bp, Homo sapiens
  misc_feature (90)..(90): n is a, c, g, or t
  misc_feature (317)..(317): n is a, c, g, or t
ggagagacatgttcccggcggctcagtgcggagcggccgtggcgctgtttttctgagtccggggtggcctggcagccggccgaggacgangggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggctgcggcgggggccgggctgcccgagagcgtcatttgggcggtcaacgcgggtggagaggcgcatgtggacgtgcacngggatccacttccgcaaggaccctttggaaggccgggtggtgccgagcctcagactatggcatgaaactgccaatcctgcgttccaaccctgaggaccagatcctgtatcaaactgagcggtacaatgaggagacctttggctacgaagtgcccatcaaagaggagggggactacgtgctggtcttgaaatttgcagaggtctactttgcacagtcccagcaaaaggtatttgatgtacgattgaatggccacgtcgtggtgaaggacttggatatctttgatcgtgttgggcatagcacagctcacgatgaaattatacctatgagcatcagaaaggggaagctgagtgtccagggggaggtgtccaccttcacagggaaacatctacaattgagtttgtcaaggggtactatgacaatcccaaggtctgtgcactctacatcatggctgggacag

SEQ ID NO: 173953 - DNA, 132 bp, Homo sapiens
tcttgcattaattcacatttatactttttgccctccatgatatttaggaaccatggatcatggcacacagatgcttggttctgagctgaggggccatttgtactcacacatgcaccctccatacctaagcca

SEQ ID NO: 173954 - DNA, 508 bp, Homo sapiens
ggcaactccggagaaatcccgggctgggcaaacagcccttaatataataatagcttgtctctttaaaaagcaaaagggggggaaagttttgttggcatctggtttctgatctcattatgttgtggtcgaccaatccagccctcgggcctggtcctcgggtttaaatctgattggccgagagcacattttgggttggtgcttagagctcgacggggcggtttcaaggatcccttttttggggggctgaggagagggcggggccgccagcgggggcccccttgaaaccgactaattgggatcggagaggccgaggtgagggctggaggaggcacaaagaagtcgctgggtgcagaagggaggggagagggggagctgagaggcgagaggaggaggaagaggagagagggcagcagcgcgcggtgtctccggctgctcagtccgaccgcggcaagcaagcgggcaggcgcaccgccccctcccccgcccggcctccccaactctgcggccg

SEQ ID NO: 173955 - DNA, 983 bp, Homo sapiens
ggaactaaggactcctgccaacagccagacacaaactgtgacctcctgccaacaggcatgcgaatgagccattttagaagctgaccctctaaccatgttcaagctttcaaatgactgcaaccactgctgacatgctaaatgcaaccacatgagaaaccctgaggcagaaaaacccaggctagagtacaaatgtgaataacatcacatgccaatcattcaggagttattcaatatgcactgatgaccccaagagcagtgaaaataaccgtgacagaagcttcctgatgactgggtacaaggacaatttttctcttagtatccagactccagtcctcaagtctgcaaaaccatgagaacaataacactttaccatcagaacaataacacttctttaccatcagagacattctccattgtacacagagtacagatcaattccagtattcttaaatgggtgaaatcggattaaaatggccagcatgaagaggcatcagaatggggaagatgcagtcttgctgtcacccaggctggagtgcagcggcacaatctccagtcactacaacttccgcctcccgggttcaagcgattctcctgcctcagcttcctgaatagttgggattacaggtgcctgtgaccacacccagctaatttcgtattttgagtagagacgggatttcaccatgttggtcaagctggtctcaatctcctggcctcatgatccgcccccctcggcctaccaaagtgctgggattataggcatgagcctctgcaccggtagctctttcttatgacagaagtttctcaacagagtactttcttctgaaagcagtatcatttttccatatttaatctccacaagaaccactttcaaaaaataacagtaacctggcactttaaagaactaaaaataaaaagagtaaacaaacaagatttattattttagaaaatctagctagttcttacatgagtagcttttgagatgg

SEQ ID NO: 173956 - DNA, 834 bp, Homo sapiens
ggaactaaggactcctgccaacagccagacacaaactgtgacctcctgccaacaggcatgcgaatgagccattttagaagctgaccctctaaccatgttcaagctttcaaatgactgcaaccactgctgacatgctaaatgcaaccacatgagaaaccctgaggcagaaaaacccaggctagagtacaaatgtgaataacatcacatgccaatcattcaggagttattcaatatgcactgatgaccccaagagcagtgaaaataaccgtgacagaagcttcctgatgactggtattcttaaatgggtgaaatcggattaaaatggccagcatgaagaggcatcagaatggggaagatgcagtcttgctgtcacccaggctggagtgcagcggcacaatctccagtcactacaacttccgcctcccgggttcaagcgattctcctgcctcagcttcctgaatagttgggattacaggtgcctgtgaccacacccagctaatttcgtattttgagtagagacgggatttcaccatgttggtcaagctggtctcaatctcctggcctcatgatccgcccccctcggcctaccaaagtgctgggattataggcatgagcctctgcaccggtagctctttcttatgacagaagtttctcaacagagtactttcttctgaaagcagtatcatttttccatatttaatctccacaagaaccactttcaaaaaataacagtaacctggcactttaaagaactaaaaataaaaagagtaaacaaacaagatttattattttagaaaatctagctagttcttacatgagtagcttttgagatgg

SEQ ID NO: 173957 - DNA, 1070 bp, Homo sapiens
tacactattttgaagaacgtgttttaatacatagagaaaagaacacctattcactgaatctgttttcactttttggtgtgaaataaccactgcaaagtacagaagctgtggtcagctgagagaccctagcacccagaataaggcatgcgaatgagccattttagaagctgaccctctaaccatgttcaagctttcaaatgactgcaaccactgctgacatgctaaatgcaaccacatgagaaaccctgaggcagaaaaacccaggctagagtacaaatgtgaataacatcacatgccaatcattcaggagttattcaatatgcactgatgaccccaagagcagtgaaaataaccgtgacagaagcttcctgatgactgggtacaaggacaatttttctcttagtatccagactccagtcctcaagtctgcaaaaccatgagaacaataacactttaccatcagaacaataacacttctttaccatcagagacattctccattgtacacagagtacagatcaattccagtattcttaaatgggtgaaatcggattaaaatggccagcatgaagaggcatcagaatggggaagatgcagtcttgctgtcacccaggctggagtgcagcggcacaatctccagtcactacaacttccgcctcccgggttcaagcgattctcctgcctcagcttcctgaatagttgggattacaggtgcctgtgaccacacccagctaatttcgtattttgagtagagacgggatttcaccatgttggtcaagctggtctcaatctcctggcctcatgatccgcccccctcggcctaccaaagtgctgggattataggcatgagcctctgcaccggtagctctttcttatgacagaagtttctcaacagagtactttcttctgaaagcagtatcatttttccatatttaatctccacaagaaccactttcaaaaaataacagtaacctggcactttaaagaactaaaaataaaaagagtaaacaaacaagatttattattttagaaaatctagctagttcttacatgagtagcttttgagatgg

SEQ ID NO: 173958 - DNA, 1059 bp, Homo sapiens
ggaactaaggactcctgccaacagccagacacaaactgtgacctcctgccaacaggcatgcgaatgagccattttagaagctgaccctctaaccatgttcaagctttcaaatgactgcaaccactgctgacatgctaaatgcaaccacatgagaaaccctgaggcagaaaaacccaggctagagtacaaatgtgaataacatcacatgccaatcattcaggagttattcaatatgcactgatgaccccaagagcagtgaaaataaccgtgacagaagcttcctgatgactgggtacaaggacaatttttctcttagtatccagactccagtcctcaagtctgcaaaaccatgagaacaataacactttaccatcagaacaataacacttctttaccatcagagacattctccattgtacacagagtacagatcaattccagtgatacccagctcagatactgtaatgaagtccatgaagaaatataaatagaaatccactttatgaagaacttggcttattcttaaatgggtgaaatcggattaaaatggccagcatgaagaggcatcagaatggggaagatgcagtcttgctgtcacccaggctggagtgcagcggcacaatctccagtcactacaacttccgcctcccgggttcaagcgattctcctgcctcagcttcctgaatagttgggattacaggtgcctgtgaccacacccagctaatttcgtattttgagtagagacgggatttcaccatgttggtcaagctggtctcaatctcctggcctcatgatccgcccccctcggcctaccaaagtgctgggattataggcatgagcctctgcaccggtagctctttcttatgacagaagtttctcaacagagtactttcttctgaaagcagtatcatttttccatatttaatctccacaagaaccactttcaaaaaataacagtaacctggcactttaaagaactaaaaataaaaagagtaaacaaacaagatttattattttagaaaatctagctagttcttacatgagtagcttttgagatgg

SEQ ID NO: 173959 - DNA, 284 bp, Homo sapiens
cttgtgccaccacacccagctaatttttgtattattaatagagatggggtttcaccatgttggccagtctggtcttggactgaccccaaatgatctccccgcctcggccttccaaagcgctgggattacaggcgtgaaccaccgcgcctggccatgtaagtattaatagttcggcctttttgtcagtaaattagaagatgaggaaccactggaggtttttaaagggaggagcaaagttgctcaattctttttttttttttagacagtctggttttgttatgcag

SEQ ID NO: 173960 - DNA, 282 bp, Homo sapiens
tagaagcaatcacacaacctacttttctttagaactttcagatttaaataacttattaaagaacctttactaaatattcctacaactctagatggtattaaaaacaaaacaaaactagacatcatttctgtccttggaattttatagctttatagataagttagtaaaaatatgggcatggtcttagaaagtaataaccaggtagttttaacctcttgttatttattctgagttttttcaaatagaagggatagcaaagaaaagagggtttgttaggtggat

SEQ ID NO: 173961 - DNA, 844 bp, Homo sapiens
gcaacgccgggtgaatcagaacccatccttgttagtcagacatactctgtgggaaaaggcagcagttggaaacagtcttgaattctaactactaaaagccatactaattcccgcggggccctgacttctggtccaaggtttctcactggctgtatcctgtccgacagtgccagagcttgtgctgcaagcagagcccgtgcagaaggcgagcgaggagaaaggcagagctgctcagttccagctccttccacacaccacaaaacgccatccctcgcctccagcccgaggcaaggcactcctttttaggtggtaaaataagccttccaacacaccagaagaaatagcttggagtttgaaaatacacaagcatattttaataatcacatttctatttttcaagttctcttaatacaaacaaaacaaaaattcttttgctcatgttcagacatgactaagttaatgacaatgggtatacaatgtgacacatgcacactcctcccttaacccttggtgagcatcctcaaaagcgattcactgctacccatttcttatctatccttccaaatagattttatgtctgtgtcagcaagcatctcttcctcctcccatttaagacacaattgtgggcatattgcacccattgttctacgtcttgcttttttcacttaatatcttggagacagctccatatttgcacaacgggattccacgtcattcttttaaacgctatggtatatgctacgggttggcaaactacagctcactggccaatctggccctctgccaatttttgtaaatataattatactgggacacagccacattcatttgtttacatattgtc

SEQ ID NO: 173962 - DNA, 391 bp, Homo sapiens
ccgcacatctcgttttacggtgcgacagcaagtttaccatctccaggacttggctctgctctcactccttaaacccttaaaagaaaaagctaagtttaagctatttgcatttaagtcataaagacaccaaaaatatttaaagtgcagatctagaagaagaagaagaacgcctagatcaaactgacccagaagatctcaggctggctctagtcctcctccctcaatcttaaagctacagcaatgtagcaagtagtattagctgttgtaagtttttctgctctctctggtcatactgattctgttctttcactatgccagtcccccaagaaataagtttctctgtccatgctaagtttaatatctatgctcaaatcttattaaattgccttca

SEQ ID NO: 173963 - DNA, 395 bp, Homo sapiens
gggccctcgaccctgcgaaagggaatatttaaagagtccaagaagttccagcaaaggagacagagaagggactagactccaacacacgacgtagagccacatccagagagggctcaatgagtgctgagcttctgctaccattattggatttttctacgtatttttttaaaaaagtaaaatctggctaagtgtagtggctcacatctgtaatcccagcactttgagaggttgaagtgggaagatcacttgagcccaggagttcaagacaagcctggacaacatagagagaccccatctctacaaaaaatttaaaaaattagctaggtgtggtgatgcatgcctgtagtctcagcttctcaggagactgaggtgggagggttacttgagcctgggag

SEQ ID NO: 173964 - DNA, 192 bp, Homo sapiens
tttccctaatgccagtgatattaatatcttttcatgtgtgttttaagttattggtatgtcttctctggagaaattgctattcaagttctttgctcattcttaaattgggtttgttgttgttgagttatagttctttatatatccaggataataactccttatcagataaatgatttgcgagtattttccacg

SEQ ID NO: 173965 - DNA, 255 bp, Homo sapiens
ccgggccgatattcatttagatgccctttgtaattaaaaaacaacgcccaaacaaaacaaagcaagggcagtaaacacaatgcctaccagggtcccatctccaggtgagcaaattggtgtacaaatacatttgtaaaacgtattcatgagacatcaatagcttattaatgaagagaataggggaggagttcctttattcagagtgggtctgcagtttaaattatagtacggaatttgaaatggaaactgctggta

SEQ ID NO: 173966 - DNA, 545 bp, Homo sapiens
tcacggatccccctcaaaggatgtcccacctatgacaaggtcagacacagacccccccaaatgctgtccttgtttcatgaaagtttagctgaactgcttgtccccacagattcatcaggatataatgctaattaactcagctttgatatgggctttaccatgtccttcaggacctgcttattagttagagaccccttggactgcataacttcttcaaagacattttattttatgcttaatcatatagaaatataatgatttgatagattaaccaatgtggttttcctcccttgttctccagtttcccactatttctctcccatttagtctaaaccttggcatctcctctttcaaaggggaagttttaacaaaaggacaaagagaaagaaaagagtagacactcacattttgaattttaataaacttggaagaatgatgacacaagagtgagtttgtcccatcccagagcagatgaggagcttctgaatgagagtgggggaagggattgtgctgttgacactcgatggcaattacactgatgcaga

SEQ ID NO: 173967 - DNA, 545 bp, Homo sapiens
tcgacttcagaggatgtgatagtctcccaggcaagcctccagtcatctgctagggatgccagtacttctcagaggggtagaaattagctctgtgccttgcttctaagtggacccacttactctctccctaataggatgtccccatttctagcatgacaatgttccccgtccctggtttcctgtactgggcaggtcatttcagtggggatcccatggaggcacatggatactcgtggtcatgctgctaacctatcaagccattttccttaatctgtactctggaccacacactgtcccagactcacttaagaaatatttactggtcattttctagatgcaaggaatgctgaaataaaagacactgctcttaccaaaaaagctaatctttccattcctctagtacattgtacttatccaaattctgcactgtccctttcattgatcttgaatagttctcaaattatataaatttctgaggtacaaacaacaacaagttatgtctttgtacttcaggagcttccagtacaaagaccagggtggatggg

SEQ ID NO: 173968 - DNA, 579 bp, Homo sapiens
attcacaaaattggcatgtgtaaactttaagctatttcctaagatgaagatgacaaacttggagggaaacttcattcatttggtttatttttatttttatttttatttatttttatctttttgagacagaatctcactctgtcccccaagttggagtgcggtggtgcgatctcggctcactgaaacctctgcctcctgggttcaagcgattctcctgcttcaccctccgagtagctgggattacaggtgtgcaccaccacacccagctaatttttgtatttttagtagagacggtttcgccacattggccaggttggtgtcaaactcctggcctcaaagtgatccgcccaccttggcctcccaaagtggagcccccgtgccccttgtttgtgacctgtcaatataaatatgctcagtagtggggggaggggtggggggtgaaaaaggaaatatgtttaatattaagactttggccttttagtgtaaactgatattcaaaaatttcttcatagaacatttgcttctttgcttgatcatttttctaattctgtacatctaaaatgcccagaatttgagttg

SEQ ID NO: 173969 - DNA, 400 bp, Homo sapiens
catttctagaatgacagtactcgactgtggtcccctggaaacttcccagcttcatcatagcacacaaagagagtgaaattgtaatttataatatttatgatactagggtaaaggggatgaggcttctcaggaccgcaagtaaccagttgcaggaggtctccacacccattccacctctctacctacatcccatccctacgccaaactgaaaagctctgcctaaggaacaagtgagttcaccgcaaccttcccttcatcccactcctaccattcagcccatttcaccactggagaaaccaagcagcctctgttgggcccctctcttgttatccctcctctaccactctttgaccgctgtcctcgtctgggagctgcactccctggaaacaggagactctct

SEQ ID NO: 173970 - DNA, 509 bp, Homo sapiens
ataaaacaaaacatgttcacttgaatgcatgaggccagcgttttttaaacgtgtggttcctaaaccacctacataagaatcaccagggttccttattaaaagtgcaaactgggctgggcgcattggttcatgccttttatcacagcactttgggaggccgaggtgggcagatcatgaggtcaagagattgagaccggagcagtgtgaagaagaggcgagaacgacccccgggtccgaccaaatgcccggcgcgccgcttgcgtcccggcgtcccagcaccttatgtccctgctgcctgtcgctgcctggcaccatgccccaagagaaaggctgaaggggatgctaagggagataaagcccaaggtgaaggacgaaccacagagaagatccgcgaggttgtctgctaaacctgctcctccaaagccagagcccacgcctaaaaggccctgcaaagaaggggttgagaaggtaccaaagggaaaaagggaaaagctgtggtcggattaacg

SEQ ID NO: 173971 - DNA, 283 bp, Homo sapiens
  misc_feature (29)..(29): n is a, c, g, or t
tctgaggatctcgacacacgccgaatgcnaacagaatcaaatgggtggacagaggaattaattcagggaggtaaagaagaaactgtaggagaattagctttgtctcctccccatctgccctatgacattattaaaagggagctggacactagctagggaacatggaagcaacagataaacaaatttaagagtgaaaagtggcagacgctttgtacacttaagggagtggctacttctccttgatctgggacataggatgggtatggtttggacagggaagaca

SEQ ID NO: 173972 - DNA, 592 bp, Homo sapiens
ggctaggtgtagaagccaccaggacgttctttgattggatctcttatttgcagctttgttttgggagacaagtgttcccctagcttttggcccctggggcagagaaagccttagcttgggccattgcactacagagttctgatgctgtgtagtgaaaatgggttgagataagccagccagatgattttagagcatttcagattaaaccaagccattatggttgattagttccaaactattacatgtcacacaatgtaagactctgtgacccttagtgtccagaaagattcagcccaatctggcggtaagcatgttgccaggaaggagacaaataaagatgaatgccagctgagggtggaagaggtgacatggctaacaacgtggagctgatgcaggtcaaacaactccagatatcccctcttatggctgagaggtggtacaaatacatgggacatttctgcctgcactgtggatatctgggacattgtgtgaatcctttcagtgacaggaaactcactaactttggaggaatgtcatcttcaccaagctttgtgagaacattgcctatggctactaatacaagcatgccaaa

SEQ ID NO: 173973 - DNA, 142 bp, Homo sapiens
tatttcaatccgtgtttgttgattaaatgaccaagccctgggattctgtggctgcagctgtgaagaaatcatagcagagattttttccccagatcccagagaaacgcagaattcaggcctctgcttcccaggctgactgaca

SEQ ID NO: 173974 - DNA, 639 bp, Homo sapiens
gatagaggtttgtgtgcgatgaatttgacccatctggagggtatcccagagccagtgctgaatgatgaatggggattcccatttggacaatttttgctttcaggtggcaaagtgagtcttctctttgcactaggggtttagaacctggaattgtggcaaggcatgaaactccttctgttcatgtggaaacagagctgggaattaacattcattttgtaatttcctcagagatgaagtaggctcagttatctgcatgaaaggtagctgtctctggaaaagctaaagatgtgatttctgcatttcctcacttaatatgcaccaagaagtggacattgaccttcagagagtagagctttcatttattgggtaatgaaccaatttgctgtcaaattgtttcatcagatgctattagtcacctgggatacagtggataaggattttaattttattattttcaagggacaagacttttgggactgagcttaatttaggaagacacagtagagtatgcattttctgtagatttctaagaacgagtattttaattattttgagatgatgagttataaaaggtctgtgagttgatttactttttgtaaccctttggcttgatacaggaggtcaaattccaaatgataa

SEQ ID NO: 173975 - DNA, 337 bp, Homo sapiens
catacatagatagataagatagatagattgattagatagattagatagccaggtggggtggctcacgcctgtaatcccagtgctttgggaggctgaggtgggtggatcacctgaggtcaggagtttgagaccagcctggctaatgtggcgaaaccctgtctactaaaaatacaaaaattagctggatgtggtggcgcacgctgtaatctcagctactcgggaggctggggtgggagaatcgcttgaccccaggaggtggaggttgcagtgagctgagatcatgccactgcactccagcctgggccacagagggagacctggtctcaaaaaaaaaaaa

SEQ ID NO: 173976 - DNA, 304 bp, Homo sapiens
taaatcacacaatcaacaacgtgtaacaaaccgaaccctatctatgtaatagctgaaaagccaggattggtgttttgattttctggcttaataaagatcaaagcaggggacttcccaatgaaaatcgaataaaagttgaatatcatactttaccaaaaaattctatctgttttcaaggtatttatttaaaaaaaaaaaaatcagctattggccaggcccagtggctaataccagcagtttgacaccagcctgggcaacatggtgaaaccccgtctctactaaaatacacaaaaaaagtcaggta

SEQ ID NO: 173977 - DNA, 189 bp, Homo sapiens
caggtgaggcttaaagagagcccaaggaggatgggaaggagatatgtcagatggaggaaatagaatatcagagcgcagtcaaaagaggagaggtggcaagaatggcagggcatgtgtctgccaggaaagggggtgggtggggcctgaggcaggtcatgaaactcgccagcagctcccacaaaggcaagg

SEQ ID NO: 173978 - DNA, 129 bp, Homo sapiens
ccaaatagctcttagacgtgccccctcctcacgatccctactgccactgtctgtcccaccacacagcctcaatccacccactatgaccatcaccataaccttctatactgcacttgtagacttggcaga

SEQ ID NO: 173979 - DNA, 386 bp, Homo sapiens
agcaaagactggaggtgtcagcaatttcataatcacatttaggatcaaaaatagaacccttctttggtcttctccatcaagtctcttggccactggcaaccatgtgactcgggaataccaattcacctccctggatccagtttctttcactgtaaaataaaggtgctggactccaagatcaccaaagtcccctgctcaacattccatggttgtggggctcagcaacatggtgcagcattaccttggccaggtcaggtgcaggcaggctattatcctgacatagtggggagagggaggtcctggttcccaggcacgcacaatctattcacaacactactgtgtaaaccccatgattctgcaaatgttggacagggattgagtttcct

SEQ ID NO: 173980 - DNA, 518 bp, Homo sapiens
tataaaagcgcggtgtcagcattaagaagaagctgaaaggagttacacgatgagaaacgagttacactgtgtagggttccagacagcagtgtccgatgacagctacaagagcagcactccttactccttacggtccagggggaatgcaggcaattcccctctggctgtcagtctccctatcccctgccgcgtctccttcgcggggcgatgggtctcagagccacccccagccaaagaaaggggcacgctttcgagatgtctccctggccgctcctgtacggagagtggcgcctgaggtttcagccccaacccgcctccctccgctagagtcagcggcggtctggagtccctgagccccgcgggcaggcgccacctggtctccggcccgctgcctagcacagcggcgaagctggctcgacgtgcgatttcggtttccgtccgtcggcctcgcccgcagtcccgggcgctgggagcggctgcgcctggcgcgcccggagcccagcggctccccgcggccg

SEQ ID NO: 173981 - DNA, 279 bp, Homo sapiens
gtgaccttgagtgatttacatgatctgtgctcaggttcctccactctaaataaattccctaagtgctttccttcctcttcatgtttgtaaacacttctggggacaaaaggatgtggaggaaggggtcgtattttagaggccagtttctcctttaggtccatgccctgtctttgctctggcggccactgcttggccccaagtccccttggcctggagggtgagttggcctccccaccctccgcttgctctgacccagtgtgtgcagtgccacatggccag

SEQ ID NO: 173982 - DNA, 171 bp, Homo sapiens
caaagatagttattttcctaagatgcaaaatgcataagccataaagaataaaatagaacagtggctatgaaacttctaaaactagggggcccaggccagcccgtgaaaccgttgttttctcttaggcctccaggtctgtgatgggaggggatgctgtgaggatctctgaca

SEQ ID NO: 173983 - DNA, 409 bp, Homo sapiens
aagcctctttttccatgcaaggcgaagatactgatcttagtaattccttggtgtttctcctagtataggagttattctatctgacatccaactagatttcaagcatgtctcctctacttgtgcagttaggggttgtgtggtacttggaaagctttctttgagggtgttgggaatgagaagaagccttttgttcttgctccggtgactggaaagttctttgttcttcccagaatatttccagtcatgcccttgatagtgtatttccagaatgacttctcacagtttgtgttctgatggctcatcagtaacagaagttgtatctgtcgggagggataggagaatagattggggaagtgcaggaaaaaatgcttggaataggtaagaataattctgagtgccctagccaggt

SEQ ID NO: 173984 - DNA, 471 bp, Homo sapiens
tgtgcatgctcagtgtttagaactgaaagccaaaggactctcacttggttttctggagaaaaagcatgatgaagcttcctccctgtcccatccagacttgacctccgtaatccacctcaccaggagtgttcagttgtggcctgcaatggagtacctggctatgctttggcggtacaaagtgacagctgattttatggcacaagcttgtctcagaagatgcagcaaaaatcaacaaccccagataaatgaggagataagtcacctcatctcattttgtctttatcacacacctgttacacctcaagagcttcgagatctgtggtccttgctgcatcatcagaaggtaaaaatcacaataagacataagcctcctttacattatgagttggttagattttctttgacagactggttgggaaacattttatttattctcaaaattccatattggaaacctcaggtttttttgaa

SEQ ID NO: 173985 - DNA, 348 bp, Homo sapiens
gcacaagaccctgtctcaaaaagaaaaaagaggattatttaactcctttttctgtaggcagggaagttcaaggagatggcccttctggtgagggcttccttgttgcatgataacatggcggaggtcataggggtagcagacaggtacaaagagagagcaacaaaaaggaggaggaaacttataacagcctgccctcataggagccaattcatcttgcacaagagagaatttactcactaccaagagaatggcaccaagtcattcataaaggatccacccccatgactcagaacacctgccactaggccccacttcccaaaacctccacgctgggtatcaaatttcagc

SEQ ID NO: 173986 - DNA, 420 bp, Homo sapiens
ttaaagacttaatcagactatgtcattcttgcttgatattttcagtgactcctgatcctacttagaatgaagttaaaattcatatcaagctctacaaggcccaacttacccttgcatagatggtctctcttctattctccctcatgctccacccatattgatgcccatcttgcccttgaagtgtgtttctgccttggggtcttacactgacaagttcctctgcatgaaatgattttttccttggatatttgcatggcttgcttcctcacctaatttatatttctgcatatcgccttatcagatagcttgtttttatctatcctatagatatttataacatatatacccaaaatacacaaagaattcctataaatcagaaagaaaaggcatgaacagatatttcacagaggaagaaatata

SEQ ID NO: 173987 - DNA, 282 bp, Homo sapiens
ttttggttgccactattggggaaatgctaaatgtcctacagtgtacaggacagccccacacaaagaactatttaaccccaaaagtcaacagtgctaagtctgggcaaccttaatttattagactgggattttcaaagaagtccatcacttgcaaaatgtgaagaaccacagccgtagtgtggagactttgaaatttggtgagatctgccccatggctcagcatgtaggccattttcgtaagtgctctgtatgttctgaaaataactattctcagcccagcgc

SEQ ID NO: 173988 - DNA, 243 bp, Homo sapiens
tgcctaggacaacaccgacaacacaatggcaaaaaagactgagctctccagttcagaacaagaatgagaaacttcagagaaaacacagcctccaaggagggcaagtgcacctctctccccacagaggcaaaagacaaatagaaagtacaagggataatcttctttctttaaaaaggggacaatgagtgagtctcaggcaggttcataaagactgccttgagaaggccagctgggagcacaggg

SEQ ID NO: 173989 - DNA, 245 bp, Homo sapiens
ctcgctccattcacagctcccttccaccagcaatgaaagaaactaatttgggtgcaaacaaatattgatttgcagagatgttcactaaagcattctttttttaatagtgaaggattaggaaaattcctttacctccaacaatatggaattaatttttaaataagatataggcaggaaaattatatttttgtaatgtctgtgtagataccactttagaaaaataattttagaagtatacataataa

SEQ ID NO: 173990 - DNA, 555 bp, Homo sapiens
tagacaaatccatagagaatgaaagcagattagaggttactgggggagtacagggtgttgttatagggtgatgaaaaagtttgcaaacaagagagaattgatagttgcacaacattgcaaatacactaaaggccatttgattctacactctaaagtagttaattgtatgctatgtgaatttcagctcaattagaaaataagaatggactgaaatggatgctttcattgaaagctaatggaaatgtaaagtgatgcaaccctctccttaggaaacaaggtttctatattcaagaataagttctaaacttactactctttgatccagtattctgtatctaggcaatgaaagaaactaatttgggtgcaaacaaatattgatttgcagagatgttcactaaagcattctttttttaatagtgaaggattaggaaaattcctttacctccaacaatatggaattaatttttaaataagatataggcaggaaaattatatttttgtaatgtctgtgtagataccactttagaaaaataattttagaagtatacataataa

SEQ ID NO: 173991 - DNA, 265 bp, Homo sapiens
tggccagctgccgaggcagagacagtgctgagggattgacagctgaatggagacctgaagagcttctgggagccaggtgaaagggatggcaagagctgcccagccccaggcaagagggagtttggaaagtttcatggaaactgcaccaggagcatcctcaccaaaatcactcccttacctcacaaacacatcccaggcatctgagtctgcacttcatttgtggaactttccaccagcctgggcgacagagcgagactccatctca

SEQ ID NO: 173992 - DNA, 226 bp, Homo sapiens
cttgctttactatccaaaacaaccatgacacatgacttctctggcggggtgttggccaagacaaactgaactatagaagatccttgacttgccaacgttcaaatgatgaactttcaaaaatagcgaaactggctgcagagcaaaagcttttcagctctgcacaacaccaacagatggcgctaagtgtcacccttgtggagagcagagggacctcggaagggccttt

SEQ ID NO: 173993 - DNA, 195 bp, Homo sapiens
atcacatggtcaggtttgccctattgtctgcaggttgttgttgttattattgtgatgatggtgaggaggaggaggaggaggaggaggaggagacagggtctcattatgttgtccaggctggagtacagtggtgcaatctcggctgactgcaacctctacctcctaggctcaagcaatcctcccacctcagcctcc

SEQ ID NO: 173994 - DNA, 969 bp, Homo sapiens
gagtcttaatatactaaacagtgaaagaatgatgatatctcatttctaaagtaagcatggttcacaccactttggcaatacactgcagtactttttaaaaaatattctctagtgataaaagtaaagacagggtactggccaagatcctaattctgacttctgactgtgtgatcttcgatgaaatttatatttccctttatcattactattctacttgttaagtaaggctaagttaatatttgtcttcgccttaaattctgatttgtaatttgtaactctgatgtggtagctgtgatatggtgaactgaaaaatccttattaggctactttatctgttctcttttagttattttaaagtgtacctgtttctgaagtaatgtagtgaatggtgaatacttttcaggaattcttccagttttaaaatagccccaaagatacagtttcagctggtggaaggtctgttctgctctcttagtcctaatcagaaagtcccttttatcttataatcccatactaaatccaaacccttagcaaatccttgctgccaaccagaccactcacaaatcaaacaaaatgtaagcaagcaatccagtactcggttacaccagaagactctgatctttgcccccgaaaaactgtcctactttatccttatacctgaaatcactgcatacctgaaatcactgcagccctactgttttaccataccattaatttaaaaaggcatctatttctttatagaaagaaacattcacagtgaggtctagtttgtgaacttcaaaatccagatattaatcccttagtatacctgcgtatgctctcacgcaacgctgcatgcaggtggatcatgctcattcccttaacattgttcaagggaatctctgttactccatgatatcgtgtaacctgaccgacactcatgtggctccacaacgagatcttcaattcacacaactgtacacacctctc

SEQ ID NO: 173995 - DNA, 1009 bp, Homo sapiens
gagtcttaatatactaaacagtgaaagaatgatgatatctcatttctaaagtaagcatggttcacaccactttggcaatacactgcagtactttttaaaaaatattctctagtgataaaagtaaagacagggtactggccaagatcctaattctgacttctgactgtgtgatcttcgatgaaatttatatttccctttatcattactattctacttgttaagtaaggctaagttaatatttgtcttcgccttaaattctgatttgtaatttgtaactctgatgtggtagctgtgatatggtgaactgaaaaatccttattaggctactttatctgttctcttttagttatttctcacacgtggtcctgtgtttttgtcgagctcataatgtgctctgctacgatgtgtggtcgaaaattacttttacaagagatattcgttccgagtttacaacaagtagcccccagaatgatacacgtctttcagctggtggaaggtctgttctgctctcttagtcctaatcagaaagtcccttttatcttataatcccatactaaatccaaacccttagcaaatccttgctgccaaccagaccactcacaaatcaaacaaaatgtaagcaagcaatccagtactcggttacaccagaagactctgatctttgcccccgaaaaactgtcctactttatccttatacctgaaatcactgcatacctgaaatcactgcagccctactgttttaccataccattaatttaaaaaggcatctatttctttatagaaagaaacattcacagtgaggtctagtttgtgaacttcaaaatccagatattaatcccttagtatacctgcgtatgctctcacgcaacgctgcatgcaggtggatcatgctcattcccttaacattgttcaagggaatctctgttactccatgatatcgtgtaacctgaccgacactcatgtggctccacaacgagatcttcaattcacacaactgtacacacctctc

SEQ ID NO: 173996 - DNA, 257 bp, Homo sapiens
cctctcaccaccccacgattcccatgtccagcaagcatttctgcagcccccaccctctgcctgagctggacccagtcggggaatggggatgggtgggacaggtagaggacagcaataaaggagacacatcctgcctgcagctctagctggaagagcataccacctagtatcaaagtaggtatgtgctctaacttcatactgttctgtccataaaaaaataaacaatttaaaatgtatattctcttaaaaaataaaaa

SEQ ID NO: 173997 - DNA, 227 bp, Homo sapiens
ccaggataaggcatatatgcaaggccacagaatcagtttcgataaatttcaaatgggttttaaagaactacacagaagagtaagaaacacacaacctgaagtggtgaagtactaagaatagaccatccatatttattaaaattctgccttgcccatggtttgagctattttagaggcagcctaatttatcaggcatctgtgttgacaaagctatgttaattttcagg

SEQ ID NO: 173998 - DNA, 1038 bp, Homo sapiens
tcacccaaacttctaccttcccttgggttgccaggagcaacagcttcatcttgggggagccgagtgcgtggcgaccctccctgaaactagatcgtatccctctctctgggggtgggggaggcagtattcaccctgggcgcgcgtccactccccggatgttttctgtgcaatcgaggctctttccttccactgataccccgagttctcttttttggtctctagcaaaatccacttcctgttgtgactcaacacccccaaggggcaaggggtggatgcctgagtcgcaggggagcgggagcaaaagacgaaaaggttggggctgtaggcctcaactcagagggtatcaggaatagggaattggtcctgagctctggcttgctctgcaaaacatcatatcaaccccacttccaacctatagagtatgagaacccgggtttctgagcatcaagtagacgagcatcagaaagagatcatcagagagatgatccgtctcctggatcagggtttaaacatcccagagaaaggggaagttgctgacttgtgggaggcccctgatttccgtcatgtggttcagggagtgggacagatggaccaaaggagactgctaacttggcacaatttccctcacccccatgaaattctgggccacaggaaatggagcgaatagcaggaagtgtgaaaggacatctgcttcagctacccctgctcccactgggcacctccctggtcatccccacactctgcctccttggccagcctagtatatgcacgctgctcctccccagcctggcaggaggtggctgggttaggatccaaagggcaagtgccttgcagctgctccagggcaattgccccagaaccacactccagttggcccactgattgtggctgtcacagccctgtgccagggctcctaatgggaggacaccctgggacaaagaggaaaaccagaagcaaaggggagggagagcctggatgatgccacggcactcagctcccaagttgggatgaaagatagggtgtttattctagcggcta

SEQ ID NO: 173999 - DNA, 441 bp, Homo sapiens
ctgaactgtatacagatatttcaatacattagaacactttgttgttcaatgtaaatgctccaattgtgcaacaactaatctgtttacttcagtataaagtagaatactgtcatttggaatttttacatccctcagtttaaaagtgcatttatttattcccacaaaacatatttgttccaatactatttcccaacagatgagagaataatgacagatgtgaactttagctcaagaatacttgtgcatttctgccaattttgttcatcttgtactcaatctgcagcagctttttagagtttttttttttttaataatcataagcacaatttcaagcaggtaggctaactattgggaggccttcttttggatctggaattcgactcatgtggtattattatatgatcacaaaaagcaagacaccaatttgacagattcacctct

SEQ ID NO: 174000 - DNA, 321 bp, Homo sapiens
tgttttctgtgatggagcattggcaggtgatgactaaatagatccagatcttagggccagaggccaaaggggagcagaggaaacagatggttcaagttgaagaggtcaagtagcctggaggccagtgttgggtgggttatctgtgtagacactgaagtcaccctggatgatgagagagctcttgggcaaagaggaaggtgggtagccaagtttttcaaagatgagtgggatgacagggtcagtgatgacagccctgagttgaggatgatggtgcccacacagggtttcttccaaaacaataggaagggaattctggactct

SEQ ID NO: 174001 - DNA, 366 bp, Homo sapiens
ataccatcatcaggggtgtgatgtggagccaaagtcactgcagtaagatattgaatcctcagtatcgtctggtggagagtagctacaggtgtaggtgctgtgtagggtttacatcctggcttcccttgtcagctgtgactttatgcaggttactttaaccctctgtgcttagttccttcatctgcaagtggagataataagggtagcccctgaaaggggttgtggggaaagttgcatgcagttcttcggaagcatctggctggctagtgagcattgggtaatggtccagctgctctgccatgatcattagtgttatctgacacttctggtgaacttcaggctaggatctgccaggacgatctaagc

SEQ ID NO: 174002 - DNA, 722 bp, Homo sapiens
atctgaaatcatgccgtttgtttgaattgttttttccaatatgtgcgctgctggtgttaagtctgaatgaaggaagggactgggagtcatttcctaacattgctatggtttgaatgtgtcccctaaatttcatgtcttggaaacttaatccccaaattcaaatgttgattggaagtggaacctttaggacataattaggattagataaggtcatcagtgtgggcccccacccccatgatggaactggtggctttataagaagaggaagataagaagggaaagaaagacctgagctgacatgcacatgcttgaccacttgtcatgtgatgccctttgccatgttgtgacacagcaaggaggccctcaccagacgccagtgccatgttcttggacttctcagcctccatattcatgaactaagtaagtttttttttctttataaattatccagcatatagtattctgttaggtaacagaagacagactaagacaaccatactcccagtgcctagattaatacatacactgtagatgattaatacatatggttcatatggttgtttgtttgtttggttggtttttgagacagactcttgctctgtcacccaggctatagttagttcagtggcacaatctcagctcactgcaacctctgcttctccagttcaagttattttcatgcctcaaccatctgagtagctgggattacaagtgtgccccac

SEQ ID NO: 174003 - DNA, 717 bp, Homo sapiens
atctgaaatcatgccgtttgtttgaattgttttttccaatatgtgcgctgctggtgttaagtctgaatgaaggaagggactgggagtcatttcctaacattgctatggtttgaatgtgtcccctaaatttcatgtcttggaaacttaatccccaaattcaaatgttgattggaagtggaacctttaggacataattaggattagataaggtcatcagtgtgggcccccacccccatgatggaactggtggctttataagaagaggaagataagaagggaaagaaagacctgagctgacatgcacatgcttgaccacttgtcatgtgatgccctttgccatgttgtgacacagcaaggaggccctcaccagacgccagtgccatgttcttggacttctcagcctccatattcatgaactaagtttttggaatccttaggcttccacgtgtggaaagcctgagctaacctactggaggatgagccatcacctggagcagattcaggccatcctagttgaagcctccctaggccaagcaaccgtccaactaccagacattgaccattcagccttgaacattcagcacaaagacaaaacagaccagaccagaagagtcccacagaataggggaaactattcagagaaaacttaagccactaagttttatggtgttttgttctgtagcagaagcataggcatactgacaatacaaaccgaaa

SEQ ID NO: 174004 - DNA, 501 bp, Homo sapiens
tgtttctactttaagcctcttagctgcgtttctgtttctatagagcaagagcagatcccagaaaagtaatttttcttcctttgttgaaacttctttatctggcagaaaatggtaactcatcaaacctgcagcagaaggcaacttttcaactctcagtcaatttgatcaacattcagcatccatcaaatgaaggattgggagtgataaccttaaaaaatcctgctaggctgctggttattgattctctgttcagcctgatggatgaagatgcaaaggcaacaagtgaaagtgcaaacctggctgccggcctccttcataccacgttaggttaggcaggacttgtgtctgaaaagcaccattgttagttttaccaaaaatgcactgctgtcatcacgaccaatcagaatgtcaccctagctggagatctgctcctcctggcctttccttgggattttcagaaaagctcagaaaacaatttacaataaaacttaattactttta

SEQ ID NO: 174005 - DNA, 359 bp, Homo sapiens
agtgtgaccgtacatcccagtttgcctcaaacaatcccagtttatacaggttgacctggtcggtgaacttttttttagcaatctggttggtgaacttttttttggaaaaaactagatatctggatttggacaataactagaatgatgctcttaagtaaggactcacgctgaactgcaccgcctcttccctctgctctgtgctcccttgcatccacacgtgccagtggtgaaaagttcattcagagaactcaggttacattttcttcatagtctttggcatcagaaaacggtctcaacccaggggcaatttgtcttaaatgacttccactgctgacatgtctgacccaaaacgtccctcc

SEQ ID NO: 174006 - DNA, 213 bp, Homo sapiens
ttttgatgctggtgaaaggagtgtttcctttttagaattcctggaagctcttattttacctgtaggcagttgttttgtaggttgttaaatctccaaggggtcttgacttgtaaaggaaacatgttctggggagcatctccccttctttgggtcttgtgttcatgcctgcctggcctgggacctgctgagcctcaggacaggccttttgatgtg

SEQ ID NO: 174007 - DNA, 294 bp, Homo sapiens
ctgagccggcccgattcactggttgatatgtttggatttaagtctaccatgttaatattattctgtttgttctctctggtttttgtttcattgtgctttttctgtgttcctgtagattagtattccatattgatttatctgcatttatgtttttgagtatatatctttgtattttttttgtatgattacactagggcagtttctcaacctcagcattttgacatattgtactgaatactctgttatgtggggttttcctatgcattgagaagcttagcatagatgcaatgtccc

SEQ ID NO: 174008 - DNA, 866 bp, Homo sapiens
ctgcccttttggctctctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaaagcccagtttgaactgggaaagctcatggagcttcatggtgaaggcagtagttctggaaaagctgctggggacgagacaggtgctaaagttgaatgagctgatggatatgaaccaccagtccaagaatctgtttaaagttcagacttcaaatagtggcaaataaaaagtgctatttgta

SEQ ID NO: 174009 - DNA, 152 bp, Homo sapiens
tggggaggcctggttggagggaggccccgctctggggtaaagatgacagagggctgggctctgtggaatgctacattgtgtcactatatatacatcttggtattgtggcatgaagaacagctctgtctttccaaatagaaccatgcaacatt

SEQ ID NO: 174010 - DNA, 726 bp, Homo sapiens
agcctctctaagcctcattttcttaccgtgcatatggaaataatagtagcatcaacttcccagggttcttatgcagattaaatgtgttacagaacataaggtgtgccaaacggtgcctggtgcaaagtaaatgcctcaaagaatgttagctagtattattgcttgcagcttaaatctactcttttaccctgtattgataaaaatctataatctttttgttctaagtaccctgtacaatactttgcacatagcagatgttcattaaaagttcaaattgaacctggaaaaaagtcaaacaaattatactacagtcttttttccccctcatcaactttattaagaatttatgtacagtaaactgcagccatttaaagtgtctgagtcagagttttggcagtgtgtccaccctgaagccatcaccacagtcaagatgcagaacatttccatcacccccaaaagactccttgtaccctttgcagtccaaatcttctctgcccaaagccccaggagccagtgatctgctttctgtcaccacagattagattacattttatataaatgggatcacagagaatgcactcattagtgtctgactactttgactcagcacaatgattttaagattcatccatatgggatgtctcagtagttcatcactctttattgctgagtagtatttcattgtatggctataccatattttgtttatctgctcaccagttgatg

SEQ ID NO: 174011 - DNA, 481 bp, Homo sapiens
cagtttggaagcaatgatgaaaaggataacttacaaaatgtttgtataaatgcacttaatgccacagaaccctacacttgaaaagggctaaaaggaagctgaggtgggaggattgcttggggcccggagtttgagaccagcctgaggaacatagggagagcctatctcttttaaaaaaaaaagaaagaaaagaaagaaaaaaaaagccaggcatggtggcttgtgcttctagtcctagttactagggaggctggggagcagggtaggaggattgctggagccctcagatttgagagtgtagtgagctaggatcatgccactgcactgcagcctcggtggcagagtgaaaccatgtctcaggaaacaaacaatggtttgtgtcatctgagatgcaaaaaaataataacaataataagagaaagaaaaccaaccaacaaacaaaaagttaaaattctccaatggtacagctttaagaaattaa

SEQ ID NO: 174012 - DNA, 1436 bp, Homo sapiens
atatccgcctggtttggcccgcctgcctccactcctgccttcaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatgtcgcggcagctgcgtgagtaccaggagctgatgaacgtcaagctggcctggacatcgagatcgccacctacaggaagctgctggagggcgaggagagccggctggagtctgggatgcagaacatgagtattcatacgaagaccaccagcggctatgcaggtggtctgagctcggctatgggggcctcacaagccccagcctcagctatggcctgggctccagctttggctctggcgcgggctccagctccttcagccgcaccagctcctcgagggccgtggttgtgaaga

SEQ ID NO: 174013 - DNA, 1227 bp, Homo sapiens
atccaagatatcattgattatatatatataatgtatctccaataagatacatgagaggtgtaataaaataatcaagcattgagtcttggccttccacgcaagactcaggcctcttcagaacagaaggattaagatggaaatggaatagaattcaaatgttaaaagaatgaagggtcaagagagttggaatgaaggtaaatgggccacctgtagaagtctgaaagtgagctttggagggaagaaaagtaaatactgctttaacaagaagtcctggggaatctgaatgaattagatcctgatcatggatccataacatgtggatgtggagaattaatggtatctagggtccgtatctaactgatattcaagaagtatagttagatggccgggtgcagtggctcacgcctgtaatcccagcactttggaaggccgatgtgggcagatcacttgaggtcaggagttcaagaacagcctctactaaaaacacacacaaaaaatagccacgtgtagtggcacatgcttgcaatcccagctacttgggaggctgaggcaagagaatagcttgaacccaggaggcggaggttgcagtgaaccaagatcgcaccactgcacttgcactccagcctgggcaagagagccagactctgtctctcaaaaaagaagaagtatagctagaaattctaagaatgactttgtctaaaatatattctctgaagtctgcagaaactaggatgagcagttctttaatctgatccaacagggcatttgtaggacttttgtgaccttaaatgaactgaaataacacaaaaggtcatcagagaatgtccaagcttctcagtacacatcattttcccatttattaaatttgaaggtatcttatattcagcaaaaatgagagctcattcagctgcattttatttccactacaaagaagtcaaacctagaacccatgtcaatttgcagagggatcttcattcacctatgatcttcatcccctaggcttttgtttcatttcctttggttgtaattaatttattatggaaacttaggtaaactcagcttctctcagccaggaacaactgcaaacacatttatttatctttcttccccaaatctacaagacatcaaatattgactaaaaggtttcttcaaaggaaagtcagcctggtacacggagctcatttctagccatccttgaatgtttgctgttttcccaaagctgctgac

SEQ ID NO: 174014 - DNA, 725 bp, Homo sapiens
tcttttatattactttactcagcaaataagcttttaagctagctcaagagtatctttttctcccagataaacagtgatgtaccctgtatattaaagggcaaagctgaacactgaaggcaagtacccttaattatgtgcaaaacgttttcaatcaaatctattgtcgtacgcacaaatatcaaatttagaggttggcctttggaaaactcacagcacaacatttcagaaatcttcagcattcagcagagtctccctgaaatgttacacccaaaccagagagaaaactcttgtgatcttacaaaaggttcttgattctttgaattatatttgggataaaggagaagaagaggagttggagtgtgggaagatagatgtaagtgatggaagaatgcagtctggtggaagaatggggatgcctagattaaacaattggcatttgtaaaaatgaaaatgaagtggaataggagcgtacagaatctggcaaataataggtgatgcaaaattcagtatcaaaaataaagacagcttttcccctctgcttcctgcagtataaatggtgggtacatttttgttttcttgtcattcattccttgcacccaacttttcagagatggatttataataaatgatcaagggtgttgttttgactgttaagatccattttggtatccagctaaattttacagaattcctttcacatcacaatcttgttcctcatgtttcac

SEQ ID NO: 174015 - DNA, 429 bp, Homo sapiens
gtggaatcctggaagaaaggagctcttacttagacaataactgctttatttgatgggtcacttgtaattttgctcataacacagagctgcttgtcatgacaatgttaattcgtgggtatgatctacttcggtatctgttttgcacagtgaatttctttgaaccccggttgcaaacaaagaaagaagaaaataacacaaaagcatgctggcttgagtgcctaatgccatcctgctgcacaacttcctcacacaccacacgggctcccgaggctataaaaattgtttttgtctgattaaacacaagtccctttgaacttggtgggggttcttttccgcttgcactttcttctaactgtgtgcagccttttcttttttttctggtttgatttggaatccaaagtgtctacaagttggcccattccacctggc

SEQ ID NO: 174016 - DNA, 263 bp, Homo sapiens
ctgcaaagaggatgttgagtatcaatgctttaacagaaatcaccacctgcatgaggaaaaggtatgacatgaagcatggataactcacacctgggcagctcccaacacagcacacacacacaggcaaagaggcagcacagggctggctggtcatttaccacgttccgtaaatgtgaattctgtgcggcagcagcatctcctggggactgtaatgtggccattttaatgcaaaattaattgtcaaatataagactgcagcggcc

SEQ ID NO: 174017 - DNA, 224 bp, Homo sapiens
gacatgacgttccctgcacccagaacatagctagcatctgctatatcgtcgaatgcatgtcaggtcggcgtggcatagccctggccgtcagttatacaagcagtgggggagtcagggaggggttcagcccagggcatagaaaagagagttccagacctgagctttttgttcagtaagagaatgattaatggctggcagacacaaatcgtgtggtctcattttgt

SEQ ID NO: 174018 - DNA, 507 bp, Homo sapiens
gtggcacttcacagcgtgctcctgactctatcccctcacaacagcgctaggctatgtgtaaagcactgtggaagcagggggaactcagagttttacccagagacttcagaaatgatgtctggaggggagatttgggttcgatcctgaaagaggaccagaagtttgccagatggacaagaggaagagtgctccaggcagaggagtccccatgaggggtcacggacaaggaaatccataatgtgctcagtgaatggggccaaacggaaaccactggacattctttagcccagggagaacatatccagataagacacaagtggacttctgcaccaactaagagggggccttgcaaaattaagaatgggtcttcgtggaggcggaagagactgagttgactcaagaagataaattattgcatgcactttaaaagctttagagaaacttatttacatacagagtgcttattaaactcttttttgctctttcattaaaacaaaccacaccctc

SEQ ID NO: 174019 - DNA, 321 bp, Homo sapiens
tttggcaaccccaaaggtttagatatgaaggtgaaagtgggtgaagtactaagagggcagtcctcattcgcacaagatgtttttatttcaagcctcctgagaatttggaattttcagtagttccttttaacattccacttatttcctgtattgatttaaagctttaaaaatttttattttaaagtaaatagtgttaccgaagcttgagctgtgattcccaagtgtgttttttaggataagaaggggcctcgcggaagttgcggtgagccgagatcgcaccattgcactccagcctgggcaacgagagcgaaactcagtctc

SEQ ID NO: 174020 - DNA, 203 bp, Homo sapiens
cattcctttaagaaaactttggggctgggtgcagtggctcatacatgtgatcacaacactttggtagaccaaattgggaggatcatttttgaactctggggtttgagaccagcctggacaacattgcaagaccgcatctctattaaaaaaaaaaatttagctgggcgtggcggtggacacctgtagtcttagctgcttgggag

SEQ ID NO: 174021 - DNA, 564 bp, Homo sapiens
actgcatgtaccataactgcataaacataacaactgcatgtaccataactgcgtgtaacagcagtgcatgttttcctcctttccctctgtagttgcagagctagcaaggcgttctggcctccaggaaccttctcaccagggcatacattccccttccacttggggcagaataaatttcatgcaggacactcatctgcatttggcctccatgcacatcagtaagtatttaactgaaaatgtaaaaggtctctgaggctgaaacagcaaagccctgtgagtttcctttaacctatccccaaatctgtccccctcaagtatcccattccccaggtagtgccagtgcttcttgaagcagttgcttttaacagttttctctgaagtgaaataccatcgcagcaagctgttactcccctgcacagagctgctgaaaactaatcatcgagcttcaaacgccaggtttggcaaactctggctacagaaaaccactaatcttgtgatggcattttagaggtctccactgaatcacatttccaaatgaaataaacccagtctcccaaactgggc

SEQ ID NO: 174022 - DNA, 599 bp, Homo sapiens
gaccaacacggtgaaaccccgtctttactaaaaatacagaaaattagccgggcatggtggtgggtacctgtaatcccagctactcaggaggctgaggcaggagaatggcttgatcccaggaggtggaggttgcagtgagccgagattgcgccatcgagattgtgccattgcactccagcctgggcaacagagcaagactccgtctcaaaaacaaaacaaaacaaaaaaaaaccccttggcttgggggaaaaatctaaacagctataaaagaacattttggaggcaattgaggaaattcagatatggactgtaggttatattgaattaattttttcaggtgcgataaaagtatcttagttatgtaagaaaatgtccttattcttaggaaatgcacactgaagaatttaggggtaaaatgtcataactgatatctgcaactttcaagtgattccataagtgaagaaaattacggtatatgagagaaagagaataaatatggctaaaagataactggtcaatctaggtcagagttataaagctgttcattatttgttctttcagtgtttctgtaggtttgaaaagtgcaaaattgagggagg

SEQ ID NO: 174023 - DNA, 344 bp, Homo sapiens
ccatcagtggttttggagcaaggagtggtggtgttaatattgcaaaaaggtagattaggaatggagatagagaggataggtaggggactgcagtggtctaaatgtaaggaaattcttcttcacattaaatctgagttcctctggttgcaatttaagtgtattgattttgatatttcagccacacagattaagcacccagagccagggtggaataacccatccctaccccatatccatttagggctgttgatgcacaggagagattaagagttcacaaactttagaaggcaactaaatttaggttttattgtcaaagcacataaaaagttaagcataaattattc

SEQ ID NO: 174024 - DNA, 236 bp, Homo sapiens
agcccgcagccccaccccacttcaggcatccattaatctcagttctgtcgttgtagattaatttttgcctgttctagaatttcatatagatgaaagcaaactgcacgaactctttttttactagattcttttgctcatatttttgagattcatctatgttgctatgtgtagtttattcctttttattgctgaatattccattctgtgaataccacaatttgcttattcatttacct

SEQ ID NO: 174025 - DNA, 653 bp, Homo sapiens
ttgtggctttagacatggtcatgacatcccccataaatctacctaactgtattgtgacccagtccacaattccccaacacatgcacagtccaacagctttggtcaatatcttgctgaaattaaggttaatttttatcagatggtatttttctgatctagcagtctggtagtcttattaaaaagcgtattagctgacttaatttatctattaaaaagatggaatttaaataaatgagtaaagaaataaaatcagcagggcaatctttgcttttagtatgttgatatgtctagaattaccactatattttggccaagatctaaaaaacatccattttgttatgaaacttataaccagttcataccctaaactccaaagaatctatactttttctttttaataaaaaagtacagaattttctcgttacattttttttcaatgtactcttcattatttttcaaaataatggatagtggttgttttctgaattatatcactggaatataattcgttaaatctggtgattcaactgatctaagtgatttattagttttgcttcatactaatacagtgggggatggcatacataattaagagttgagataaatactattttctctacttctacatatatttgaaacttttcataataaaa

SEQ ID NO: 174026 - DNA, 517 bp, Homo sapiens
tccggtcacacgctgcaggtcctgactctggcctcgctggtggtagcccctcctgaccctcctgtcagctgctcaccctcccaaggcaagggtttcatccctgaggtcccttttatgcccctcttttcggaaaggatgaacttgagttggagtgacatggcagtcatttggattcagtttccagtttcacttctccaatctcctaattgctgcttggttgtgggccggggcttttagaattgattgggcaacatggcgtggaattgcctccgtgtatgtgccatccactctgtggttcagggagctcctgtgagttccttaagggaactaattaccagctagcacttcttatcgttagcgttttctcccatctgccagccaaactcacttcttttacaccttagataatgtagtgtgttttaaaatccagcccagatgtcccactttctaaccatttcaaactgatgaggaagccaagtgtcacagccaggaatgggaaagtcaggactttttgggc

SEQ ID NO: 174027 - DNA, 414 bp, Homo sapiens
tgtaggcgtatttggaagctcattagaacagaatactttaaactttctctaggtaactttacaaggaagtgtgatgcttgaataaacacagatactggttctacgcacacagatcaaatcatgtaacactattaccaagacaaagctaatttcttttcacagacaacatttaaagcaaccaaactctaggttagttatgtaatttaggctagtctttaatatcctcactctttaatgtagttcaaggactgctaaatagcaagaatgccagaatgagtgggacaatatatatatttttaatgtctctcttatttcacttatgtttgtggctagaggagtgacctggggaaggtacgtaagaataaagcttcaggatcagtagattctaaaactacttttctggttgaactttgt

SEQ ID NO: 174028 - DNA, 362 bp, Homo sapiens
tttccatgaatgcttaaaacaaacaccaaccaaaaaggtactgaagagtttggtaaagaattcccatcactactgtggaaagagtttccaactgtacccagagaccatgtgtaaaccctaacccctggaaggaagtgagaagcagaaaagagggatgcatggggaatcctcagagggtgaaatctgtccacttaagtattaaagaacacatgtggaggatgtatcctgtccatgttttctttattcttgattccactcaagtcttttttttttttttttttttttgagatggagtctcactctgtcacccaggctggagtgcagtggtgccatctcgactcactgcaagctctgcctccagg

SEQ ID NO: 174029 - DNA, 795 bp, Homo sapiens
gcggaggttgcagtaagctgagatcacgccactgcactccagcctgggcgacagagcaagattccgtctcaaaaaataaaaaaaaaaaaccatgtcacagaaatattcgaggagagaaaacaggagtgtttcagaacaattttataagcatgactatgtcctcataagatatttgtgagttaagcctgttgcatctaactctgcccactgacaaggtagagcaatggtggcagatcccccagcagtgaacagttctggggcccaggctggggttgcttcacagcaaaagaagcagtcctggcagggtgcttggctccaggtctggggaagaccctgcaagatgggtgtggagtgctctgtcatgctggagagcgaggaagctattgcagggtggctggggctgggagacagggttaggagcctgtctctagctggtcatgggcagaaacttgaagcattcatgaaaacagctaactctgagttcgcaagggtgctaacaaaacccttcgtcatcatatttgtaggatgcaaaggaaccatctcattattttgaatgctgttttgaaaaaaagaagtactcaagcatttaacccacctttcatttataaactgtacctcaggcaaaacagatagtgtgtgatcttttgcatagaagtattccagccaatactacatgaaaaggatttttgcaaactagaatcagcctgttgcaggctctggtgaaggagatgaccagggcggtgccactccaggtgcagcgcatgtctagggtctgctggtctgagatggtgtgtt

SEQ ID NO: 174030 - DNA, 651 bp, Homo sapiens
gtgagctattactgtagttcagcttaactaagcatcaagattttaaaacaaacacactaactgaaaaatagagtggcaagttaatcaagactaaatcccagtttaatttaattttgacattttaatatgctacaaccaataagaaatctatgccgaatgataacttaagttctcatttgtccaaaaaaatatttattaagctctctgtcaggcattagctttgtcccggatgttaacatgcaataattatacacagatgcttgcctcatgcagctttctctcttgagagcgatagtcacaaatgtaaaaaatgcaaattgtgccaagtccaatcaagggaaggtaaagggagtattgagggaactggtcagtagttagaggcagatgtgggtatctaaagaagactttttaaaaatctgagattaactagaggttttatttttcaatgttaataggaagccagctgaaagaaagggtagaatatgtgggagacagtatataagtagtagaacagagttgtgaggagagaggagatgagatgtagagtgtatgtaaagggtaagactatttactgagagtgagagttcagtgagaagagcaagggaatttgaagagtaaagaaagatatgaagcaatcgtaggtaattgggc

SEQ ID NO: 174031 - DNA, 302 bp, Homo sapiens
agcagcctggcacatcatgttctgactctgggtgcagggctccccccacctccccattttcaccttgatcagtcctgacattctctccacgggccagctctggtctgtgtgttgggaatgaccactccaggaacagagtccaggcagtcagcatagctgagggtttgccacagtgctctggacagttgagtaagacaggagctacagccgggcacgatggctcacgcctgtaatcccaacactttgggaggccgaggcaggcagatcacctgagatcaggagttcgaaaccagcctggccaa

SEQ ID NO: 174032 - DNA, 309 bp, Homo sapiens
gagtagaattataatttggaacctaatctgaataagaagaaactgatcagaaaagaagtagtggatgcctcaaaagaaaacaaccaagacagataggcaggcagaagggcaaggggcacagctagatgtagcaactagactctgagaacaggcttcaaccagacctaaggctgaggtgctaaagacaggaccgaagtctgaggtgctaaaagggaagacaacaggattgaggttctcaaaaatgaaattctggcaatctcacattatttaacatagagggggaaaaaagagggggcttatctaaagaga

SEQ ID NO: 174033 - DNA, 177 bp, Homo sapiens
ttgaggcatttcattattcctagcaactctagtcgagggtaaacaagaggcactgggaataaaattgaagtcacttttagcttcttattagcaggtatgggaaaaacctggggataagttgggtgggtggtagaaaggactgaaattgtccaaagtgaggtttgagaaatatctatg

SEQ ID NO: 174034 - DNA, 871 bp, Homo sapiens
gacatagggagggagaaaggaggctccaggaagaatcggaatgagaactgatgaggacctgaactgcagcaggaggagagagagtggcgaggacgtctcacgtgtgaggacgtctcacgtgctgtcatgtcatttattggcaccaccttcaacacaactactcaagcccagttgctgagcatcatctggaatcctttcaccttcccatgcacaatccttgagatccggagatgctacctccaaaaggcaaccaaaaaatctaacgacgactcactatcttcccatctactgtccagttgtgtatatatgcgtctatggaccaggtagtgtgtcaaaggtatttcttagctgtagggttgcagcaaaaaagtttggaagctattcattgcccattaggcaattaaagagtaaagatgtggcccctgcctacatctttaatctcatcttctgtcatctccccctctttgctcctttagtccctggaaagtggtaagctctttcctgccttggggccttagtatttgctgttaactctacctggaacattctccttatctttcccatggctgattcactgccatccttcaagtctcagtttaatgtcatatcctcagagaggccccccatccatattatgtaaaccatgtcttcttcccatcactacacgctatggtctgaaagtttgcatctccccaaaattcatatattgaaacctaatccccaatgcataggattaagaggcgggacctttaggaaataattaggtcttgagggtaaagccctcatgaatgggattagtgctttatataataaaagagggctgaagaagcttattagccccttctgccatgtgaagaccttagaaagtgcc

SEQ ID NO: 174035 - DNA, 412 bp, Homo sapiens
tctttagatctctgatttaagtgcgttatcttttttctcagcataggctgtgattttcctcaagccttccttctctgttagcaatttcattttcaacagattctgttatgtttcctggtaactttttctgtaatgacattgtttttatccccaatgtcttccttggctctgtaattaccttttttatttcattgagtagtttcatcatcttgtctttgggatccaattaattagttttcaataatcttgattttgcatgaatgaattccccatactgcctctcctacccgagagccaactctaacccaggaattatcttggaggatggggagaataggcaaaagatgtcccattcaccattaagtgagacaataattttgctcatatgttatgccctccaccttcccaactc

SEQ ID NO: 174036 - DNA, 314 bp, Homo sapiens
atatttcatgaataatttagcaccatcctctaggtgctgtctggtgatagagttctaaaaagatctgattgttcaaaagtgtgcagcacctctcctaccactagctccagctctggccatggaggatgagcctgattcccttgtgctttttgccatgactctaagttttctgacgcctccccagaagttgagctgatggccagcatcatcctttttgtacagcctgtggaaccatgagccaattaaacctgagtttttataattaattacccagtctcaggtaattctttatagcaatgcatgaaaagactaat

SEQ ID NO: 174037 - DNA, 217 bp, Homo sapiens
atgtcgcatgggcctcctggagacagcacgctttgccagttttgttttcaagagtctcatttgatttgcattttctgagttcgtaaggttttctcatctcaaccatttctctttttgatgattgaggatcgttaaaaaacaagcagaaaccttatgtgacagtttttttgactaagtttgttacctgcaaagggtaagaagagttttctggagtccg

SEQ ID NO: 174038 - DNA, 255 bp, Homo sapiens
accagcattgcctttctaatcggttgccgtgatggtttagctccctgatgcgtgaggctgctgcctggctggccacccccatgatctgactttacttgcctcggtggcgttgagggatctagttaggcctccctaatcccctctcaatgttttctcagtttgcttgttgatgcctgaaatttttcacaggcagataaaaacttttccttgcacaatcagaagcttaaaatatgtgcatcctggcagaagtaatat

SEQ ID NO: 174039 - DNA, 318 bp, Homo sapiens
aaaaaaattaaaattagctggctgtggtggtgtgcacctgtagtcttagctacccaggaggctgatgtgggcttgagcctgggaggctgaggctgcagtgagccatgatcatgccactgtactccagcctgggcaacagagtgagaccctgtctccaaaaaaaaaagttcttattccaaatgcttctagaactttatcaccattaattaattaattcattcaaccactgatcttgctgggtcaggcacagtggcaggctatgtgaatgctgaggtcagggaccgaggcttaaacacccctcaaagagaaagagaaagg

SEQ ID NO: 174040 - DNA, 460 bp, Homo sapiens
cttcatttttacataggtagtcatcatccttcatacctacatatgtactcaacctccttcatccctacatatacactgattctccttcatatctacatatatactcatcctccttcttccctacatatatactcaccctccttcatctctacatgtatactcatcttccttcatttgtatataggtactcatcttccttcatttctacacaggtactcatcctccttcatccctacatatatactgatcacccttcattcctatatacatactcatcctccttcatccctacatgtatactcatcctccttcatccctacatgtatactcatcttccttcatttctatatatattgtcatcttccttcatccctacatatatactgatcacccttcattcctatatatatactcatcctccttcatccttacatacacacttatcctccttcatccctac

SEQ ID NO: 174041 - DNA, 375 bp, Homo sapiens
acccaactaatttttgtatttttattagaaacagggtttcactatgttggccaggctgatctcgaactcctggcctcaggtgatccacccgccttggcctccaaagtgctgggattacaatttattttttattgctttcttatgctgtagatctcacatctaagaaaccgttgcctaatccaaagacatgaagtttatacctctctttccttctaagagttttacagttttagctcttacctttaggtctttaatccactttgagttaatttttgtatacaatgtgagatagcagtccagcttttttcttttgcatgtgattatccacttatctcagcacaattgttgaaaagactattccctccccattaaaat

SEQ ID NO: 174042 - DNA, 803 bp, Homo sapiens
atggaaaaagtttcaaagatgtttctttttgaaagttatggttgctgggattacaggcgtgacctaccacgcccagccaatgactacttttttaaaaatccagctatgttaactattaatagcctttcagtactatctatatacaatttttatcttaacacacaaaaaaatagaccatcaagtattattcatatcaagtagtagtagtgtagtgggttttttgaaattatatatatggctgggtgcggtggctcatgcctataatcccaggactttgggaggccaaggcaggcagatcacttgccttgctgacatgtcaaaaccccgtctctactaaaaatacaaaaattagccggttgtggtggcatgcgcctatagccccagctacttgggaggctgaggcaggagaatcgcttggacctgggagacggaggttgcagtgagctgagaccacaccattgcactccagcctgggcaacagggcgagactccatttaaaaatatatatatatatattcattttctgtgtaaaatttaaattttggtaaaatcagttcacaacacctttttttttttgagacggagtctcactctgttgcccagactggagtgcagtagcgcatcttggctcactgcaacctctgtctcctgggttcaagcaattctccggtctcagcctccccagtagctgggactacaggtgcatgccaccacgtccagctaatttttgtatatttagtagtatatttagtagagacagggtttcaacatgttagtctggctggtctcaaactcctgacctc

SEQ ID NO: 174043 - DNA, 547 bp, Homo sapiens
ggtgacagagtgagactccatctcaataaaaaataaacaaacaaacaaaaaactcccacaccgattgtggatttgtgtctttctctcctcttagctctgtcagtgtttacttaatgcattttaatgttatggtattaggtagataaaaattttaggttgttttatcttcctgtcgaagtaactcatttctctctctctcagtaatactcagccttaaagtttacttcgtttggtattagtatagttgctagagttataacagttctttcagtaggtgtttccatcatggatctttttctagccttttacggcctatatttctatgtccttatacatatcctttttcttttttttcttttttgagacagagtctcgctctgttgcccagactggagtgcagtggcacaaccttggctcactgcaacctcagcctcccaggttcaagtgattctcccgcttcggcttcctgagtagctgggactataggcgtgagttaccgcacctggccattaagtctttctcttttaaggagcttattgttggctta

SEQ ID NO: 174044 - DNA, 566 bp, Homo sapiens
aggtgctgacaatacaataagggagacaagagtaactcataagaagtagtctaccagtactgcaagacaaaataatactaagtactaaactatgtggtcctggaaataggttttggaagaatcataaggaagatcgttttcatgaaggccacatgtagtcaagaaagacacttgagttgtccgttagggggatattagacttgttttctacgtgtagtggttatcagggtcagttctgctctcccagctacaacaaacacacagaaccaaacagaacttaggaagtctggagagccgcaaagcaagcagacaccattagactctgcgtagatttgtttagagtttgtgggcattgttgaggtctctcagggtctgctgacagtcctgtgaccatctgcctggcagcaaggacttcagttgtttgcaatgctttggccaagccgagagcacgcggatctggatgcacagctgctgagcgtgtgctgacgggcctcagctcctcgagcgtgtttgttcagactggtctgcctaaatccactccaaaattcttccgagccagaaaagga

SEQ ID NO: 174045 - DNA, 181 bp, Homo sapiens
tgaaaagcgtaatgcctgggtgcagtttaaaaataaggaatcttaatctatctggtctaactttagaaaattgtttggaggggattcttaagatactctgaatttatactttcttaacaggggctgtcttttgtatatgtggtttgtgagaaaatgtgtgattgatctgtaatttgagcct

SEQ ID NO: 174046 - DNA, 396 bp, Homo sapiens
atgcagcaccaaggccaatgcgtagcacacagtaggtaatcaccccagccagaagccatctttcccgtggtgtctctagtctctgctagtcaggttacgcttgtcagcactgccctgtgatatttccatgtatagacatatttatctcctcaactagatagtaagtaagctttggggcaaagaagccatgactaatacattttgtttccccacagtatctgcctagtatcttgtacgtaattggcacctgataaaaatggttggttatgaacaatttccttgaggaaattaccttaagggtgctaaagaggaaagcctggaaattctagtacttgtgaggacttatgaataagcacgggccttacaaacctttctgaaactcagcccaaactgagg

SEQ ID NO: 174047 - DNA, 588 bp, Homo sapiens
ggtatccatggggtcctagaaccagtctcccaagggacaattgtaattggtaagaagaaaatgtagagaccacagatcggtgagcatttctgtctgtgaccttcctctggaaaagctcagtctgaagcacaaactgggtcttcatagagaggcacttccagctgcctcagagcactcgctgcaaagcttcgggctgctcagagaaaatggctcctgatgccattatgggcttctcgtcgtgccctgagatgtgctgggttctgtttcttgtgtctattcaatgaattctgacccttcaagagcttcccagatgctttccaggaagaaccctgggccctggggacgactgccttcctaaggaactttccttctagatgcctttgtagtttttcatgtttaagtgacaagtagtgagtggcgctgcttgtagaatctgaacacaaaatgtccccggattagtaggtgtcatccagttatcagtctcgtgctcacacccccgccaccgggtttcgatttgcccatctctgctttgctgctggatctgctggtccttggggcctcactctgaaccacattcttgtgtgctag

SEQ ID NO: 174048 - DNA, 436 bp, Homo sapiens
cgctcattaaggaggtgtgggtgcagcctgggaattcacatccagggactgcagggaggtaggactctgtattacagcactgtgcgcccttacacaaactggaatttccagtctcctcaagccccttctattattttccactcagacaccatgctgttgatgtttttttatcttttaaaaacattgtcctgaaacttcctcctcttttagggctctttgatttctcagttgttcacactgaaaatcaaatgcagtgactcagccgctgggaatattcctgctggagtgatggctcctcccctccccagtgctcatcttattcatcccctccaaatatggacagcaggcaaagcttcagggaggggaagcaggagcacaaaagtaaatctccaaggaaataagaaaacggaggtggccttgaaggcacctcctaaca

SEQ ID NO: 174049 - DNA, 425 bp, Homo sapiens
gatgtatgcatgcgagcgggtattacatcatgtgctgtaaagtaggctgcaatctgttatagctctcactgtgcgcccttacacaaactggaatttccagtctcctcaagccccttctattattttccactcagacaccatgctgttgatgtttttttatcttttaaaaacattgtcctgaaacttcctcctcttttagggctctttgatttctcagttgttcacactgaaaatcaaatgcagtgactcagccgctgggaatattcctgctggagtgatggctcctcccctccccagtgctcatcttattcatcccctccaaatatggacagcaggcaaagcttcagggaggggaagcaggagcacaaaagtaaatctccaaggaaataagaaaacggaggtggccttgaaggcacctcctaaca

SEQ ID NO: 174050 - DNA, 723 bp, Homo sapiens
  misc_feature (526)..(526): n is a, c, g, or t
gggcgaaggcgccggggagaattgggagccgcgcgtcttgccctaccaccctgcacagcccggccaggccgccaaaaaggccgtcaggacccgctacatcagcacggagctgggcatcaggcagaggctgctggtggcggtgctgacctctcagaccacgctgcccacgctgggctgtggccgtgaaccgcacgctggggcaccggctggagctgtgtggtgttcctgacgggcgcactggggcctgccgggccccacctggcatggcagtggtgacgctgggcgaggagctgacccattggacacctgcacctggctgctgcgccacctgctggagcagcacggcgacgactttgactggttcttcctggtgcctgacaccacctacaccgaggcgcacggctggcactgcctaactggccacctcagcctggcctccgccgcccacctgtacctgggccggccccaggacttcatcggcggagagcccacccccgtgcgtactgcacggaggctttggggtgcntgcttgtcgcgcatgctgctgcaacaactgtgcccccacctggaaggctggcgaacgacatcgtcagtgcgcgccctgacgagtggctgggtcgctgcattctcgatgccaccggggtgggctgcactggtgaccacgagggggtgcactatagccatctggagctgagccctggggagccagtgcagtagggggac

SEQ ID NO: 174051 - DNA, 284 bp, Homo sapiens
actacattgataacaattcttgctaaactgagccattcaaggaagggacaatttcaagaaatctcttgtggatgtccattctgtgattatttgactggagaagcattgtctttttaacaaaccagcagtcgtaggcttttcttggctctaggtgaagaggtgacttccctctttgattcagtgttcataattgggctgtctgttagccaaggtggtgagaaaacaatgttaatgaggtcaggggttcaatgcccacgtgggtcagttagtgtttctttgttctt

SEQ ID NO: 174052 - DNA, 499 bp, Homo sapiens
cacattagcagagagactgcaaaaagcagccagtcctgtgtttcatactgtgatgtcacatgagatgctgagctaaagcactgaaggacattctatcctatcctaagggagactggaacaaagcctaggctgtcccagctagcacccctttatctcaagattttgcattgccagcacattctacacttaattcttgagaggtacaattgagaaaggatggagaactgcgtcagtccaaggccacccagagaactgcagtatttgcaggtgggacctttggaagatgatcagatcataagggtggagcagggttagtgcccctacaaaagggaacacagagggctcacttcccttttctgccacggaaggacacatgctattttatgaacctgtcagtggatcctcactagacaatgaatcttccagtgtcttgatcttggagttctcaccctccagaactgaatacatttgagaaataaatcttttgtttataaagcta

SEQ ID NO: 174053 - DNA, 500 bp, Homo sapiens
tacaatctgttttccacaatgtaccgagaatgacctcaaaggataattggatctcatccttctcctgtgcaaagccccctgactgcttgcctccctttgtacttagaattaatcctgattccttaccttaatctctaaaatgtaggccctgcttgccttctcaacctcatctcctgccatgtttccttgggcagcttgctccagacattctgatatgtgtattccgtaaatatctagatatgttcccacctccagacctttgcactcataactgttctctgtggccagaactccctccctgtgatacttctgtatctgcatttttcttattcagatctcattttaatgttacatctttaatgacacctttcttagccaaccagtgtaaagtagcatgtacctccaaatccgtatcagtttcatcagtgcccttttgaccactttgttgttgtttttgtattggttgcatgtttatctcactaaaagacaagcttcatgta

SEQ ID NO: 174054 - DNA, 388 bp, Homo sapiens
atttttagtagagatgtggtttcaccatgtcggccagttggtctcgaactcctgacctcaggtgatctgcctgcctcggcctcccaaagggctgggaggccctacaccccgccacttgggccactacacccggcccaagtctcccttttttgaaatattctgtgtttcgtagataccttttcgttgatggtattaattatttctctgaggttttcttctgctgtcagtcctaaccttttttcttcttattctctgctttttaaactgtaattcatattggacattttcctcaaatatttgtttcttggctctgtagttattgttgatagtgagatactaaaaagctcaatagcagaggggtgtgtgtgttcacctctggcatgatggg

SEQ ID NO: 174055 - DNA, 847 bp, Homo sapiens
ggagctgttctgtggaggtggtagtcctttctaaactctgtggaggtgggagtatctgcacctcctagcagagtgttgggcgcggggcacattaaagacctgggggtcacgtgtttccgaaatgtgtctgactgcaggacatccctcgtcctccgtctttagtgggacagccgttgatgtcttgtgagacagtgtgaggggcatagtggcaaggctagaaaagtgggtgaggccagctgtgacacattcggtgtcccgtgtgtatgctgctcctgcgctgttgtgtgggaggcggcgtatgttgcagccggaagtatacagtaggctctctggatcagattgtgtgggttcaggctggtctctgcctcctgtggccttgagcacttactttctctgtgcctcaatactctcatttgtaatgtgcagatggtagtcctcatttgagggaactgcagtggcaagattaagtagcgtggttcatgtcaagagtttgatgctgcctggtccaaaaatggataaaggctgattgctgctgcgtgctgctgtgtcgtcatggttacagtggcaccacgcctgcctggctccctctgctgtaaagaccatgggtgttcaccctctgttatcacttctgattttcatgtctgaaagaggatgctgggctccctccccgggctgatgccaggcctgcccacatgctgtctccgctggtgtccccaggcactacaatggtcctagcctgtgctggtttcccctcagcccattaacacactcagggctcccatgtctaccttcttactgctgttaagttaggacagtcatcctttgaggtcacggtggaggtcacgaa

SEQ ID NO: 174056 - DNA, 479 bp, Homo sapiens
ccgcggcgctcaaggagcccgctgtcccggagcacgcgagatcccagcgctgcactccgagctcgcggcaccggttgcgggcagccggtgggacgctgccgctgagctgtcccatggttcgggagggctctgcggtgggagaggccttttctttaaaaactgggaagtttgtggtgggttcgctttttaaaaattaatctaaaaacacaaaatctatcttttaaaatagattttctttttgtcttttacgccgttgacatcctgctgggggccgattaaagaacttgattgctcaccaggaattcaggttccttaagatcttggcgcttcatctttaaaaccatacagagctgattgtttccagatcccgacccggtgacattcctccctcattgttgaccttgtcccaaacatcttttcaagaaaagcaattaaattgagattgaaaataaattacgtaaattaaatattagacgtga

SEQ ID NO: 174057 - DNA, 366 bp, Homo sapiens
atcctcccacctcagccacctaagtagccagaactataggtaaataccaccatgcccagcatccagtgggcaatttttgatattcacttctggagttcaggagagaggtcaggactgaagataggcatttgggaatggtgggcattaaaacaatagactggatgagatccgggaaccagtaaaggagaccaagaaggagggaccaccgaggtggaaggaaaagccaggagggagtgacctggaagccaaggcagagtgttccaaggagaagggactggtcatccctagcaagtgttgccactggggcaaaaatggttacatcaatcggtcgtaagctgaggcccaagatgagtgactcaccgaggg

SEQ ID NO: 174058 - DNA, 648 bp, Homo sapiens
gatccacccacctcggcctcccagagtgctgggattacaggtgtgagccaccacacccggcctcaagtatgcatttttcttttttttttcttggagacagaatctcactctgtcacccaggctggagtgcagtggtgcgatctctgctcactgcaacctccacctcttgggttgaagagatcctcctgtctcagcctccgagtagctgggattacagtcatgcgccaccatgtccagccaattttattttgtatttgtagtagagacagggtttcaccacgttggccaggctggtctcaaactcctgacctcaagtggtccgcttgcctcggcctcccaaagtgctaggtttacaggcgtgagccaccgctcctggctgagatcaagtatgtaaagcacttgataaagagccagtacctggtaggtgcacagtgaatgacagccgagtctcactctgtcatccaggctggagtgcagtggtgcagtctcagctcattgcaacttccgcctcccaggttcaagcgattctcctgcctcagcctcctgagtagctgggattacaggcgtgtgccaccatacccagctaatttttgtatttttagtagagacatggggtttcaccatgttgaccaggctggtcttgaactc

SEQ ID NO: 174059 - DNA, 240 bp, Homo sapiens
  misc_feature (13)..(13): n is a, c, g, or t
  misc_feature (28)..(28): n is a, c, g, or t
gagctcggtaccnctcgataagggccanatagctgatgggctaaaaaaaaaatctcataatgttttaagaaagtttatgaatttgtgttgggctgcattcaaagctgtcctgggccacatgcggcccacgggctgtgagttggacaagcttgttttagaacaaagctgagttgggggtgctgaaactagaatagaccattctctagtctagaaacaatcttctgggcttggcttatcgag

SEQ ID NO: 174060 - DNA, 187 bp, Homo sapiens
tgaacagtaacatcacccacccacagccatcctagccacaaacctctttgactcctacctctctccaatgtccaggaggtcacaactcatctattccacttcattctttctcaagtctgctttcttcatgacatccgaacatcttacttgatcaactgcataagcttcttccttggttctcttgcct

SEQ ID NO: 174061 - DNA, 1100 bp, Homo sapiens
ctcacatcatccatactcatattacctctgaataatgccgttaagcctgaaaacaaagatatatctcataatatctctcatggatagaaaattcctcttagccgagcaagatggctcacatctgtaatcccagcaccttgggaggcaggggtgggtgaattgcttgagctcaggagtttgaggccagcctgggcaacaaggcaagaccctgtctctaccaaaaaggcaaaaaaaatccgggagtagtggcatgcatctgtggtctcagccactcaggaggctgaggcgggagggtcatttgaccctgggttgtaggttgtggtgagccgagatcatgccactgcactctagcctgggtgacagaacaagagaccctgtctcaaaaaatatatatatttcaggaaagataagatgtcccattttaaagaaggagatctgttaagcggatttgtacatgtgtggcagtagtggcagagagtctgccataatctcttcactctcttcattctggccagctttgagtatactggcttgcagatgccagttggggccagagggactgaggtgaggacaggaacagagcaaattacctgacccaccagggacctgtacttgagacttgatcccagagctgtgttcagcctaatcacttttttaaagtgaatgtttagggcctgcctgcagagaataacatctctcagtttagacagaggtggtgagcatgtagaatgtaggagctactgagagattgatggagctttatttttcttatcaaaggagcactcactggctatatccacagccgaggggccttcctgtgcatcaaagaggaaggcattgctgctgcgaagctggtgggagtcatggcggctggaatgggtcaaatactgtttgaagtccctccaggactttatccatttcttcctccttgatgtccctcctgagcctggtggagtaggcaagacaagggatgaaaccaaggcagcctggaaccacatagctagttctgatctgaagctcatggaagaggcacctaaaccaaagggaccatcacatcaaagaggacatatacaatccactttgaccggaagtatgtagtc

SEQ ID NO: 174062 - DNA, 2241 bp, Homo sapiens
ggcaacaggaggcattgatcgcgctgcatatgtttagggcagcttttgttttttgtttctttaatggtatagcagcagtgactgagccttcgtgattcctggggacagcttttcagatactctgtttcatcagtatgctttgcacatccggaaggagtacaaaaatccaactgcccaaatttggggcttggaaaataggttttataggtggtcggtccctgggctgtgcaacaactcctcaaagaggggtttatataactagaacccccctgggctgtatttttggtcaaaggagtctccaaggcggcttacaaaagcttcctttttcacttgaccacccttgctcattggttacttgtgaagggaattggtcagtttccacctcagcactttgccttatcaacatgcggtcgccatctagtggccaaaggttgtctccaccagctacccagatggaaggcaaataaatcctttcggccaccctgctgtccatcgtgaactttgggaatgaaatataatggcctgaacgaactgcctttgtgttcagagatcagtgcaacactagggtcagaagactccagaagcagccacttagtagactctcacgcagaactgagaaatgcactagctgtcctgtgggcagaagagacaggagtggaccaggagaggtccaggtgcccgggaagggtttactgtaactgcaatactggcagcccagctgctgaccttgttaagtaaacctttgctgggtggtccgaattctgccctcaaggcaagataagaagttgggtgtaaggattttgtggggggcctggccatgatctttgatatgatccccgaatagccaaatagttttttttgttcaattttttgtttctgtattttgtatttttaaaatcttgtcaaatgtttttgtgttaggaataaaaagtcataaactattcccaactttgtttcttgagggatgttctgattccaatggaaacaggtgggaaatctcaaggggagcgtggacaaggtggtatgtgcagcaggggaatagactgcttggatttccaaatggtttctggggaagatgaccatccagaagtccagcttagtgcagtctgctctggaattcacacccaccccctcgcctccttgtgccatgttgttagcattggcttggagcatctgcttcttccagaggcagctgctaatgttgaaaccaacacgagccctctccccaaccccaggtttctaaagaaggtgtctgtagccagccttaatcaactgggcaaggtggtccctatggtcctttccagcatttccaaatcttggactcaaattattttctcttggtgtgaccacacagcctagagaattctgagcaataggagccagggctttccctgactctgcgacagggtcaaaccaaggaatggctaaacctgtgaggttttgtcatccccgggggtactactgtagggggcattatttattaggaagcttaacaaggtaactacggcctgagtgcgtgagtgtaaggctgtgtttgtggtgggggtgtgtgtgtgtgtatctgtgcacacatacacacgtctgtgcctgtgtgtgtgtgtttgtgtgtgtgtgtgtgtgtggaattacattgatgcatttattgagaaaggtgcaagaatttcacctacacagagggacacatctgctttgttatttataatagaaagctaaattttaattttttaaaggacactgctaatgattgagaatcaagtttttagttttgctattttttttaattggtagaggatttttatatattttttccattttgttgggttgtgtccttatttatataaatactttatccgtaagaggcaaggaggaaaccttctttgcttttacatattgtggttgtcatcgtccctattttatttctggtgtgatttctctgtcttaccttctaaatgagaaaatgttttcttgtatttgtacattgtcagattctatagtttcctagataatttaaccaaattgctctatgtattattattctgtgagtataaagttctattttaatgtctgtaaatacttcagaactggcttcttttctcaaactcccactgtggggttattgtttacatcacagaaactgtagaatctctatgctcatgtactgtaaatagtgaagtgatctgcttataaataaacttaacaaatacactatggagattaaaaacaaaataccacccacagctt

SEQ ID NO: 174063 - DNA, 2186 bp, Homo sapiens
ggcaacaggaggcattgatcgcgctgcatatgtttagggcagcttttgttttttgtttctttaatggtatagcagcagtgactgagccttcgtgattcctggggacagcttttcagatactctgtttcatcagtatgctttgcacatccggaaggagtacaaaaatccaactgcccaaatttggggcttggaaaataggttttataggtggtcggtccctgggctgtgcaacaactcctcaaagaggggtttatataactagaacccccctgggctgtatttttggtcaaaggagtctccaaggcggcttacaaaagcttcctttttcacttgaccacccttgctcattggttacttgtgaagggaattggtcagtttccacctcagcactttgccttatcaacatgcggtcgccatctagtggccaaaggttgtctccaccagctacccagatggaaggcaaataaatcctttcggccaccctgctgtccatcgtgaactttgggaatgaaatataatggcctgaacgaactgcctttgtgttcagagatcagtgcaacactagggtcagaagactccagaagcagccacttagtagactctcacgcagaactgagaaatgcactagctgtcctgtgggcagaagagacaggagtggaccaggagaggtccaggtgcccgggaagggtttactgtaactgcaatactggcagcccagctgctgaccttgttaagtaaacctttgctgggtggtccgaattctgccctcaaggcaagataagaagttgggtgtaaggattttgtggggggcctggccatgatctttgatatgatccccgaatagccaaatagttttttttgttcaattttttgtttctgtattttgtatttttaaaatcttgtcaaatgtttttgtgttaggaataaaaagtcataaactattcccaactttgtttcttgagggatgttctgattccaatggaaacaggtgggaaatctcaaggggagcgtggacaaggtggtatgtgcagcaggggaatagactgcttggatttccaaatggtttctggggaagatgaccatccagaagtccagcttagtgcagtctgctctggaattcacacccaccccctcgcctccttgtgccatgttgttagcattggcttggagcatctgcttcttccagaggcagctgctaatgttgaaaccaacacgagccctctccccaaccccaggtttctaaagaaggtgtctgtagccagccttaatcaactgggcaaggtggtccctatggtcctttccagcatttccaaatcttggactcaaattattttctcttggtgtgaccacacagcctagagaattctgagcaataggagccagggctttccctgactctgcgacagggtcaaaccaaggaatggctaaacctgtgaggttttgtcatccccgggggtactactgtagggggcattatttattaggaagcttaacaaggtaactacggcctgagtgcgtgagtgtaaggctgtgtttgtggtgggggtgtgtgtgtgtgtatctgtgcacacatacacacgtctgtgcctgtgtgtgtgtgtttgtgtgtgtgtgtgtgtgtggaattacattgatgcatttattgagaaaggtgcaagaatttcacctacacagagggacacatctgctttgttatttataatagaaattttgctattttttttaattggtagaggatttttatatattttttccattttgttgggttgtgtccttatttatataaatactttatccgtaagaggcaaggaggaaaccttctttgcttttacatattgtggttgtcatcgtccctattttatttctggtgtgatttctctgtcttaccttctaaatgagaaaatgttttcttgtatttgtacattgtcagattctatagtttcctagataatttaaccaaattgctctatgtattattattctgtgagtataaagttctattttaatgtctgtaaatacttcagaactggcttcttttctcaaactcccactgtggggttattgtttacatcacagaaactgtagaatctctatgctcatgtactgtaaatagtgaagtgatctgcttataaataaacttaacaaatacactatggagattaaaaacaaaataccacccacagctt

SEQ ID NO: 174064 - DNA, 259 bp, Homo sapiens
cgtatgcaaaccaagaaacactgaagactgccaggagaccacaggaaggtaggaagaggcaaggcaggactccccgacaagcgcaggagggagcgtggccctgctggcacttccatttcagactgctggccaccagagccacaagacaatcagtttctctggtttcaagtcacgcagcttttggtacttggttgtggcagccctagggaatgaacataagtactttcttttttttttctttttttgagacggagtctcg

SEQ ID NO: 174065 - DNA, 1083 bp, Homo sapiens
ctaacagttttggtccagaattctgactaggcttggaaatcactgacttgagttttaagttaatattaatacaaagcatttactgacagaccaccttaataaagataatgaaccccaaagaagctcacaagtagatgttattaaatgacaacacatcatggcatagttggtttttcttttcttttttttttttttggaggtggagtcctgagcttgtcgctcaggctggagtgcagtggcgcgatcttggctcactgtaacctccacctcccgggttcaagcaattctcctgcctcagcctccagagtagttgggattacaggcacccgccaccatgccgggctaatttttgtactttaagtaaagacggatttcgccatgttggccaggctggtctcgaactctgacttcaggtgatccgcccgcctcagtctcccaaagtgctgggattacaggcatgagccaccatgtcccgcctggtttgttttttaaaaaatctctggccttggagtctgaagccccaaggattttatcactaactccctgagtgaattttggcaaatcagatgacccataggtttaattttgccacctatgaaatgaaggcactgggctagattagtggctttcaagagtttttggactatgagccaaagtaacaaatacagtttacactggggtatctatatatgcaaaatacacaaaagcttcatgaaacaacactttttttaaagctagaatgaacctattaggtaaaataaacatatttttactattctatttcatcattaaaaaaatgttaatggcaacacttggcccactactagtagtttaaataacactagatctctaagcttcattaatttgactctaattgtattcaatgaacttaagttatttaatattttgcaaacatcagccactaggtgctcaattttctttgtcctgtgtattcataaatggcaactatttattgctgacttatacttacttttcagcttgaaaaccagtgctaagtacacttggatcacccaactagttggctttacgttactgtgaaaatcacatgaagtaacttatgtg

SEQ ID NO: 174066 - DNA, 296 bp, Homo sapiens
ctaacagttttggtccagaattctgactaggcttggaaatcactgacttgagttttaagttaatattaatacaaagcatttactgacagaccaccttaataaagataatgaaccccaaagaagctcacaagtagatgttattaaatgacaacacatcatggcatagttggtttttcttttcttttttttttttttggaggtggagtcctgagcttgtcgctcaggctggagtgcagtggcgcgatcttggctcactgtaacctccacctcctaatgataacggtaccgagctgatt

SEQ ID NO: 174067 - DNA, 519 bp, Homo sapiens
tgtaaaagtaaccaggcagctaaagagcctacttccttgctaaacaatgacccttgcatatgttcctcttattgcaaccttcaggaggccccctaaactttataagggccctctccttaatttgagccttttcaacgtgtttctccttcccttaaactttttattgaaatctacattacagaaaagggcataaatcctaagtgtatagtttgatgaattttcataaagtaaacatgcccatgcaacctattcctagataaggagttgagagcattatcagctcatctggtcaccacccggtgagctagcatcctaagtttagcttgtttttgacctttacgtgaatggaatcacttgtacaagttttaaagtaactgtttagaatgtttattgggaattagattacaaagtaatacacagcttggcgcagtggctcacgcctgtaatcctagcactttgggaggctgaggcggatggatcactgaggtcaggagttcgagaccagcctggccaacatgg

SEQ ID NO: 174068 - DNA, 677 bp, Homo sapiens
gccttccgcatcgaagtatctgtgaggatacaacaccacaagattgagaaagtacactgcaactgtaaagcatgacacaaatataagttattattttcttttaagtaagacctcttatcatgtcacttctcagccctgcttcataatcagttattgttttaaatttcaactcctctgcctacctttcgaggcctaagtgatctgacccatctgcccaatttatctgtcaccttttgctcaagaggtttcctcacagtgtcacaaacacatcaagttcacttttctttctctgcctttacttacttctcgaaggtgtccatctttcttgctttcctatctaaatactattccatcctttatgagatctagttcaagttgtcacattcctttttaaattgcccttgaccactccaggactcaatgattctcctttgaccttcctgttgcccatttaatgcctagagattgattggtaattgtttccatattcatttatctcatgctctggtggtagtgcattaattttcccacatttcatgattcacattcacatgtgcataattcttgttcttgctgcctcatgctttatttgacagctatatcacatttaaagaagtgaccaaaattaaatcagggtatctgccaaagacaataattttttttttttttttttttgg

SEQ ID NO: 174069 - DNA, 576 bp, Homo sapiens
cactcggacacacacacatttgtcggcccgcggttcgctgcgcactctccgcattgccccctcgaaactcccctggcagagtctgtctagaaactaaatctggctggttcggcagtgaatgtgcgaaggttggctggggggagggcaggggctgaggaggtgcgacctcaccgcaaggcccaagttacttccaaacagcgaattacccatttaaagagagaagagagaaaagagaggcgagagaggagaaggggcctcgataccagacagggattagaaagtcaaacagggccgtgggatctccagacttgaagttttttgttgttgttttttttaactttttggggggaagaggggttatttgcttccaggaaacatcttaatttcaattctaaccttattttctaagaaacttaaaatgggaaagaccagaaaaatggaaataggaatcgaagcttggaggacagataagaaaaattgtttagaaaataaaaacttatgttgcaggaagaaacgttaacttttcgtaaaagtgaactctcagtgaccctcggagtgtgtgattcggctttaaca

SEQ ID NO: 174070 - DNA, 298 bp, Homo sapiens
tttttgcagccctcaccagataccaaacctgccagtgccttgatcttggatgcctcagcctctagtactaagagaaaataaatttctgttctttataaattacccagtctcaggaatgttgttatagcagcacaaacaaaataagacagtttatttttgggcattgggctgaggatttagtgagacctattttttcctgagggctcttttttacttcctgatttttttttttccatttttattatgagacaaggtcttgctctgttgcctgggatgtagtatagtggtgtgatcttgg

SEQ ID NO: 174071 - DNA, 270 bp, Homo sapiens
tgagagaaatagatggtattaggagcaactggaaacctccagtttttcttgcatgcctgtccattcatattctggttaatctattctttgatatttaacataatggaaccaaaaagtaggagagaaaaaagcctgcagattttaggtatttcagaaatcatacatgatatctgaggtttattcaagaaccagtgtttcagaaaaagcgagaaagagaaaaagcactttgtaaaatgcatttaggaagtttctctttaacagtcatgctct

SEQ ID NO: 174072 - DNA, 439 bp, Homo sapiens
ctcaggtcaaggtgtcagtcatggggtggctgaagggtgtccccaggtcaaggtggcagtcatggggtggctgaagggtgtccccatgtctgtttgggctcacagtgcacctctagggtttttgtttgaatgtcagggccatgagagaagcagcgatgacacgatgtctggttaccttctccaggtgggaggaaaaaggccgctatgaaggtgtcctgggccatttcctgagggttgctcctcttctggactgtgttggaggcacactcgtgctgcacaagctgcctctagcctagggccttgaagtggcgtggggtgtccaggtcattgctctgccgtaagggctgtccgagtcacgacggtattccagaccggacagcgcacggtgtgcgataagtcaattgatgcggatgtgtgtaattacaagactaatactgat

SEQ ID NO: 174073 - DNA, 471 bp, Homo sapiens
ctcaggtcaaggtgtcagtcatggggtggctgaagggtgtccccaggtcaaggtggcagtcatggggtggctgaagggtgtccccatgtctgtttgggctcacagtgcacctctagggtttttgtttgaatgtcagggccatgagagaagcagcgatgacacgatgtctggttaccttctccaggtgggaggaaaaaggccgctatgaaggtgtcctgggccatttcctgagggttgctcctcttctggactgtgttggaggcacactcgtgctgcacaagctgcctctagcctagggccttgaagtggcgtggggtgtccaggtcattgctctgccctagctccagcccgcacctccagggtatcccaaaccctacttgccctgaaatgcctaagacgcttgatccagagggtgtgggaaacaatatgatgatgatgataataatagtgaatattcaccaagggcttact

SEQ ID NO: 174074 - DNA, 231 bp, Homo sapiens
ctgttaggcaagtggagatattgggagataagctgcttactcagacagtttgggcatgatgaagaaatcataataaactggaaaattaagattaaaatatgggcataattagtagtttttaatgtgccaaatactgtattgctgaacacataattaacggggtcagaaactcccagtgattgtcagcaactccagctcatagtagctcaacattctattcagaaacatcta

SEQ ID NO: 174075 - DNA, 206 bp, Homo sapiens
gccataattcagacacatacaacccagccagcgtaaccaccccctactcaccccctgaaaatagaagaagaaaggatttagagtctgggcagattgcttttaaaacatttccaaccttcaatctaatttgtcattattatttgtagagctttctttctcttccttcgtatctcctttcatatccggagcattcccagggaagatcc

SEQ ID NO: 174076 - DNA, 469 bp, Homo sapiens
cttcccatccttgatagagacacataaaaaccagctcaagcatgcagagaaaacaggtaacttcttcaatgagcagatttgtataattattacttaccgtttagtgtaaaaatattaaaatctcactgcaggtttctcagtacagaattaaaatacttacactagaattactcagggtgactgtttaaaacaatgtaaattgtgagctagttccatcacagacctactgaatcagatcttctggtgggagtaagataatgtgaatttttaatacgctccgcagtgattcacatacacagtaaactttgacaagactgtacagaatgggagtctctgagagcagggagtatgtatgtcctattgtctcagcactcatagaatctagcacggggattgggagagtgagagctcaataaaagttattgaactaaactgaatacacctaatatacctaagagtctttaaagca

SEQ ID NO: 174077 - DNA, 212 bp, Homo sapiens
gtcagcaggagtagaaggtacagtttgaggaataaccagaaagtttgaagactccctaacatagtcttgtgcctttgtagagtattccttttagcataaatgtagaggtgggcctctgttggcatttgccactgttgagaactatccttatgttcaggcatctcctggcagggattgtgtgaaaaattactttagacactcaaaggataggg

SEQ ID NO: 174078 - DNA, 549 bp, Homo sapiens
tctgtcttggatattatattcactcggtcactttgaaaatataacgtcacctcattgattctgtttttccacatatttaagataaagggttaagatgagattctgaaaattcccgttgaattttattatggaattcttagtatgacagagactgctcaagaatttgctagattccatgtaatggatgaatagattttgttctactgatagcattagtgatcttatcataaccctgacatgaacatattttttgcttccacatttttggatcagagatcacattgagtgatcacattaaccaatcactcaatttatccatgcctatatcattgactacttccacagaaaaccatctgactacatgacaagttacatagacaatatatggtgtaaaaagaagtctctatactaaaaaatactgaacaagactggtagcatttgttttaaagtttgctaaaagctcaattgacaaaacaaaatccatcatctctgatcatctatcagagacatcctttatgtccacaattttattaccccaaattctctatt

SEQ ID NO: 174079 - DNA, 514 bp, Homo sapiens
gcttgacaaggtcttgctcgacaaggtcttgctctgttgcccaggctagagtgtagtggcatgatcatggcttgttacagctcactcctgacctgaagcagtcctcctaccttagcctccccagtagccaagagtataagcgcataccaccatgcccgactatattttttaaaaatttcttgtagagacaggatcttgccttgttgcccaggtcttagactcctgggctcaagtgatcctcccaccttggccacccaaagtgctgggattacaggtgtgagccaccacacccaacctaaaagataatttgaaggttgcaagatagacacatgatttcttccccttcctcctttattctctttttttctttggattcttttagatcatcagagggctttgttttctttgctttcagaagaattgcagttactaagtttctctctattatccacttggttaaaattgggggttgtaattaagaattgccatttaaaacctgctaatgcatttactg

SEQ ID NO: 174080 - DNA, 237 bp, Homo sapiens
tcctagccaaggccattgggtttgggggactcagcgcacagctgactactgcaggactactactgtggttatgaccatagtaagtttcaagcgcaaagttactagagggataattctgggggtggggttagggagggaagagtagccagggtggtatcctagttacacacagctcattcctgctttattttggggttgtgtgaaattttctattgctatctttgttgacattatgcc

SEQ ID NO: 174081 - DNA, 359 bp, Homo sapiens
agctaggggtggtcctgtcatgccaccgattccaattaactgatcgcccataactcagagttgcggggggtagcggaggggagagcccagggagggagccgggtccccttgttgtacttgataacaattatagtttaaaatcatagcttgccagggctcagctatattttacttgataacaataaaagtgacacataaagttaactgtttatgttttatttattagactaaatctgccagcggtggtaggagcgcttgcctcgtcgctacagcttttatagggctgtaaaacgtcataaatcagtctcgcggaatcgcccgcactctttgtgtcggcggcggcgcagggctggcggccg

SEQ ID NO: 174082 - DNA, 372 bp, Homo sapiens
cttgaacagacacattccttttagccaaacaggtgggtgaaaaagaaatcagcttgggagagcaggtctatcaggtttctctggctctcctcttgtaggtggaaattcatctgggcctgtttacattctgaaaaaggtcaagttctgaaatacttttggaagcagcccaaaagaaggctgctataccccccacagggttgggacacacattaagaagacctgaggtgaaccagttatgccatttaagaattttatgcatcaagaaaggtgtaattgtttcagtgagattaaaataacaacttctcatatttagataatgcgttacagcttgcacactgttttcttacacactaaagttgtgctgataacgtc

SEQ ID NO: 174083 - DNA, 522 bp, Homo sapiens
tctttcttctaaaaaactattttcataatatcgaatagagcagaagatatttccaattgttaagctgtattaaaacttacaactgaggggcaataaaagtgatacatttatgccaaatcctgtatttaaatcaagtctacttttgaacctccaaatttagaatgagagtaaatacatctacttcttattgataagaaacctaattgtcaaagtaattagtgctaaacctactgctttattctcattttcagcatcatcattcagttaccgtaaagaaatctaattcatttaaggctcaataatctcttatctctcatttgtgctatggaatttggttttatgaatcagaggagagaaaggaagtcccctgcctccagtgcactgattaacatataggttaacatattaagttccggtatcaggaatcaaatatagagaaatgattatgctaaaatggagtttccaataactgccagtaaagcagactggcagagctctgccctatcgcttttggacatttgt

SEQ ID NO: 174084 - DNA, 429 bp, Homo sapiens
cactcaccgcatttcacacaaacgtattctggctcttcaaaaaccccaagagaagttttgtcaacagccataaaagtcatcaacttttatctagtctctgaatcacagcatttttgcaggttttgtcaagaaatgatggcagaaaatgaagtgcttctctaccacagagaagcttactgtctttcaaggggaaagattcactgttttctaaaagaaaaagaaaatcctctcctggaacatgtagcaagaaaaaatgttgtctgagggttggctgacccagcggatatttttaaccatctgaacgagatgaaccttccagttcgaggccctgataccaccattatgaatgatcctgaaaactttaccagcttttttggctcagctgccaatatgaaaggagagttcaggctgacatctttgccaactttt

SEQ ID NO: 174085 - DNA, 188 bp, Homo sapiens
agattagggcagttacagtggggctacacagaaagaaacgaatacattagctatgacaaagagaaggtgacaaaattagtgccttggtggatgtaggagataaagaaatgaagtttaaagtgaaaggaagtgtcactcaaagaaaaacagatggcatggtttatcacaaaagttatcaagctgaacac

SEQ ID NO: 174086 - DNA, 418 bp, Homo sapiens
ctccagagtgagcccagtgcatcctacagtcctataaggccaccattgccctcactacctcacccctgctcgcaggctagcagcccccgtgtgagctgggagggagtggccagagcactgggagtccagccatcccctctctcttgtgccaacaaaagatgcagggaagagaccggatctccaatggtggggacaggagccggcaccctcaggacagctcaggaaaatttcagtcccaggtagaataaatctcctgtcaggccagacacggtggctcccgcctataatcccagcactttgggaggctgaggcagatggatcacctgaggtcaggagttcgagaccaacctgggcaatgcggcgaaacccaatctccactaaaaatacaaaaattagctgggcgtggtggcacgcacct

SEQ ID NO: 174087 - DNA, 302 bp, Homo sapiens
aatgaaggtaaaataatgtcattttcagacaaaaagagattttgacacctatggaaccctactaaaagaaattctacaagatacacccaagcagaagaaaaacacactctaatagaaagtctaaaatgcaaaaagaaaggaaaggcttaggaagtgttaaatatttgggtaaatttaagcaaacattgtgctaaacaatagtattaatgtcttgagggattaaaacgataaaacacgtatcagtagcatataaattggaacataagtaaatgaaaggaatccattctaagtacttgtaatgt

SEQ ID NO: 174088 - DNA, 499 bp, Homo sapiens
gctacatgatcatctcaattgatgcagaaaaagtacttggcaaaattcaggaccgtttcatgataaaaacactaaacacacttggaatagaaggaaattacctcaacatactaaagaccacatatgataagccaacagctaatatcatattcagtggtataaaaaagctttttgtctaagactaggaatagggcaaggatgtctactctgaccacctctattcaacataagaccagaagtcctatccaggcgagaaagagaaataaaagacatccaaataggaaaagagtgattatctatgttaaccaatgacatgacctagtacgtaggaaacactaaagattctaccaaaaaaagctgctcaactaataaattcagcacagttgcaggatacacattcaacacacaaaaaaatcagttggcatttctccgcactaacaatgagcaatcaaaaaaggaagttaagaaaattctatttacaatagaatcaaaaagaata

SEQ ID NO: 174089 - DNA, 568 bp, Homo sapiens
cttttccctgagtggtggtggcctgcaggttaaacaggtgggcttgggaattgggctgcctagggtaaatcctcattcccccatttaactcagtctgccagactctgttttcttgtctgtaaaatgagggttaaaagagagtctctgtaaagcatttaatacgttgttgggcactagcggtggattaaggagaagagggctgtgatgggagctgtcagccccagcaggcaggagttagaattgtctggaattgccggtgtagggtgataataaaaagcaaactgactcttggtcggtttattactatttttaaattccctactgacaaggccctccctattgcctgcactctgagtggaccactccttccatccatgccttgcaatgccactgtcttgcacataagggctcaaaagtgtatgctgttgttgcccttctcacatttcggctgaggtgtatattttcattaaagaggattatgtagaaaaattggtttaataaaaatgatgagactttttaatatggtttgtacaccattaagagtgaaatatggcaaaatctggtctga

SEQ ID NO: 174090 - DNA, 902 bp, Homo sapiens
ggtagcttttctgactcttaaagagatctcaagtataccttcagagaaatgccagcaaaaactgtagtcatttgggaaggaataagcctggaagaaaaagatacaacgaactagcacaacgaggagtttgaaaagttcatgacagctcacagctgatgatggtggcaatcttaaggatacagaaagctcattcctcatgcagggaagaagaaaatattctaaagaagagataagcatattccatgaaatcaaaaaagcgtaaaacgctggaggagaagtcagtagcaagcagctaagacaacatggtacatgtgggtccaatgtgaaaaacactaagtgggatggttaattgtatgtgttcccttggctggaccatgatgacagatatttggtcaaacattattctggatgtttctgtaaaggagtttttgggctagaagcccaccaactgctaacaaccagctggagggtaagtcaaaagctatgagagcccagaaggagaacaattatttagacctggaggggccagttgggaaagtctttgaagggtcttcagaaaatggaccaaaagaaaagaggaaaagtcattctactgagaggtgtttgtgtaatcaaagcaaccgaggcctaagaactcacaaaagattagaaaagggtaaaggatgcctggaaagccggactaggaaaaggctgtgaagggccctgaaggtcacatgtcacatgttgcctgcagcatgcagaatcaaaacatgataaatcatgtcttgaatcatgacatatgaagcatgacacacgaatcatgacatgtgacatgttgaatgtcacatgtcacatgccgtaggcagccatcaagagtatttgaaaggaaagtgtataatcaggcctgtgctttagtaagacaa

SEQ ID NO: 174091 - DNA, 567 bp, Homo sapiens
ggtagcttttctgactcttaaagagatctcaagtataccttcagagaaatgccagcaaaaactgtagtcatttgggaaggaataagcctggaagaaaaagatacaacgaactagcacaacgaggagtttgaaaagttcatgacagctcacagctgatgatggtggcaatcttaaggatacagaaagctcattcctcatgcagggaagaagaaaatattctaaagaagagataagcatattccatgaaatcaaaaaagcgtaaaacgctggaggagaagtcagtagcaagcagctaagacaacatggtacatgtggctagaagcccaccaactgctaacaaccagctggagggcctccccggaagctgagcagatgccagcaccataattccagtacagcctatcaaactgcctaggtgctctctgatggtgggaatccactaataagaggtgtccagttcttctagcaaacttgtcagtgctcatgtcttccatgggttgtgccctgaatcaatgcatttattaattctttcaaaatgcaaaataaaaattatgtgttgagcctcta

SEQ ID NO: 174092 - DNA, 233 bp, Homo sapiens
atgacagagttaagcttcctagggtcctagagtcaaagaaactctgctgacccccactgctaagcaggtgcactccttccacagggggcaacatctgccgatccgtcatggtcccactcggtgaggaccccaagaaacttccttgggaagaaacaattttctcaggactggcagccagtttgggggatgtggagaagttatatccatatagtgcacaggggctgtgtaatcta

SEQ ID NO: 174093 - DNA, 534 bp, Homo sapiens
ctctgtcagggcactgttgatctcttcttttctaatggaatgctctttccatagctctctgcacagctggatacttctcttcttcaagtcttcaagtcttagagcaacaattcatcttgaaaaataggcctgccttgatcaccctatttaaagtgataatcccaccccccagctgctgtcactatacattaactattttcatcacaccactacctgaaagtactttatttatttgtttgttcactatctacatttccatatgaaaacataagttccatatgagtaagaaccttttatatctggattattgctgagttcccaacacacagcacataacaggtactcaataaaatgtggatgaatgaataatatttcactaaatgcttttagtttcatgtatcttgaaatatctaaaatagccaagttcaataattccacaaacataataagtaacttcacatccaagggactgtgattgacacaaataaataaacagcttctatcttcatgcaagttcatgatagtaggaaagcc

SEQ ID NO: 174094 - DNA, 339 bp, Homo sapiens
aggaagtgcttattggaacattttggatttcagaatttcatatttgggattctcaatggtataattcaggtgttccaaattaaaaaaaaatccaaaatctaaaaaactcctggtcccaagcatttctgttaagagatactcaatctgtatgtatgtacatgtatgtgtacacacacacacacacacacacacatacacctcctttgtgtgtactgtactttttttttttgctcctctctcccttctctggaagcatatagaatcttctctgtttcaccagtttggaaatttagtaataactgctttggtgtgggtctgtctccttttactgaagtggga

SEQ ID NO: 174095 - DNA, 434 bp, Homo sapiens
ctgtccaataggacttcctatgatagaaatgtccttcattgtattagacaatagccaccagccacaattgcttcttgagcactgggaatgtggctagtatgactgtggtactgaatttttaatcctatttaattttaactaaactcaaaaggccacatgtggccagtggctaccatattgggcagaatggttctgcacagagatacaaatgataaacaagtggatagacacttgctcctcttttaaccacaaaacatcgaagtatgatgtcagctgttgaagagtgctgtgcagaaagccacgcagggtgaggaaatagagagtgctaaggaggcattgttttgcagaggggcagctgtcagcaaaagcctctctgtgggaggctgacttttcaatggagacctaaaaaccaggcggttctcggggtgggatgt

SEQ ID NO: 174096 - DNA, 192 bp, Homo sapiens
catttagaagacacagagatgaaacacagagatcagtcaaagctcgtacatgtcgagttagataccgtgtttaggtcagaatctttcgttgctactcatttattagtatgaaatcatgtattttttactatttgggtaagagtaaaaaattgtcctgcaatcataaaagaaattttttaacagtcatattag

SEQ ID NO: 174097 - DNA, 320 bp, Homo sapiens
gacaccagctcagctacagcaggatggggtaccggtcagagtcatgagacacccccttttctaggccctagctcctggacatttctagacacactctgagccagaagggaactcactgccttgaagggaagaacccaatcatggaaggattcatcacctgctaactgaagagcccttgggccctgaataagcagcagcaatatccaggtagtacatcatgggccttgagtgagactctgatattgctagcttcaggtaccacctcagccagaggtgggtagagcactaagggtgagtcccaggccaggcagcatgcacca

SEQ ID NO: 174098 - DNA, 278 bp, Homo sapiens
attttgatgtattcatttctcttttgtgtatcctctagtcctagactagaaagcatgctttctgagctaatggttgaacgcatattttatgattgccttgtattgctgtgttgaactcctggttacctaaatgttatttccagatgttaatttttggacagtccagtttcacagatgctctttgctagtgagatggagactttcccagcatctctagttcttctctgcccacttaattttgccaaaacttttaatttacaaacctcaggccaataatt

SEQ ID NO: 174099 - DNA, 429 bp, Homo sapiens
aagccatgcttcctgtacagcctgtggaactatggtctgagagtacctgtgctgaaatggaattgtctttgagtggacacttcttagatgagacctattgtggccaatagctcctgaggaactgaagccttcagttcaaaacttgtgtgagaaaaatgaatcttgccaactactggagtgagcttagaaatgaatccatccccagttgacccttgaatgtagccttgtcagagacccagagacaaagcatcctgctaatctgcactgggttctaggcccacagaaaccatgggataataactttgtgttgctataagccactgaaaacaaacaaataaaatacttaagatgttcccctgtggaagggttccattgccagggatctgcacttcacaaccaaagggattaaagagaattgccttcttcaga

SEQ ID NO: 174100 - DNA, 550 bp, Homo sapiens
tctagttctctgtcttgagtgaaaaatgatgaggaggtctggagactcaaacaaataaactaattgcttccaattcatatagtcattagaaaaatagatgaagcagtcatggtccctaccatgcaagaacttttagtctagactagcaactggataagtggtttaattatgcatcaaaaggttgggtacaataaatagatgtgtgcaaaaatatgggctttatttgggccgttttctttatatttttgtgacttgtgatgtctacacctgaacatatattaataaacaaaaaagttattatttgtattttttatgccctgctaagaatacttatttatcatctaaaaaattattctagaaaaccttaagggatttgtttaaattgcttattagtatgtgatataaaattgaaagggcagtggggctaaaaaagattaaaattacacaaactctgagatttaagtttctgttttcgtttttgttttttagctaagtttaaaaaaagaaacggaactaaaaatactccccagtggctaagaacagaatttta

SEQ ID NO: 174101 - DNA, 337 bp, Homo sapiens
cctctccacctgccgtcacctccttgggtccctcaaggttctccttgtggctgatagtcatggtgattgcttgacctcgggccttgcagctggctggcttccaggaagctcctctgatgacaaggtgtgctgaagtctgtgttcacgggcacggcattcaggcgcagagcgtgggatgcgggagaaaaacctgctgccgttgctaatggccccagtgttcttccctcgcaggcagaaattatgcaggcttctgtctcgcggcttctccctttacccagcgccttgtatgtactgggagaccagactgtgaccacctccagggtgacaggaagcagca

SEQ ID NO: 174102 - DNA, 475 bp, Homo sapiens
tttgtttattttacagctcaagtgcagtggcgtgatctcggctcactgcaacctctccctcccaggttcaagcaatcctcctgtctcagcccccctagtagctgggattataggcacgtgctaccatgacagactaatctttgtatttttagcctcccaaagtgctgggattacaggtgccagccattgcacccagcctccgcactcttgaagaaccagaaagccaatggtcctcccttctcaagaaaacaagagttggccaggtgcaatggctgacatctgtaattccagtattttgggaggccaaggtgagaggatcacttaagctcaggagttcgagaccagccaggtcaacatagcaagactccatctttacaaagaaaaaaaaagaggctgggcgcggtggctcagacctgtaatcccagcactttgggaggccaaggtgggtggatcacaaggtcaggagatcgagacc

SEQ ID NO: 174103 - DNA, 305 bp, Homo sapiens
acggctaggtacgaggctgggtggtgcttagctcaggagttcgaaccagaaagccaatggtcctcccttctcaagaaaacaagagttggccaggtgcaatggctgacatctgtaattccagtattttgggaggccaaggtgagaggatcacttaagctcaggagttcgagaccagccaggtcaacatagcaagactccatctttacaaagaaaaaaaaagaggctgggcgcggtggctcagacctgtaatcccagcactttgggaggccaaggtgggtggatcacaaggtcaggagatcgagacc

SEQ ID NO: 174104 - DNA, 400 bp, Homo sapiens
cctgccctctgcaggatgctctaccattattcactccacttgaggatgagtttaaaattcagcccaccaggggccaactcaaaatctacaagccaagtatacctgttctattcccactcaacactttccctgaatctgaatccccatagtacattattagtaggtgcctctgatagcaagaacacacacagtttcttcatctttatataaaatatatagatgctctgctgtagaaggtatgcagtaactccatattaattaaagaaacaaagggccacttgaatatatctgacttggactattcgactgtcagctccttaagagtagggactaccttaaatccctctgagagacttaagtacctccgaatccttgcacttaactaaagagtaccttgcac

SEQ ID NO: 174105 - DNA, 364 bp, Homo sapiens
ttacgatacactcgagtgtcggtaccctcgataagggccaactcaaaatctacaagccaagtatacctgttctattcccactcaacactttccctgaatctgaatccccatagtacattattagtaggtgcctctgatagcaagaacacacacagtttcttcatctttatataaaatatatagatgctctgctgtagaaggtatgcagtaactccatattaattaaagaaacaaagggccacttgaatatatctgacttggactattcgactgtcagctccttaagagtagggactaccttaaatccctctgagagacttaagtacctccgaatccttgcacttaactaaagagtaccttgcac

SEQ ID NO: 174106 - DNA, 251 bp, Homo sapiens
tggagatactagttcataattttaaaattcccaagagaagtgtctttgaagtggtaaacacagtgcactttaagccacttctcttcccacagagtccagctgaaggaggtaagggcatgctgcatgagagtaatgccgtgatgagtgtcttactctggtaaaatgccatttacaatgcctggagactgaacactgaacaaaacatagtgcccttagaatttcactggaaaaacatgtgaatcacataagtt

SEQ ID NO: 174107 - DNA, 3237 bp, Homo sapiens
  misc_feature (31)..(31): n is a, c, g, or t
  misc_feature (127)..(127): n is a, c, g, or t
  misc_feature (133)..(133): n is a, c, g, or t
  misc_feature (196)..(196): n is a, c, g, or t
  misc_feature (239)..(239): n is a, c, g, or t
  misc_feature (269)..(269): n is a, c, g, or t
  misc_feature (342)..(342): n is a, c, g, or t
  misc_feature (401)..(401): n is a, c, g, or t
  misc_feature (505)..(505): n is a, c, g, or t
  misc_feature (1829)..(1829): n is a, c, g, or t
  misc_feature (1902)..(1902): n is a, c, g, or t
  misc_feature (2168)..(2168): n is a, c, g, or t
  misc_feature (2329)..(2329): n is a, c, g, or t
  misc_feature (2339)..(2339): n is a, c, g, or t
  misc_feature (2389)..(2389): n is a, c, g, or t
caagttcgagcagttttcctgcctcagtctnctctgagtaggtgggaccacagtggcacaccaacacaccttgctaatttttcttttaataagagacggtggtctcagccgggcgcaatggctcatncctgtnatcccagcactttgggaggccgaggcgggtggatcacgaggtcaggagttcgagaccagcctngccaatatggtgaaaccccgcctctactaaaaaaatacaaaanagtagccgggtgtggtggcggtcacctgtngtcctagctactcgggaggccgaggcagaagaatcgctcgaacccaggaggcggaggttgcagtgagccgagnttgtgccactgcactccagcctgggtggcagagcgagactctgtctcaaaaaaaaaaanggcggcggcggggaaggtggtctcactgtgttgcccaggctggtttcaaactcttgggctcaagtgatcctcctgcctcgacctcccaaagtgctgggattacnggtgtataccaccacgtctgactaattaaaaaaaaattattttcgtgcagatggggtggggtctccttatgttgcccaggatggtcttgaactcctgggctcaagcagtcctcctgccttggcctcccgaagcgttgggattacaggcgtgagccaccacacctggacatcagtattttttttgttttttgcgacagagtctcactcttgtggcccaggctggagtacagtggtgcaacctcagctcactgcaacctctgcctcccgggttcaagtgattctcttgtctcagcctccagagtagctgggattacaggctcgtgccctcacgcctaatttttgtatttttagtagagacggggtttcaccatgttggctgggctggtctcgaactcctggcctcaagtgatccgcctgccttggcttcccgaagtgctgggattacaggcgtgagccaccgcgcctggctgtcagtatttttaaatggttgaatgccatcccactgcctgcctgtctcctgccactgaccctgctggcggttggtggtttgggtggtgatggtgttttgctgtcatagttaccaaagcaggcagcgtctctgttttgcatacagaacttctatcacgtcggaagttattttcttatttactttattttttttttacaaaaaagtaggggaaggcacccagccgtgggttttcagatcaaagggaaagaaacagttactggctttatctgattataacagtaatttggaagataaagaaaagaaaaatccattcaggcctttttttttctgctgtcatttccttttgtttccctgtgggtacagctgcagggacatgtaccaggagctgcagctatctgcttaatgacggatcccagagataaggggacagcgccactaacattctttcagcgcctaagatgcctctgattccagaaggatgacttgcattaaagagttcagcagcaacaagaaaataaaacacacagacacacacacacacacacacacacacacacacacacacacgcacaaacacacacatatatatttttcccccccaaaatggggattaaactgtatattctttttccctagaacataccattttttgtttcttttaatgctctctgctttgactttcattttggatatggacgctgtgacttctgttgttgtcttggtagcatttgaccattgttatctttatttattacttttctacctctcctggccttggccatttgttttggtggttgttgttgtttgtttgttttttgacacagagtctcactctgtcgcccaggctggagtgcngtggcacgatgtcggctcactgtaacgtccgtctcctggttcaagcgattctcctgcctcagcctcccgagtngctgggactacaggcgtgtgccaccatgcccagctacttttttatatttttagtagagatggggtttcaccgtgttagccaggatggtctcgatctcctgacctcgtgatccgcccgcctcggcctcccaaagtgctgggattacaggcaggagccactgcacctggccttttttttttttccttaattttattttatttttgagacggagttttgctcttttttgcccaggctggagtgtggtggcgcgatctcggctcactgcnacctccgcctaccgggtgcaagtgatgattctgcctcagccacccgagtagctgagattacaggcacccgccaccatgcccagctaatggccatttgttttagacgtgtcccttttagaaagtgtagattttttagctgggcatggcggtacatgtctgtngtccaagctncttgggaggctgaggcaggaggattgcttgagcccaggaggttgaggctntcagtcagctgtcattgtgccatggcactccagcctgggcaacacagccagaccctgtctcaaaaacaacaacaaaacagagagtgaaaaaacggaggcagcctacaggcccttctcatcgcgggggtggttaaagtaagtgcattagggtttctccataccttggctcaataggctgctgttaaaatgaagctcctttcatatgtatcagtcatgttgaggggaaacgttgcaaagcaggactgttggtaaattcccactttttttttttaaaatactgtgtgtgcatggttgtgtctgcgtagccttcatatttacacggttgtgtgtgcttgtggaaagttctagaaggatacaccatgctgttactagtagctgactctgtggagttggtaggagggtcactggagaggaacttgcaacatatatacacttcagtggtgtcttttttgggcagacggggcaacaagtaatatatactagtaataagataatacacgttaaaaacagcctgtaatcccagcactttggaaggccaaggcgggaggattgcttgagaccaggagtttgagaccagcctgggcaacatagcaagaccctgtctctaaaaaaataaaaacttagctgggtgtggtggtgtgcacctgtagtccagctactcaggaggctgaggtaggaggataacgtgagcccaggaggtcgaggctgcatttagtggtgatggtgccacagtcctctggcctgggcaacagagcgagaccttgtctctaaaaaaaaaaaaaaaaaaaaaaaaaattgcagggcgcgtttgctcatgcctgtaatcccagcactttgggaggccgagg

SEQ ID NO: 174108 - DNA, 196 bp, Homo sapiens
ggatgccctgtagagacaaagctcagttcaaaggcgtcattccatcctggtgctaccaataagaagcatggaggattcagcaatactcagtatgcaatcatggatgatcctcttgtcctttcatatactgttcctgtctatttcaatgccttttcttttgcttttcatgctgcagcattcttttttttttttttct

SEQ ID NO: 174109 - DNA, 134 bp, Homo sapiens
gtggtttaaaagaacaattgtaatatttccttcattctgaggtgtatttttctcacattttcatattgtaattaggatacctgttaacattggtgtacatttaatgtagtagtactttttctccttttgccctg

SEQ ID NO: 174110 - DNA, 221 bp, Homo sapiens
agtagagacggggtttcaccgtcgtagccaggatagtctcgatctcctgacctcatgatccacccgccttggcctcccaaagtgctgggattacaggcgtgagcttccgcgcccggccaacaacagccatttattatcttacatttccataggtcagaaatccagcagagcatggctgtattctctgttcagggtttcacgaggccaaaacgaaggtgctg

SEQ ID NO: 174111 - DNA, 560 bp, Homo sapiens
atttatgaagatagaaatgggtttctgatttaaaaaatcaatcttggtgccattataatcctatgggctcttgaaattactctccacactgtgttattcttctgaatgcagtgcaggttcttcagctttgctggagtacgtatcgactttgctgggagcatgactttgtgcaaggcataaaggttatacctctgcagctcttctactttgtctctgccatctctgaccactcaactcaggtaaccaatgagagatgccctgttgatctcttatccttgggaataattttaatctcttcctcctgtttaatgctagtgtcctcctttccccataaatgtggttgtgtgcctgtttgtctcgtccatgagagtaagcttttaagaactggaactctgcaccaaatgtgcagtgaaatgactttgttggagacccattgtctgcctgctggccctcatcagtggtgacttcatattcctctttttagagagttttacatagagcctttttgaaatggtatcctgggaaaataaagagctggctgtttgtaatactttctacca

SEQ ID NO: 174112 - DNA, 323 bp, Homo sapiens
agactacacaatggaggaaaggacagtctgcaagaaatggtgttgggaaaattggatatacatatgcaaaagagaagacagactcttaccacatatctcatataaaaattaactcaaaatagattaaagactgaaatgtaaaacctataagtacagaacctcaagaagaaaacacagaggaaaagcttatgacattgaaatgaacaataacttcttgtatatgacaccaaaagcataagcaataaaagcaaaaatagacaaataagactacatcaaacttaaaaacttctgtgtagcaaagaaaacattcaacagagtggcaa

SEQ ID NO: 174113 - DNA, 487 bp, Homo sapiens
atgtaagcaagggaagaaatggctgtaaaatacatttttattgtacttttgagtaaaataaaacttacccaattgttgcttcactaggaaaaatagtctgattttaaacataaggcagctaattacaaattggcaagttaaaagaagatcagtaaatcacaatgttcccttttggcaccatgaaaaaattaggatatttttgtgtgagtggttgttaaaggattttattattgcctgttcctgtttactgagccctgaaactttggccacactgcattggacacaagtcccttgataatcaccatgccctatcaacatgtcttttcaaccaggaacaactaaattcattgtaagtaatttaattaactgttgacttaaaaccacacttgcctaggagacagcttttcccacttgtgtaatattagctttacaatgaaaacagatacaattttaagttgaatataatcttattatgtacaatgattag

SEQ ID NO: 174114 - DNA, 427 bp, Homo sapiens
gtaaatatgacaagatggacatgtatgttgagaaagtcattgtgtgggctgtaatgtaaatctttcatgccatcagttatgtcttctaacaatggaaagcagaggcaccccatacctgtgcaattaaagtgatggcacatgattcaagcatataaataatactttactctccaaatttaaatcatattggaataaagtaaaagtcaatggttggttagagattatgtacagcatgtagctgagagaagagaggcacggctgagggtgtgttggggataaagtgcagcgatgtagtagcaaacacgtggagagtacccatgacattttcctaattgtccaatacccatgaccattgttcccacctactcctgagtctacagtgttcttttcagccattaaataatatacttaacatcattctaataca

SEQ ID NO: 174115 - DNA, 483 bp, Homo sapiens
atgcctatctttctaaattcggaggatgcagtcctccctaaattgggctctggtggcgggggaaaggagccaggaacaacgttccccgcacttcagtgccccacaaggctcctgagtgtctcagtcaagggcagcagatggtcaggccttcctgcaagcccaggccacttcgagggctcacttctgggcagctgccacattatcttcccatatgaaatagcaagggatagggctgggtgcggtggctcactcaagcctataatcccagaactttaggaggccgaggcaggcggattacctgaggtcaggagtttaagaccagcctggccaacatggtgaaatcccgtctctactaaaaataaaaaaattagccagacatcgtggcgtacgcctataatcccagctacgtgggaggcggaggcaggagaatcgcttgaacccaggaggcggaggttgaagtgagccaagatcatgccactgcac

SEQ ID NO: 174116 - DNA, 272 bp, Homo sapiens
cagcagagtagtgcccaaccctgccccctcaacacaatgcacttgtacaaagtgggtgtgggatggaacttaaatagcaaagaaccaaatcaagatgcacattgagagcaatgtgcatctatgactggtgtacaaagtcatccttctgcactatcagtgtggcattgtgcccacgagtaaagggaatcacaaagagataaaaccataagcagctaaatagccacaccataagtgggaagaacagcatatttttgcttgaaaatccattaata

SEQ ID NO: 174117 - DNA, 341 bp, Homo sapiens
aagacgcgaccactccaaaagacaggttaatgatcccatatatcagatgaacagctaaatatctctcagccaccccaactcttattaaataaccattagtaacgaggggttttcccgctattagatgggttaacagaagaacaagctgcaatgggtggttaatatagaaatgctatcatgtgaatgagctgaagtttcagggcaagaaaaattagaagatgggcacaggaaatctgttaaaagtaacagctgaattgcagaaaaagagtggagaggagatgaatctttctaaatttaatgttagttataaggatacagatataaacacagcaaatctgacc

SEQ ID NO: 174118 - DNA, 296 bp, Homo sapiens
agcagagacaaggtttcaccatgttggccaggctggtttcaaactcctgacttcaagtgaaccaccacctcagccctccaaggtgctgggaatataggcatgaaccaccacgctcagccttacaaaagagtattattcgccttataaagaaaggaaattgtgatatatgctacaacatggataaaccttgaggacctgctaactgaaataagccagttacaaaaagaaaaacagtgtatgattctacttgtatgaggtacatacagcagccaaattcagagagacagaaagtagaa

SEQ ID NO: 174119 - DNA, 866 bp, Homo sapiens
ctggcgggcctcatctacaaggcccagttcaacaacgaccggtcccagctggctagtgtccccaagatcctgagggaactggtgcctgagaacctcacacgcctgatgtcctcggaggagtggaaaaagagcatccttctagcctatgacaagcataaggacaagacagtggaggaggccaaggtggccttcctgaagtggatctgccggtggcccaccttcggatccgccttcttcgaggtgaagcaaacctcggagccttcctacccggacgtcatcctcatcgccatcaaccgacatggggttctgctcatccaccccaagaccaaggacctgctcaccacctatcccttcaccaagatctccagctggagcagcggcagcacctacttccacatggcgctggggagcctgggccgtggcagccgcctgctgtgcgagacctccctgggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatgactgactgacaggacacctcccaaccccaccccaccccaccagaatgttcaataaaaactcctggagcaggaaaagt

SEQ ID NO: 174120 - DNA, 638 bp, Homo sapiens
tcacagggcccaggcggggccagcagatctggagagggcctgggtgcatccccaggaccagcagccaaggtggcaaggccaggcgggaccccctgcgcccttggcccattccaaggagggagggagacccagctccagcagggcaagcagaaatgacggccccaatggcaggagcccgccttccctttctccatgccctgcactgctggttgctgaggaagagaaggtggtccctgagtccaggacccccacctgccctctgcacccacagcctctgacccccccgtcccctgtccagggctataagatggatgacctgctgacctcatatgtgcagcagctcctgagtgccatgaacaagcagcggggctccaaggccccagccctggccagcacctagcagcggatgctggcgtgtctgctcaggcgcccttcccgacctctagcctggcggcaccttcccaggccctctcaacccagggcctgtccttggcgggcagccttccatgctgccccccatacaaagcccactcagccccgcaggcggccccctctgtcctgggcgctgcccagggaggccaaaagacgggcccagaatggggtcgggagtctcggacccccaggctattggtggatga

SEQ ID NO: 174121 - DNA, 555 bp, Homo sapiens
atgtctgggcgtggcaagcagggaggcaaagctcgcgccaaggccaagacccgctcttctcgggccgggcttcagtttcccgtaggccgagtgcatcgcctgctccgcaaaggcaactatgcggagcgggtcggtgctggagcgccggtgtacctggcggcggtgctggagtacctgaccgccgagatcctggagctggctggcaacgcggcccgcgacaacaagaagactcgcatcatcccgcgtcacctccagctggccatccgcaacgatgaggagctcaacaagcttctgggcaaagtcaccatcgcacagggtggcgtcctgcccaacatccaggccgtgctactgcccaagaagaccgagagccaccacaaggcgaagggcaagtagaagcctggattagtttgcagcaactcaatcccaaaggaaccaaaggctcttttcagagccacctacaattttgtggaagaactgagcactatgtttaatgtaatttctcgtctttgcctacttctaaaccactccaaaggttacgtagatcagtcttcggtg

SEQ ID NO: 174122 - DNA, 540 bp, Homo sapiens
tttgcagctaatgtagatgacattttaagcaacatctatcaatagacgatctcatttccaatagatcacttgctgggagggagagaggagggacaataaaactcaggacttactccactactcttgtttaatgacctcgacttccccgagaaacttagagaagagtctcttccacaaaagccacaccctggcagtcttcaggctgtatctcgctggaaaatgtgttttctttggcttgtttggtgtttatacacttttaaaaacattatcaacttttaaaaatcagaaaataactgtctctcaatgaaagacatccagatttttggcttctcttgaagacaaataaaggggggaatgtagcatcccacatagtaactcaaaacaggagttgagagcagttcctccctccagaggctatgagtcttcagtttatcacagtccccactgctccctgcagtctttccaattacaggtgcagtgtcaactgcctgccatcattgttcagagtggactgaaacataatcctctgaaaagtagaaa

SEQ ID NO: 174123 - DNA, 262 bp, Homo sapiens
cacaacataaacaatggtgttctatttagaacccctgcaaaattagatgtgattggcttctcctaagacattgagttgtagttagttgacaggtttgttggccagtaagcagtggtgctatggtgaatagtgccctttttgtatttgtattctttttggtacagatgtataatctcatagaataatttcaaattaattagtattgcagctgaactatgtgatgctatcacaatttgggttagtgggtgaatttagtagtttt

SEQ ID NO: 174124 - DNA, 425 bp, Homo sapiens
tgctgggattacaggcatgagccacagcacccagcccagagaaacctctttatgtcccatgagcattagagcagtacccagaaccatgtaaggtactagcagtggtaaatgcctggcaggctctttgctcatcttcctcctaagccaggaacaggcatcagccctcacccagagcacttggatctccccacgtgtgctaagatcccttcgcagcatggagcttcatgcagcaaggccgatgacataagctggcatgagttctgtctgctgccctggtatatcctatagcacctaatgtgctggaaggactcacgtatttaggaacatgatagttctcaggctgtcagttttttaaaaaggtgcagggtgcaggggaggagaatctggaagttactattgctttgtcagaggtgagattctgagta

SEQ ID NO: 174125 - DNA, 559 bp, Homo sapiens
cctagagttgtgcaatatggaaatcaggctggagccacagaacaaaccatacggacaaagttgtgtctttctgggtctttgaccggtccgatgtttggtccgtaatctgttctgcttttctagatctggttaatagctaaacagtgatccttgaaaaatatatatgagatcacgtaatgtctccgttcaatactttttaacagcctcccatccttaatggtggggcccttatgatctggcctatgcctaattctccaaattcaaaacccttacccctgctacctgggtacaaaatcctgtttttaaaccctacttgctaaatgtgtgaccttggtcaaattatttaatctttctgtgcctcagtgtctttatttgtacaatggaggtaacagcattacctatttcctgtggtttttgtaactattcaaagagttgtgatatataaaatatttggaatgattcctggcacacagcaggtgctcagtaagtactatcactactgtcattattatttcatgaggaatgtggtaactacaattgtactctaagcttacaacaa

SEQ ID NO: 174126 - DNA, 225 bp, Homo sapiens
aaaaacaatcagagaagggaaagtataaagtactaggggtaagagttagaagaatggaaattttacatagggcagcaagaggagacctagctgggaatgtgactttcgagtagagacagaaaggaagtgaaggaatgtagagcccagagagaaaaacatcctagggagaaggaaggaggaggcaggacattgaagactttctaggctgtagtccttaaaatatgt

SEQ ID NO: 174127 - DNA, 250 bp, Homo sapiens
tggaggtcgaggctgcagtgaactgggatccagacactgcattccagcctgggtgacagtgagagaccctgtctcaaacaacaacaaacgaataaacaaaaaacacccaaaccatcaggtttttatgctgacacccatgttgactgctcagccctctccccgcagtctgacttatatccagtgacttcctcttggatacctgagaggcagctccagtctccagtgctccacgccgggcttcccatacccc

SEQ ID NO: 174128 - DNA, 519 bp, Homo sapiens
tgatgcaggctgcagtggttcagctggcactggaggagctgagagggcctcactcttgtgtctgaggtctgggtgctggatgccagcagaaatgcttcagttctcttccagctgacctctccacttggtccctcatcaatcagtagtctaggcagggcatctgtttatggtgtataagcattccaagtgcagagacagaagcagtctgaggcagcttttgagtcccaaattactgaaaactggaactagcacaggctgctttcattgcataatattgatcaaagcaggtgacagggccagccagtctagatttgggacagcggcagcttgtgcacaggaatgggaggattgttgcttactgcaggcaagttaccatctaccactgtcatctgcactggtggtctccacccaccaccccatggatcatgatcctccttcatgtgacctctttctgtcttggcttctggtctcatgatactatgattttccaaacagctactccagccacatttttattat

SEQ ID NO: 174129 - DNA, 1129 bp, Homo sapiens
  misc_feature (6)..(7): n is a, c, g, or t
agcggnngggagcagtggccgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaatccctaccctgatcctgttccaaggtggcaaggaggcaatgcggcggcacagattgacaagaaaggacgggctgtctcatggaccttctctgaggagaatgtgatccgagaatttaacttaaatgagctataccagcggggccaagaaactatcaaaggcgggagacaatatcctgaggagcagcctgtggttcaacccccaccacagtgtcagatgggggaaacacagaacgataaataagatcctcactttgggcaagctgctctgccgttcaattcacagcctttcattacacaaggctaaagtggagctctatttatagtttcctttggctggtaatggtgggctatcgcctctgattaagagacgcttagaatgagcgcaaagaggctccggtggccactttctcgggcagcaagatcacagagggggaaaggctcacacg

SEQ ID NO: 174130 - DNA, 128 bp, Homo sapiens
ggatgactaccaggtcatggatgaattcctctacaacctcagctcagatgacttcaatgacaaatggattgccagcaactggccttctaagatccttgggcagatagagctggtgcagcagcagcatg

SEQ ID NO: 174131 - DNA, 369 bp, Homo sapiens
gcctcccatcatggtccccttttactgatcagatgccgaacaagtggcagagataagacccaaagctcggctcctaccaggaaaggcatacctaacccgtttcctactgctgccctataagctttctaggaaacaggagggcaattaacagctacatcaaggcttgtacccagtgtcttcgtggaaggaaagatgtcaacccggggcgtggttgtacaccgagacttctgttcactttccttactgctgaattagagaaataatttaatgcagtccttaccatttcgaatcctactaaattcggtttgatacttataaggtggtagacttgagtaagattcaaatagactcaattaaatggtcctatag

SEQ ID NO: 174132 - DNA, 615 bp, Homo sapiens
gctgcccacgaagtgcatgcagctgtgccaggcagggggctacagggactgaggctctccaggctgctggcacacctccctccccaaacattgcccccagaagccgccacgtgctctcacgtgcactgcacacccacgtacacagccaggcacacatccctactgtcacggtctccctggggaccctgtcagcatgtccatgggacttggtcctgatgttggaccgtaagactccagggaaccctcgtcccttccgcagtcccccaaggaaggtcacatcatccaccccacttcgtgggcagcgctgctcccgaagtgctgggattacaggcatgagccaccgtgcccggcctgctttgcgttttttaaagtcaggtagtgggatgcctctagcttcgtttattttgtttagtgtcacttcggggcagcgctgcccacgaagtgtcacacattccaacagcaggtccaggttgtactccatgccccgtgctgggtcgaagcgccgatagccgttgagcagtcgctgcttctgtaagcgcaggcggagctgatagcgccgattgatctgctccaggacagtctccaacgcatcacccacgtccgccctggtaaccc

SEQ ID NO: 174133 - DNA, 396 bp, Homo sapiens
gggaaatgggagcaggaattggggagataggggaggggagggacaagctgacccaactatatatcaaattggaggtgggcagaggggcagattacacatgaggacttactttaaaacgtaatacttagctgtaatcccactgagacgtggacaaaaagagaaaataaatatgacatactacacagcacaggttcaacccagattattattgcatttctgagggtcatgggaaaaccataccattttgaaccaatacctacaaatttactagcacatctgtgcaaatatatagaaatggcttcagtgtccttagctagactgtaagcaagtttgctgtaatcttggtctccttcatctctaacacacactaacatacatacatacacacacacacac

SEQ ID NO: 174134 - DNA, 743 bp, Homo sapiens
aaggaaaaacttggccaagcatggtggctcacgcctgtaatcccagcactctgggaagctgaggcgggtggatcacgaggtcaggagttcgagatcagcctgatctcacaagtgatccgcctgcctcggcctccccaaagtgctgggattataggcatgaggcactgcaccctgccgtaaagtgcaattagatttaaaattacttgtgtctaggtaaaagaagagtgaaggcaaaaaaggatgttatgaatccctcatattattttaacaagaacaatgttcagtaaggggaagaaaaatgtttgaggagatggatatcccacttatcctaacttgatcattttatatttatacaagtatcaaaatatcacatgtaccctaaaataagtacaactactatataccaaccttttaaattttaagagaaaaaaacactgttgagggtaggtagggaggtagtagaggtaactgtatataatcccactaagcactctggcattttcagagaaaataaatatgacatactacacagcacaggttcaacccagattattattgcatttctgagggtcatgggaaaaccataccattttgaaccaatacctacaaatttactagcacatctgtgcaaatatatagaaatggcttcagtgtccttagctagactgtaagcaagtttgctgtaatcttggtctccttcatctctaacacacactaacatacatacatacacacacacacac

SEQ ID NO: 174135 - DNA, 273 bp, Homo sapiens
gtgactaacacttgtagtctgaatgctttcagaggccaagacagaagggcttaaggctaggagtttgagaccagcctgggcaacagagtgcaaccctgtctctacaaaaattttctttaattggccaggtgtggtggcacacacctatagttctagctactcaggaggctgaggcaggaggattgcttaagcccaggagtttgaggttacagtgagctatgatcatcctacttcactccagcttgggtgacagagagcttgtctctaaaaaaa

SEQ ID NO: 174136 - DNA, 761 bp, Homo sapiens
aggttcttgctctgttgcatctagagtgcagtggtgcaatcatagctcactgcggtctcaaactgctggctcaagtgatccttctgcctcagactcccaaagagcttggattacagacatgagccactgtgcccagcccacagtcatgttttaaagtgtctgagctataaatactactataaaggtgtcaactggttgtatatgtgggcccttggcatttcagaaatgacagttattgccaaccattaccaaatggaatccattttatccaaatgggcatggttggggctgagcatgggatggagtaatgcagtcttattgcatttcagtgttagagggctttcactcggtttgcagtttctccacagctcacccaccaattctacctgtgtacttcttttctgttccctctcaacttcttttccattctctccttcctcttgtttctgtccatatctctggcttcttttaatttcccttttcccttctttcttattggtctggccctgggtctggtgagaccaagggcacagaaggatactggctccatgccaacctttcctccaaggcacaatctccttcttggcatttactgagatgttcaacttcctgtgtttctaatattccttcctgttttataaaagaaaaatagattggatttgcaaagtgccttaatttgttgattttctaaaaagcaattttaaaaatgtgtatcaacaatatcacatacatgtaactgatttattgactctggcttgccc

SEQ ID NO: 174137 - DNA, 308 bp, Homo sapiens
ttatgcatgtatgctgggaggtgaacagacttaagatttctataacatgtactttgtgcccagatagagctgagtttacatctaactctgcctcttactagctatataatcctgagcaagttattgaaacgctgtgagctcctcttctataaaatatgacaataataccgatcatgtgggccattagaaggattttatgtgataatattttattaaaagcctttataggttgggcatcccaaatctgaaaatctaaaacctaaaatgcaccaaaatctgaaatgctctaaaatccaaaactttttgga

SEQ ID NO: 174138 - DNA, 302 bp, Homo sapiens
ctggccaatctgtcctccttaagaggcaacttgaagactacaacgaggagttttaataaaatcgtactctcctatcttctcttcctcttgcctatcctttaaaatttccttttcttgttcattcttctcagaaatcctcagttggttctggcatctttagtgaaaacagccagatgaggtgtttatcaattcctagggctccttttgttttcatttagataagaaactccccaagggtaagacctttatttcttgtttggcgaagtgcaacatttgttcacagctctctatccccgataaat

SEQ ID NO: 174139 - DNA, 363 bp, Homo sapiens
caaacccactgcaatgcaaataatcagaaacgaacgtaaggcgctgggtaatttacagtggtatctgcgaggcggcggctcgttggtcctgagaaaatctgagagctctgagcacagtccaggcattctttcaaagaaatcgctgtgggttttgtttgaaagggttcaaagaccggcccatgaattataaataacatttatccaaccatggtgtctgttcttgttttcccattaaaaggagtaccaagaacttggtgtgcgcctgggtggggcgcgaggtgaaacgcctgcggataaagtgtctccaccgccattccagaccctgcccagaccttcgggcttgtgggcctgagggcgcggtcg

SEQ ID NO: 174140 - DNA, 529 bp, Homo sapiens
gccagagaaataaagcattttttaaaagatggaaataagccgatatctgattagggcaaacatgatgcagacaagaaatgcactggttcagaggagggaaggtcaggccgcctggggagagtccatgaaaaagatggaacgtgccagatgctgtgcctggtgctgggaaagagttgactaggccagcatccctttcctcaaagggctcctagactggggggagggctggatatctgaatacatcctgaggagacagtgtgggacagcatggtggcagtggagccagccgtggttctgctcttggtcggctggaaaggagacgtaagggatggcttagaagaagggaagtggaagaaaagttttctgagctgacaagaggaaggaaagggcttctagaaggacactacaaaggcatagaagccctaagcagagtgaccaccagactccacaggttaagggctcagtcacatcggaccacccccacgtcagaccccaggtgcaaggccaagcatcacctatgcatctgacc

SEQ ID NO: 174141 - DNA, 1195 bp, Homo sapiens
ccgggcatggcagtgcatgcctgtaatcccagctactccggaggctgaggcaggagaatcgcttgaacccagcaggcggaggttgcagtgagccgattgcgccactgccttccagcctgggcaaaaagagtgagacccgtctcagaaaaaaaggaatgagttaaaatttgctagtactttggattgcagggtgtgagagaagaggaatgaaggatgataccaaggtttttagcttaagcaactagagttgtcatctgagatggggatgaccttggaaggggaaaatcagcaagagtttgcctttgcacatagtcttaggtgcctattagacattgaaaaagaaatggcaagtaggcagtagacagcagagtctgaagttctggaagaggtccagactggaaatgtacatttggaggatgtcagccctgtgggaatggagttaggaaaatgctatgatttgttcccttccctgtagtttagtttttaccctggcagatttgaggcctgctttggatttagagaaagctgagttggccaggactttactattatgtaaccaggactacaaatgtcagcaactaaaaataaagaaagtcaggccctcttctgcccttcgaaatggctacagggaccaagtatgcataccccacaagaccagaagtaaggaaggaccagtaggaggctggaggtaaaagaaaaataagggcccagcacggtagctcatgcctataatcccagcactttgggaagcgatggatcacaaggttaagagatggagaccatcctggccaacatagtgaaaccctatctctgctaaaaacacaaaaattagctgggcgtggtggcacgcgcctgtagtcccagctactcgggaggccgaggcagaagaatcacttgaaccgaggaggcagaggttgcagtgagccgagatcgcaccactgcaccacaggcacatctcaaaagggtctgtccagtagttccagccaagggaagggtgatggcctaagccaccagctccagctttcttttctttctttttttttttgagctggagttttgctcttgttgccaggctcctgagcagctgggaccaaaggcatgcaccaccatgcctggctaactctgtatcttcagcagggtttctccatgttggtcaggctgatcccgagtacaactgccggtgggggtccgagct

SEQ ID NO: 174142 - DNA, 625 bp, Homo sapiens
  misc_feature (25)..(25): n is a, c, g, or t
  misc_feature (111)..(111): n is a, c, g, or t
tcgctctgttgcccaggttggagtncagtggcgcaatctaggctcactgcaacttctgcctcctgagttcaagcaatcttcctgcctcagcctcctaagtagttgggattncaggtgccaccacacctggctaatttttgtatttttagtagagactgggtttcaccatgttagtcaggctggtctcaaactcctgacctcaggtgatccaccagcctcggcctcccaaagggctgggattacaggcttgagccccgcacccggtcagtacttccatttttatatgctactatattgtcttgacttttacaatgaatatgtagtacatttcataaaactaaatttaaaagtactatgtgctaagtgctccaataagtgaagttgggaattttctggaaacttctagttggaacatctaaacacagaagtctggggtgtcagggaaggtttctcagaggtcttgtaaccttggcaagttatttagcctccctatgtcattttccttatctgtaaagtggggataataatactaccttcctcacagggttgttgtgaagatgaaatgagctgacatatggaaagtacttttagagcagtgtctggcatgtagtaagtatgatgtaac

SEQ ID NO: 174143 - DNA, 109 bp, Homo sapiens
actcagactctgatggctctgtagctaactggcccatcctcagagactaacgcaaaggaacgaatttccaggatgttcgactatgtggagaaaacaaaaaaaaagcaaa

SEQ ID NO: 174144 - DNA, 334 bp, Homo sapiens
ggatctctcaggcaccattatgtcactgcttctaccatcatgtattatatgagaggtttggcaggacacagtggctcacgcctgtaatcccagccctttgggaggctgaggcaggcagaacacttgagatcaggagttcgagaccagcctgcctggccaacatggtgaaaccctgtctccactaaaaacacaaaaatttgccaggcatggtggcgtatgcctgtaatcccggcttctcaggaggctgaggcacaagaatcgcttgaacccgtgaggcagaggtcacagtgagctgagatcatgtcaccgcacttgagctgggtgacagagcaag

SEQ ID NO: 174145 - DNA, 251 bp, Homo sapiens
tacatgtccagtgatgatgatgttgatatgagtctttttctttcccattttcggtttgatttaggggtagttttcatgacacctgtattctggtggcaaaccctttgccaaaaagctgcttaggtcttttgtccattttgaatagatttttgtgtatagtgtaagataagggtcaaatttcattcttttacatgtagacatccagttttcccaagtgtttgttgaagagactatccttgcctcattgtgtg

SEQ ID NO: 174146 - DNA, 442 bp, Homo sapiens
ataagcaagccagggagaggggacgggagattctgccattcagaggtttcccaagcatctgaagaacacacagaaatgcaaaagccagatgaacggaaaatgctggaacataacatacagaccacgtatgaaccacagaggggaaagggcacccccagcgcagtgggcctgcccagcctcaacccagagatcaaattcagcgtcaaccaacgagaatgcgatggcacaaacagacaccacgagccccgatatggtactgcctcagcaaggacacatgatgccttctgcagaattcttgccatgaaagctaagtctgagcctaacccggaggagataatcagaataatacaatacacactgtgggacatttcaaaagacagttctgggccaggtgtggtggctcacgcctgtaatcccagcactttgggaggccaaggtgagt

SEQ ID NO: 174147 - DNA, 363 bp, Homo sapiens
agttggagtgcttgtggaatataagttgaattgcatatattacattccaaggacggaaagaattagaagtgttctatctggaaagtgatacgctatcattgaaatttctccagtctgctgcacagaaatagggtatgttcaccctgagaagcagatgggtgggggcatgacatagacagcatgacttattatgactctttgacataactgagagagctcacattgtatgttatatacctcaacaactttctccatcagactcttgatgagaattaacaactagaagaaaaatggcttttcctgaggtttttcctttccctttccttaccctgtcagagtggattttttaaaaaagaagtgaaa

SEQ ID NO: 174148 - DNA, 633 bp, Homo sapiens
cacagatagttttttgctcaattaaattctgttgcataaaatttgtttaaactttttcttttaacagatggcatcaaaagtggaatctgaagtacaacttatagcagtcctcaggaacatcaagtgaccaagtgagaaatccaccaggccattatgtccattactctcttgcagcaactgggatcattggtaagttctctgttagattctgaagctccatggatttgtgttttaagctttccaagtttctttgagcaaatgttttatctgaactggatttggaagtcacagtagaaactagactgggtccagggtctgatttgctctcataattaactggcttggatctatttggaggcttcagattgttgtcaaccaaacttgggtcggcctgcccagcacaggaaagccaaatactgacattgggatttgcagcaagagaaagtgaggcatttattgcaaggcacctaccaaggagaatggggcaggtcatgcttcagatctgaaccctctcatggctgacatgtacgagtttttagaggtggggagacagaggttacaggcaaagtcatacatcaatacatggaggctatacattagtttggactaaatagccgcatcggaaacctcaga

SEQ ID NO: 174149 - DNA, 823 bp, Homo sapiens
gtgcctgtgtggcttcctctgagcctcgcagggactctgccttgatcacagcgccagggccttttctggcttctcagcagtctgtgtgaaccttcagatggggtgggcacacgtggcacccccagccaagcaggggacgggccggactcggtcctccagtgtcacctctccctcctgccactggaaccgaggcttagaatcactgaggcggtgggaacatagctgtgggcacaagagtggacatttctacggcgttccctgctgaccaggcgctgttctcacgtgcctcacagcacacattaactcatcttccccgcaaccagccctggagggcagggactgtgattttccccattttacagatgaagaaacagaagcagaaatgtttaaacttatgggaagatacaccactaacaagggctggagccaggactctagccatgcagtgtggctgcagagtacaggattttaatcacccgttgcatcctctggcgtcgggcagggctggacttcaggctgggttttccccgttcccagctgcacccacgtcgtgtctcctcctggagtctaagtttcctgtgctgtgactgcaggcggagaggagggcccaacgtctaggggatttcatgctgcatctagaagccaaaacgctgacaccccttgaaaaggagggctgggaactgagatgattgacgccccaaggggaagcgggcgcttcccagaacagcctcggcatgacctggacatggagccaggcggctgctccttgcccaacccatggggctcacatggggatatatatatgtgtctggtttctgtccct

SEQ ID NO: 174150 - DNA, 834 bp, Homo sapiens
gtgcctgtgtggcttcctctgagcctcgcagggactctgccttgatcacagcgccagggccttttctggcttctcagcagtctgtgtgaaccttcagatggggtgggcacacgtggcacccccagccaagcaggggacgggccggactcggtcctccagtgtcacctctccctcctgccactggaaccgaggcttagaatcactgaggcggtgggaacatagctgtgggcacaagagtggacatttctacggcgttccctgctgaccaggcgctgttctcacgtgcctcacagcacacattaactcatcttccccgcaaccagccctggagggcagggactgtgattttccccattttacagatgaagaaacagaagcagaaatgtttaaacttatgggaagatacaccactaacaagggctggagccaggactctagccatgcagtgtggctgcagagtacaggattttaatcacccgttgcatcctctggcgtcgggcagggctggacttcaggctgggttttccccgttcccagctgcacccacgtcgtgtctcctcctggagtctaagtttcctgtgctgtgactgcaggcggagaggagggcccaacgtctaggggatttcatgctgcatctagaagccaaaacgctgacaccccttgaaaaggagggctgggaactgagatgattgacgccccaaggggaagcgggcgcttcccagaacagcctcggcatgacctggacatggagccaggcggctgctccttgcccaacccatgggggccttgcaatgattaataataataatgatgatgataatggtgccagcagca

SEQ ID NO: 174151 - DNA, 691 bp, Homo sapiens
tgcttctgttatatgcaccagaaacaaaccactgtttgatctattaggttggtgcaaaagtaattacagttaacagcaaaaactgcaattactattgcaccaaattaatatagcaaaacccatacatgtagcaatacttcttataaattaggtgtagcagcagcaacacattcacaagaattaattaaatcatataatgacagtattttccttctagtatataagcaaatggctatactgaggagtatgggtatttttaatgaaagaaaattctggacccaagcacaaatcgtaacacatagcctggcagacacaaattgtttatatataaattcactcaaacatggccccaaatcataggtttgaatccagcagagattacagggaattaaaatacaatataataaagactgcaataggaaaatatcttatttgtaacctgcctcaaagattcagatgaattcaaaacctaggccatacacgtagttaactgctcatcgtactaaaatcctgactacttaaaaccatgctataaatagggaaaatgttaagattaacacactcttttaaaatcagtaagaaactcaatgagataaggacctcaataggcaattccaaagataaagacatgaaagtctctctaacagtaataaaataatgaaacacaaaatattatgcctatccaattggc

SEQ ID NO: 174152 - DNA, 683 bp, Homo sapiens
taaagccgggagtccggtgaacgggcagaagcaggccatgcccatgccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatggggg

SEQ ID NO: 174153 - DNA, 765 bp, Homo sapiens
taaagccgggagtccggtgaacgggcagaagcaggccatgcccatgccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggtgaggctggggctgggtgggaggcacagcccccagactcctggcccccagccctgggctgagacctgacctcccctgccaggcccagtatgagaatcccccgcacatctacgccctcacggacaacatgtaccggaacatgcttatcgactgtgagaaccagtgtgtcatcattagtggagagagtggagctgggaagacagtggcagccaaatatatcatgggctacatctccaaggtgtctggcggaggcgagaaggtccagcacgtcaaagatatcatcctgcagtccaacccgctgctcgaggccttcggcaacgccaagactgtgcgcaacaacaattccagccgctttggcaagtactttgagatccagttcagccgaggtggggagccagatggggg

SEQ ID NO: 174154 - DNA, 922 bp, Homo sapiens
taaagccgggagtccggtgaacgggcagaagcaggccatgcccatgccacccccaagatccccctgaacctgcacctccatcacgacccattcaggagcctccaggagcccagacaccagccccccaccatgggcagcaaggagcgcttccactggcagagccacaacgtgaagcagagcggcgtggatgacatggtgcttcttccccagatcaccgaagacgccattgccgccaacctccggaagcgcttcatggacgactacatcttcacctacatcggctctgtgctcatctctgtaaaccccttcaagcagatgccctacttcaccgaccgtgagatcgacctctatcagggcgcggcccagtatgagaatcccccgcacatctacgccctcacggacaacatgtaccggaacatgcttatcgactgtgagaaccagtgtgtcatcattaggtatggacagagttggggggccacagaccctgctgcccgggcccctgctgaaacatcaccacccccagggaggtttgcctgaaactcccaatctgaacattgccctgctgtccctctctgccctcactctgttttattttccttgtcaccatctgactcacgatgtattttattgattcattctgctattgtctgtctgtcccctctaaatgtcacctcaggccaggtgtagtggctcatgcttgtaatcctggcactttgggaggccaaggcgagaggatctcttgaggctaggagttcaagaccagcctgggcaatatggcaacatcctgtctctgtatagataataattagccggacacggtggtgcacgcctgtagtccccagctactcaagaggctgaggagggaggattgcttgagcccaggagttccaggcaggaacaggtgctatgatcacaccactgc

SEQ ID NO: 174155 - DNA, 547 bp, Homo sapiens
tatgatgaattgaaagaagataatattctacttcctgtgcaagtcatatatatgtttgacacattctaaagcagacctaacttagggatcatttagatttgagtggtaagagatagaaagtaatgaggataattctcatgtttctcacttacctaagttttattctatttaaacaaagtagaaattagtcatagcaggaacactctgagtgttcataattttttaaatgagtgaactcagcagctttgataatataattagacatatgtaacaatacccatctacctgggttggctttataaaatgtagatatcaatacttggaaaacaagttatcctttcatgtttattcattaacaatagtatgtccttcatcttaagtagtcatacatcttgctctttcttgattggaaccttaaagctaaaaatgacatatggacctctttgtatccatataattaacaacaaacagatataattgtttgaataattttaactacagaactgtgttaatttcaattcaactgaatgcagagtagtagactaac

SEQ ID NO: 174156 - DNA, 340 bp, Homo sapiens
gaatgttgtcagttttcttcttaaagaacttctggcttgattgaaccactttatgatatatatgttttctattttataactttctgattgttatcattttcttcctttttgggatgtttctttccagtttcttatgttgaatgcctgtcacatcccaaagaattgcagtatcatactttattgtattttaattataaatatcaaatatcatggcttctttggcatgcagatttagaatttttttcttttaattttcatttctgtgactttttttctggttatcttttggtcattgtttgccaactgcattgctctgtggtcaagcattttctgagacaaa

SEQ ID NO: 174157 - DNA, 366 bp, Homo sapiens
caaatagtgtcctgagccactgcctaatcctgtagcccagcatattctcaaggatccttagtaacccatcaacaggttaaggactggcaccctaaagggcccataggttccttctctagcacagtaaccagcctctattctgtttagtacccacgcagtcaatccctacccccagcccccaaagttgtaccttctggacaatgcctttggattcttctagatactcccaaggactaggctgtgcatttcttacctttcccacccagacgtggggcaactcaaatgggtctggaaagtaacagatatagcactagccagtccagattactgaatccagttcctgttctttcatgtctcctctgccag

SEQ ID NO: 174158 - DNA, 489 bp, Homo sapiens
gaggttgtgatgagccgagatcgcgcaccattgtactccagcctgggcaacaagagcaaaagtctctctcaaaaaaaaaaaaaaaatcatgagaatcatggaaggttatctaatgctatgatttttattctcctccacatgtgctttcacactgagaggagccactaggggaaaggctgagtatgtagagaaaaggcgtaataaggtggtatctcaaaggaggtggaggattaacactgaaaagaagatccttaacgcagtgtttgagctaacaatttaaaaaaattttaaagaaaatactgtatagaagacagaatatttcttccttgaagaacagagataaaaacataagaatagggagaagatgggcaaatcccggcatttgccaatcctggtattttgccatgttctttatgcaacgtggaaaaaatgttaaagagtgttaggcttgtttggctatttttctcatcaggtaagtaatttcctgga

SEQ ID NO: 174159 - DNA, 488 bp, Homo sapiens
tgtctcagttgcactcaaaatgctattgtgtgttagggttctttcttacagattttgaaacagtgtcttggagaggttaggtgaattgctcaaaagacgcagcaagcacagagctgtgacttggtcctgtcttatctgctttggggttatgggtagtttatctttatatgcctattttaacagtagaccctcaaccactgaaattgacaggaaaaagtatgtggttgttttaccaaacaaacaaacagacaaaaaaccaaacccaccaaacctgaaatttttggtttggtcaacattttaattcaactgtactcaatgtattaacaatggtgatttgatatgatggatgtaattgataatcaatgcagtgccatttatagactgcctaaaagtgcattgtacatcattttgacaacatatttacctgcattgtttgggcaaaatgaattttaaaattattttttgtttcctaaatttgtatcaattga

SEQ ID NO: 174160 - DNA, 311 bp, Homo sapiens
aaggaggttatctcatttctctatggaagcatcacaaaatacctagcttgacctctgctgctgggtaatgaatttccatgaaggaccatcagggagggccaaggaggtgtatggggaggatggggtaggggagagcggaaaccagtgatcaatgttgcctgcgtctcctacagcccagctaaaagggccaggcagagttgcattaaacctgattagaaaactctgcttaatacattaaagaaacaacttgcagaaacatctacctcccttccttcctcccccaaacagtaatgagtccaaattgctaataa

SEQ ID NO: 174161 - DNA, 634 bp, Homo sapiens
acacagacatgcgaatatcaagatatagtttgaaatcataattctgaactttcactctagtgtttaaaacacatcaatatttaatatctcactgctgctagttggatgaaagatgaccattttatcatgctctacaaggatcatgcctcctgtgatctgatttccctccaactctccagcctcatccagcacttttctcctctttctcagacctctaggcccacttcctgttcttctgttaattcctcaaacaagccttcccttgtttcttatattagctgtcactctgttacattctgtagtttcttgactgttcatttagggcatttagcacagtttgtaagttccatatttgtgtgattatttaaatagcatctttctgcctctactgaactgcaagttccaagaagacagaaatgaagctgtttttttttttcttttttttaaagctgttttatccctagagtctgtgcattacctggaatataataggatctccgtagatcatagttgaatgaatgaaaaacaaatggctggctggctggatgaatgaatgtatgatgtagaaacttcctttgggtagggaggaaatgctaccttttggaaaacagttgtgttttagtatccaaacaca

SEQ ID NO: 174162 - DNA, 482 bp, Homo sapiens
tgtcctccagcaactcttgagcaaataaacattctttgtctttggtggggcacgttttattgactccagtcatttggtcattgcacagcttctctaaagaactagaagttccctagaaactgtatatcacaattagttctgagaatactatttcaaacaagaaagttactatattgacattttttaaatcatccaaagcttttatttttaactcagtgttcctgtttaatacattgatgatgatggctggaggaaggtggtgtgtaggaaggaaaggatacattgctttctcagccacagccgctttaggaaacatgccatcccccacgtggctgtaattagctgtgggcccacctttgagtctctgtggagtatttagctgtgcattcccagacagcctgtaaatccccagcagcaaagggtcatggggccagaggaaatggttctccaaaggctagggggaagggaggcaaggaagacac

SEQ ID NO: 174163 - DNA, 175 bp, Homo sapiens
catccttggaagatctggtacctgagtgcagcgaggcctcctgcggccaccctcgggtccccatgctctctgggaggtgtgctgggtgtgttcgtgtaaatcagattctgtttgcagatggatctgtttggtcttttctagaaattctgttatgtcctgaacgtgaaattctgtc

SEQ ID NO: 174164 - DNA, 234 bp, Homo sapiens
aaatttgataattcagagaatttcagtgttataaaagtgtaaaagctgatatgcaaactgaattgcgagatgttagtatgtcctagtgtgtctgggttctcctgtataaaacgtcttaggagtcactggccaaattatttatctatggaaccccctgagatttgctaagaaagttatacttagacttctttctactcatggatatgttctgtaattcacacgcttgggaaacgg

SEQ ID NO: 174165 - DNA, 330 bp, Homo sapiens
gataatgcttcctgtcttgatggagctagatatagaattctaagttcataattgagtctattcccagttctttacgcttttatcttctgatatttgttacaaatgaaaagtctgatgcctatctcattcttaattctttctgtgtattttattttttctttctggtagttggtatgattttctctgtaactgtaaagtgtgggggttttacttttcagttttactttttttttttgaaacagggtcttgctctcttgcccaggctagagtgcagtggtgtgatcatgccagtgtactccagcctgggtgacagaatggaaccctatctca

SEQ ID NO: 174166 - DNA, 2320 bp, Homo sapiens
  misc_feature (4)..(4): n is a, c, g, or t
  misc_feature (6)..(6): n is a, c, g, or t
  misc_feature (653)..(653): n is a, c, g, or t
  misc_feature (713)..(713): n is a, c, g, or t
  misc_feature (732)..(732): n is a, c, g, or t
  misc_feature (933)..(933): n is a, c, g, or t
  misc_feature (1118)..(1118): n is a, c, g, or t
  misc_feature (2285)..(2285): n is a, c, g, or t
ggangngggttgaagtttacattccagactgtagcctccaagactagcacgttccatcccactgccctgagtgtccactctgaggctctgggactcagatctgggggactgggggcttcagacaggagtcactactgtccctggcctcaaaggaagggctcaacatctaaagaatctttttcttttttttttagagacagggtctcactctatctcccaggctgctgtgcagtggtgtgatcacagctcactgcatccttaatctcccaggctcaattcatcctcctgcctcagcctcccaggtagctgggactacaggcacgtgccactatgtccggctaattttttcactttttttgtagagtctgggtctcactatgttgcccaggctggtcttaaactcctggcctcaagtgatcctcctgcctcagcctcccagagcgctagaatgacaggcttaagccactgtgcctggcctaaagaagcttccgattcgataacccatcaagtttatgagctgcttccacaggcgcggtgtctcctttaggacctcatgaaaactggttgaggagggcaggctgtgtgtgttcatccctgccccacagatgatccaagaggggttggaaagagataaaggaccccgccaaaggctnccagcgtgttcctgaaggagctgggatgcaacttgtggtccctgacttctggccagggcngaggctctttctgctcctncagccctgactactgaggacaaggggaagacaccaacctgcccgggtgacatccctgtctcaggccccatgctatcccctgtccccaccctaggaggaacccggaagctggtagaatctttgtccactgtgtagcagatggcaacctggtcacttcttcaccagataccagaataatgtaatggaagaggcatctttgaanggtgatgaaatgaactctcattctttctggcctctgctgtcttcccttgacccccatatatatccaggatctaagcccagcagaacagaagctccagctgcccaggagaagagcttaattgtcccccatccaggcacatgcagacttgggttcaaatcctgactccaccccttttagctctgtgnctgatccatgctgagcctgtttttgtagaacataagatgataatagctcccacctctggtggggagggtggcctgaaaatgtgcgtaaattttatttgcatataaagctgtagtagaggctgggcgtggtggctcacacctataatcccagcactttgggaggccgaggcaggcggatcacttgaggccaggagttcgccaacatggtgaaaccctgtctttaccaaaaatacaagaattagccaggcatggtggtgtgcgcctgtaatcccagttacttgggaggccgaggtaggagaatcccttgaacctgggaagtggaggttgtgatgagccgagatcatgccactgcactccagcctgggcaacagagtaagactctgtctcaaaaaacagctgtagtagaaatgaagtaatttgggctatcttatctagttttgctgagtgactttgaggaaattctttcctctccccagggctcagtcttccactgaaatagggtgttgggacagctctccccttagaaatgactgtgggacctttcagtgtttgagaaaggtgcagtggctgtgtctgcatgtgcaaacctgctcctcggggttcagggcacgagagcaactggcagaggcagagacagagttctgggcccaggcctgccaggagttgtagctgctgagtgaggaagctctgtgggagccccaggaggggggaacatggaaaaattgagcttggccctgggtgagttggggcggggaggccgtggttcacagccctgcacagaagctgcacagaagccccacgcctgagaggaggcgagtcaaggccttatttattcacgatcaggccactggcatttgcccgtgcttgcactttttgcaaatgtcccctcgggaagacgccgctaagggcctggcccacaccacgtgctctgtgactatctatctatgaaatgaacaaaagaatttgatccttacgaaatgcaggtcgtcctgactcccaggcggggttccttgaggttacccagaactctcctgccagggagatgaggaggccatgtggactgcaaaagaacataggctttggatttgggacaacctggatttgaaccattcccttattcagccatccattcattctttgcacaattgttaactgaacgtcctgtanatgcctggtgctgtatgacctttggcaaatcactt

SEQ ID NO: 174167 - DNA, 154 bp, Homo sapiens
gcagttgccacaccaccttgaatcttgaagtattttcagcaacaggatgaccattagccacaaatttagtgtcagcccttaaggtcggtattggtttgacccatattttcatgtagttctttttcttcacttgtctaatcttcccgtgtactgc

SEQ ID NO: 174168 - DNA, 264 bp, Homo sapiens
gcttttatgcagaactcactgttcttcagttagagcttattactcttaatagtgaaatcaaatccatcttcagttgctacatggctttgttaaacagttaaacttgagttggagatgctctgtcgtagggaggaattttcgctccacagatgtgttcatataatgtattttcccctttcccctgtggaaactttgtggaaagattatttcagtgttaaccctgattgatattttagtaattaaacaagtgtctgttactccttt

SEQ ID NO: 174169 - DNA, 479 bp, Homo sapiens
aacttaaaaatacattatttggctgggcacggtggctcacgcctgtaatcccagtgttttgggaggccaaggcaggtggatcacgaggtgaggagatggagaccatcctggctaacacggtgaaaccatttctactaaaaatacaaaaaattagacaggtgtggcggcgtgcgcctgtagtcccagctactcgggaggctgaggcgggagaatggcgtgaacccgggaggcagagcttgcagtgagccaagatcgcgctactactacactccagcctgggcgacagagcaagactccgtctcaaaaaaaaaaaaacaaaaaacaaaaaactatttataaatatctagactaccaagactcacttcaactcccatcataccatgtttatagtattaactaactgtttgttttgtatttgagtacaattaagaaaaaaagaggctgggcgcaatggctcacacttgtaattccaacacttt

SEQ ID NO: 174170 - DNA, 566 bp, Homo sapiens
cagtccagagcccatgatcctgtggttaggatgagcagacagtatggccgctttgccccctctctggacaattcagccttatcagcctccaactcacttccccagaggatttggaaatatgcttcttactgctctgtgcccctgggcagagatgctaagtatcctgtccaccccttccttcggaacataacacagaggatttttggctttttaaacctacatcttatctgaaggtagggattgctctgcctgccatcccaaagcctacagtcctgacactgtgaaatgagtgcagaggaaggaggtggaatgcagttggctttgagtcctagccagccgtttgaaggctacagcctgcttctaacttgtttctgatggaattcccaggaatgaccctggctcaacctgattctcatcaggtcttctctgtactttggagaaatcaggtcccaaactctcctttctgggcctctctaatgtctgactgtggacattcagtatctcagctctgacttcgcctttacttcctgtagagtgtcttgaattctggtaactcatattcttgt

SEQ ID NO: 174171 - DNA, 459 bp, Homo sapiens
gttactgcagctgcggtgttgtgctgtggggaagggagaaggatttgtaaaccccggagtgaggttctgcttacccgaggccgctgctgtgcggagacccccgggtgaagccactgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggcgttccaatgaattcattcaggtttctctttgagggtcagagaattgctgataatcatactccaaaagaactgggaatggaggaagaagatgtgattgaagtttatcaggaacaaatggggggtcattcaacagtttagatattctttttattttttttcttttccctcaa

SEQ ID NO: 174172 - DNA, 279 bp, Homo sapiens
ccaagccacaggtcagatctgcccaaggccttgggagctcagccctcacagccctgtgccatggatgtgggacaaggattcaaaaacgatgattttggagctgtaggattgagtgattggcctgctgggttttggacacttatgtatcctatgagtcccatctgtgttttgtgcttctttctagcaattttctttttttctgttgcctgggaatgcttacccattgcctgtacaatcatttaccttggaagtaataaacttgctttacaaatcagtggc

SEQ ID NO: 174173 - DNA, 306 bp, Homo sapiens
caacctccacctcccaggttcaagcaattctcctgcctcagcctcccaagtagctgggactgttggtgcgtgccaccacgcctggctaattttttgtgtgtttagtagagacagggtttcaccgtgttagccaggatggtctcaatctcctgaccttgtgattggcccgccttgacctaccaaagtgctgggattacaggcacgagccaccgcacccggcctctacattctttattattcaaactaccttacttatccaatagttttgagttcctgctgtgtgcctgtactttgctaggtcaaagg

SEQ ID NO: 174174 - DNA, 666 bp, Homo sapiens
gaatgaatgaatgaatgaacaaacgaacaaacgaacaaatgaatgcaccatcaaagtattgtgattcagtcattcaaggaagggaaaggtggcatttgccagccctggaataattcgggttagtggcagaggcttgtaaaggcactcaggagaccagcattaggggcctgagtaagtctcctggagggctggtgagatttttgcttccttagaatttggacttcctgttaagagactgagggatgggaatgcagataaatacccagatggacccaggagcccccaatgctggactgagttttggttttgtcctacagagaacttcaagccttctaatttgaaaagtgtgtcatctgttgaaaagctgaaattaatagagactgacattgtgaaaaacaaatgcagcctgggggattgagcgggacttgagtcagtgacactcaagggtgtctagctgagatgctagacagaggactctcctagctaatgggattctaaaaagaatgaaatattctttctcaggaagatcacttagaatctcttaatggaaagactcaaatatatacgatctataggacagaagtgtgactgaaatggtttggttatttctaagtatgtttctggtcaagatcgtgtccctggcacatatgtatatatatgtgtgtg

SEQ ID NO: 174175 - DNA, 490 bp, Homo sapiens
agaaaaatccaacattccccaaccaccccctctccaacaaatactttgaaagtggcgaatctcacccactttgcttccatggggaggcactctgtattcacatacataatccataggtatttataaaaatgtataattgtgaaatggaccaatgaaaactgtattgttagctaagtgaagagggcagttgtcccccccccataaaaggcagatgtttaaataaatgcagattttaataatacaatatcattatcagattgcatacttaggtcccccagatgaaacctaagcctgttttcgtgggctgctgtgccttttctgccaagcagctgtgagaaggaatgaacatcccagaatccttgcttatgaatgcactgtcttcgctgagtttgaatgtactagtgcttcatgtttgtgtgaatgggggttgcatgtgctggtcagaagccacatgagacacatggttggggggcggggaattatgtcttta

SEQ ID NO: 174176 - DNA, 296 bp, Homo sapiens
tatagctctcaaaaggaaaaaaagaagtttttttaacaggtggtgcatcttagtttgctactaacccaaattcagggcataaagatagatagcagataaaggcagaaacgagtccagccccatccatatggccttaactccatgattgctaatagagtattttcaaggttatgggaacctaacacttaagtaaaaaattaatacataccatatatcccacaaatcggtagactaagacaactgagtttggatactacagggaaaaacatttactcttaactaagttgtttactact

SEQ ID NO: 174177 - DNA, 334 bp, Homo sapiens
ttaacaccatgtagtaagaggaatagttaagaatcttagtaggcatcgagggactggcactaccggcctaacacctgggagctttttagtaatgtaaaaatgtgggtccccactcctctatcaatcactatctgcgccttaaccagacccctaggtgattcacatgtacatttaacatttagaactctgctttgtaaagctattattacagtaatgccaacaaagagcttgcattacttcaaccttaaagcctaatgtgccaccttctaaagatcctgatattgtcacaataggctagtcagcatagaactgttagaaaaaagtacatactttg

SEQ ID NO: 174178 - DNA, 447 bp, Homo sapiens
cagtggaacactgagctgcttattttcattctggccccttgttctgatatttcccctttttgatcattcttcctccatgtctcctacacatttccaggcccttctgtttttcctgccatcataactgtgcatctggaccactgcaaagagacttcaaggtacctcatctgctgtgtcagcccctctgactgtcctgctggccactgcctgttcctcttcccggagtggagccttgatcctgtcattcccttttctaaagagcccccacggcttccatggcttccagcacacagtccatgctctcagcctgctacccagcctcctttccctgtcttcccctccacttttctccttgtaagctccatgttgcagcaaaatcaaatgactgttctctgggtgcacccgcagaattccatgcctccgtgtcttcactcacaaagttcccct

SEQ ID NO: 174179 - DNA, 420 bp, Homo sapiens
ccaggcatgagtcatcgtgcccaaattatttttttttacttttattttaggttcagaagtacatgtgcaggtttgttatacaggtaaactcctgtcaccagggtttgatgtacagattactttgtaacccaggtacgaagcctagaacccaatggttattttttctgatcctctccctcttcccaccttccaccctcaagtaggccctactgtcggttgttcccttctttgtgtccatgtgttctcatcacttagctcccacttataagtgagaacattcggtacttggttttatgttcctgcattcgtttgctgaggataatggcctccagctcccaaccacgttcttgcaaaagacaggaggatctcattctttcttacagttacatcgtaccccatgatataaatgtaccaaatttt

SEQ ID NO: 174180 - DNA, 167 bp, Homo sapiens
ttctccccccagagtagttttatcagcaagcacaattgattctaccaattcttcttccagtaaattatctctaatttgtccactttgtctccaatccttcccacgattctgtaacagttgcctcctatgtagctgtagtctcctaactggtgtccctgtttcttatc

SEQ ID NO: 174181 - DNA, 616 bp, Homo sapiens
cctaccaccaagaacaggaactagcacttaaaaggtactcaaatatcggtcatttaattgacaaaatctatgaaaattaccatatagtccttgctgaggacaagatgagaaatgtacggggcagcacatgacctccattctccaacttaattcagtatttcttatcgaataagacatagaaatgtctgcttatcaacctgttactgtcgtataatctcaaacacaaattgactttcagattaattgtaagggtcaaatgggaaattgtagatttgtaaaaaagagataatgatggctctgccctcctccaaattcctttcctgaaagaaaagtctgtttacagatatcaagcaaatgaaaacctgccaaattttgatctctaattttagcaaaaagatatttacaaagtggtattttactacctatacatttaacatacatcgggcacttctaaacatctagatagactagatgtttcaagtaaggagttaatttgtctactatgtatacagcagtcttgaataaactgcaaacatgtaacaacagttataatttgaaagagtcttccaaatgtgaacattctggcctagaacccttcccatctggtacggattaa

SEQ ID NO: 174182 - DNA, 538 bp, Homo sapiens
tgcacaaagaccccaaatccattctcctgtcttccacagtagcaggtttcagctatgcacatgactgggtaatataaatataaaaactatacttcccagcctcctctgtggctcagtgtggttacataacaagactctggccaatacagtattagctgaagggataaatgtgatttctgggttacgcccttaaaggaaagggcgtgccctccttcctcttttttcccatccaggagccatcttggatgactcagatgagggtaccatcctgagaatggagagtgataagacagaaaaagcctgggttcctggtatgatggggccagcataccagccatggactgcttatccctgtgctgttacaagaggaagaaatcatctatcttgttaaagtcattgttactttgggtttggttacagcagcctctacatcctaatcaataccctctaataatcctcccaataacctcccctgccttgcaagcactaactgctttggaatcacgctcaaagactccataacaccgcaaggagtatc

SEQ ID NO: 174183 - DNA, 571 bp, Homo sapiens
tgtagctaatgccctataaatatgtgattattggcttggattttcccaaagctttaacacaataagggcttaattacagcttgtagttggcaatcccagtaaattacggtttacatgatgttctcactttttttcagcagccgaggggcctataatttcagcactttcattcaaatcgggcagaagtttggcagatgtggctctgagccaaatataaacgctgagagcgacagcgagacagggttccattcaaaggccagcctctaccgcctaagccaactctgaaaactctaaatctaacctaggccgggtgccgtggctcttgcctgtaatcccagcactttgggaagccgaggcaggagaatcacttgagcccaggggtttgagactagcctgggcaaaaaataatgagaccccacctctacaaaaaatttcttaaaattagctgggggtggtggcgcacacctgtggtcccagctaattgggaggctgaagtgggaagatcccttgagcccaggaagttgaggttgctgtgagctgtgatcacgccactgcatttcagcctaggcaa

SEQ ID NO: 174184 - DNA, 441 bp, Homo sapiens
tgtagctaatgccctataaatatgtgattattggcttggattttcccaaagctttaacacaataagggcttaattacagcttgtagttggcaatcccagtaaattacggtttacatgatgttctcactttttttcagcagccgaggggcctataatttcagcactttcattcaaatcgggcagaagtttggcagatgtggctctgagccaaatataaacgctgagagcgacagcgagacagggttccattcaaaggccagcctctaccgcctaagccaactctgaaaactctaaatctaacctaggccgggtgccgtggctcttgcctgtaatcccagcactttgggaagccgaggcaggagaatcacttgagcccaggaggaggaacttgcagtaggcggagatcacgccatttgactccagcctgggggaaagagtgat

SEQ ID NO: 174185 - DNA, 415 bp, Homo sapiens
aagggttccttcccagggcagtctcatgggagcaattcctcctgcaacgtgttgtagcagcacagtcgaagtgtcgtctaccagggaagctcattagagactcagtgcctggggtttttatggagatctggtcacatagcattctctatctagcatgaaacaaaattccagacctccagagggcaagcaggtgttctgcataaaccccattttgtgtgcaaacagttcaggcacagcaaagcagcacagcaaagttagagaatggtggcaactctctcaagatccaagttcccagatgccagtcagaggctactcttgcaagcaggccttttaaaggagagcggtctcaagcacgctatcttagttctcttctgcacacacatcaaaatccaggattttaaaagtccaaggctta

SEQ ID NO: 174186 - DNA, 576 bp, Homo sapiens
ggatcgagaaggttgatttagtctttgaaaagaggttattagagtaatccagatatgactaagagttagaatggggagtagaattatctgtcagagacctgcaaaggatgaataggcataatttgctaagtaactagatgtgagaggggctgttgtttatccagtatgtctgtgtgtgcacaacttcacacccgttgtgaaatagatattactaactctcattttacagatgaggatctaggctcagagagtaagtaactaatccaagaccacacaataagtaatggcaatcctgggattacattttagtctgtttgatccagagctgcactacatcccattattctattctgacacaaaggagatgagccacagggagtctaatctttctagctgagaagactgtgatactcattcatgccattgaatggaatagaagttggaaggcaggaaccatttggagagaataatgatgaatggtttttgaatcattaagtttgaggttatagtgagcatccacttagaaatagtcagtaaataggctgggcacggtggctcacgcctataatcccagca

SEQ ID NO: 174187 - DNA, 342 bp, Homo sapiens
atggccggtgaagagagattcatgcaagaaaggatggcagcatggcagaaatgggagattaagcacatataggggattgatcaaagtagtaaatatattaaggataacaaattatgtttcacagtgttgaatatgggagggaaaagtagggaaaaggagaaaactagaatgaatcctgtgatgtacaattgcaactggagatgtcagcaggaactcatcgtttttttaaaatatagagagaaatggatgtaaatttagatgtgtgtatacatgtgaatgtgtgtgtctgtgtgtgtgtacataaacatatatattttctagctttttcctcttcgagggcct

SEQ ID NO: 174188 - DNA, 317 bp, Homo sapiens
tacgtgactgtgttttaacagccttggccacagggtctttgtctcggggaaaaaggggtgtagaaatcgtaatattgagggggaaacaaattctccttgtcaaaggccttactagtcaggcttgcagggacattcaggactttagagcaggggccagcaaactttttctgtcgaggggcaaatactaaatattttaggctttgtgggccagaggatgtttatacagctattcagctttgctgctgtagcagaaaaacggccatagacaataaataaccaaacgggcatgtctgtttcaatacaactttcctaacaga

SEQ ID NO: 174189 - DNA, 318 bp, Homo sapiens
  misc_feature (273)..(273): n is a, c, g, or t
  misc_feature (277)..(277): n is a, c, g, or t
taatgaacatcgtcttagactgaaagagaagtggaaagccggagtgaagaggaaactttgtctttctttggaccccttacttcctctaccttccttaaccctatggataggaagatggaggagagaagcaaagaaggagaagaatacagaaagagaaaaaggaggagagaaaagtaggagataacagataaaaaggtcacggaagaggacagatacgtgctgagtgggtcgggcagggaggagggaaaagtcgccatttggaaaggggaatanacgnggctgagtctgccaagtggaactgtgcactcttgctgcgcg

SEQ ID NO: 174190 - DNA, 400 bp, Homo sapiens
taatgaacatcgtcttagactgaaagagaagtggaaagccggagtgaagaggaaactttgtctttctttggaccccttacttcctctaccttccttaaccctatggataggaagatggaggagagaagcaaagaaggagaagaatacagaaagagaaaaaggaggagagaaaagtaggagataacagataaaaaggtcacggaagaggacttacctgtaaaagctggggctttgctagggacacagaaaggagggaggtgctgggctgccctttgcagctggctgcctagggctagaagctcttcgggaggaggcggagaaaggggggttgagcatagaaggtgcccacctcctgctctcagcaatgtggggatagactcagcccacccacctggcccca

SEQ ID NO: 174191 - DNA, 370 bp, Homo sapiens
gtattttaatttggttacttaatattacaaaattgtgattcaaacgcatgagcagatgcactatggaaaggtcttaacagccttaaaaatctaaaatccaggaatctaagtgagaggtagttaagaaagtttggctttaaagctgaattattaataatatatagaagctacctgaatcctttactcatacttatatgtcaaacaagaactattcagggctttctggaagtattaaggtcatgtttcaccttcactttttgtggtacaattaagaaagcatgccagagtttgtagtaattcctgccactcaccaaggaagcagaaagtttgtttctgagctcagtctgatcacaacctcacaattttccct

SEQ ID NO: 174192 - DNA, 356 bp, Homo sapiens
cttgcccaggctggaatgtaatggcatggtcgcagctcactgcagcctccgtcttctgggctcaagcaatcctccttcctcagcctcctgagtagctgggactacaggtgtgtgccaccactcccagctaatttttaaattttgtgtagagatggggtctccctgcattgcccaggttggtctctcaaactcctgggttcaagcagtcctcccaccttggcctcccaaagtgttgggattataggcgtaagccactgtgcccggctgttttttgttttgttttgttttgtgttttaattgaacggactgaagtttactttctaactaggttagccctccattcatacaaaattatg

SEQ ID NO: 174193 - DNA, 467 bp, Homo sapiens
gctgtaaagactccctggaaagcttcgagagccatagaaaggtcatgctctgacccaggactgtggcttccacgaggcaccctaaggatgcagtcagattgtcctggcaagtgcacaggctctgctccagcagtgcagagccaaggctgtaaaaactccctggaaagcttagagagccgtagaaaggtcatgctctgacccaggactgtggcttccaggaggcgtccgaaggatgcagtcagactgtcctggcaagtgcacctctcacagcatcacctttcataacaagaagcaaaattcaccaaatgttcctccagaaaggaatgcttaagtaaaaatgtcaacacatccatgacagagaagccatcaaaatagtgtctttgcagaatatttaaagattatacagcttataaaactggtataaatagcaaacagccaattttggcatatccccatcttttcatgta

SEQ ID NO: 174194 - DNA, 429 bp, Homo sapiens
aaggactccccggatagacgccacgtccatactttgtccttgtggtgagagaggataaaatgtgatataatttgttattcaaagaacatggcaaccgtaacagacaaaaggaagcatggcatctaggggaggagagtggagagttttccatacacaaacacatttaaacttccctgtacaaaaatacctgctgttgctttagaaatcgttttcctttatgaatagtcaggtcttgcagtacaaatccaggtgcagtgccagcaagtatttcaaataaatttcaacgacttgatattcaagtccaaactaaaggttgaatgttttcgtaaatgtaattgcaaacagttgattcttggctttaatataaaagagacatttctatcttcagtagtcagcaaagccagtgcctaattatggctggtctgcccg

SEQ ID NO: 174195 - DNA, 152 bp, Homo sapiens
cccccttgcgatgcatcttttgtctgccataaggcaaatgtcacttcgtccatttagaccacccaaggttatctgattcttgttggttattctatgttttattaggattggaatttatatttgttgatcttcaaacaatagagtcctgttcc

SEQ ID NO: 174196 - DNA, 186 bp, Homo sapiens
cctccgaaagtgttgggattacaggcgtgagccaccacgcccagcctcctgcatccttcttaaagtgtggctcctggagagaaacaaaggatcgattccaggtagggtgtgagccacagagaacagaataggactattacctccttcactctagacactctcccacaattaatgcaaccccaaacc

SEQ ID NO: 174197 - DNA, 168 bp, Homo sapiens
caacttcacctcctcatatgccccctaggacaggaggaaaggaagacaggaaggctcactcagtgtctttgccctggattccacgggacagtgccactggcatctcaggtctctccatagatctgggaacaattcactaactttacatgatggtctgcattcacccca

SEQ ID NO: 174198 - DNA, 883 bp, Homo sapiens
actcctgacttatagtgtctgtcttccagttcccaggacgtgaagttagaagatgggatgaatgatatgtttgcatttgatctttcttctatcccttctttgcgaagattatttcaccttgttccttaagtttcacatggtaattagttctaatttagtgataatgctgtgaacatggagtaagaagctaattgacatggcatgctaccaactagaattttatgaactaaaataataagctttaattttttaaagtgtgacttaacattagatagttcaggaaaacacttatttctcctaaagtgagatcaggttgtagtgaaacaaatcttatttgaagtgtcctaaaatacagtgtgttttaagttgttttctgttctctttggtccaaaaacattttgcaaagaccttcctctgtctctgtgtcgtgtctagattctatagtggagcacaaacaactgcaggaaaaaatgtgagagtgcctgtagatactggaacatgttaacagaggtatttgagaaccctcaggaagaataacattttacagtgaggtgattgttatctttaacaataaaagccatatgaatgtgctataattaaggctaatgtggaatgcttaaaatcataaaacaggtatgatcattggattcctattcacccagggaatgcagatcccaaagataagtatgccggaacatgaactttgtgagaaaacaggaatccacccacctccaataaacaagagactgtccttcatttcagttatagctcttcagggtttaatttggatagatgtgaggtgttttattctagagcataaactagatgcttctttcaagttaatggggagcaactgatggctactggattaactagaaaagaa

SEQ ID NO: 174199 - DNA, 368 bp, Homo sapiens
actcctgacttatagtgtctgtcttccagttcccaggacgtgaagttagaagatgggatgaatgatatgtttgcatttgatctttcttctatcccttctttgcgaagattatttcaccttgttccttaagtttcacatggtattgcttttactccatcgattacacatcataagacaagttgtatctttaaagtgaagttctcaaagtgtggtagggactcaaaggtccctaaggtcctttcagaggatctgcaaggtcaaacccgttttcacaataacgctaagacattgtttgctcttttttgctcgtgttacctcacgagtgtacagagtacaaattcacccgtaaggtttgtctccagggggca

SEQ ID NO: 174200 - DNA, 892 bp, Homo sapiens
gggggggggggagaacccaaacctacggctaggtacgaggctgggtggcgcccaaggaccttgagtggagacaagtcacaggttcttttcctgacttaggcacaggctgggcagctggaagggctgcagaaggggcactggcagccactcagtccccccgcgtgccttgcccagcccctcagctgtgcatttttctgggctaagaagacaaaacagacagatgctaggctgccaagtgatctggacaggacagtcttgtgggggagtgtgtggaggggtgtttttctgttcttgaaccctcagccaaagtgggaagtgcctttaggggctaggtgcccacacagatgctgagaaatgcccagactgccctccatgaggctgcctgctcaacaacactccttactttgcttgacccaggtcactgtgacctgcccatttttcccctgcatccagggctgaggtggagaggggcagtgtactcctgcagcacaggtatgggaggaggcagctgtgggagggagggagagaaggacacaggcactgctcctgtgcaaggaagactccctctcactcttcagctggcagtggggtggctgcccagaaccaggctgtctggatcaaacccagcttttgcacttgtgaccttcaacaagtttctgaacctctccgatctgtttcttcaagggagatcatcatataacctgtgtgataggctgagattgaatgaatcattgatatgaaatgtgaatagtgcctgaggcaggcgtggtggtcacacctgtaatcccaacactttgggagggtgaggtgagcagatcatatgagttcaggagtttgacaccagcctggccaacatggggaaaccccatctctacaaaaaataccaaaaaaa

SEQ ID NO: 174201 - DNA, 484 bp, Homo sapiens
aagtgctggggttacaggcgtgagccaccatgcccggcctgaagtaaaatttttatctctttattgttctattcaagttttctacttcttgagccagttttgattagttgtattttattaatatatgatccattttgtctgaaatttcaatttgagtgttataaaattctgacttgtattttcttatatttttcctattgccttttatatctttaattataattcccaatgttgtttattgtctcttcttttttctttgatcagaattgccaaaaaaattttctcaaataacttgtatcaatcaattgtattgtgatttttttcttcttgctttctttttttcttatctttatttttccttccttctatttccttaagattcaatttactgttctttttctacattcttgagttaaatgtctagttcatttatcttaagtcttccttatttttgaatatgtaagtgagtgtataaatgaccctc

SEQ ID NO: 174202 - DNA, 1625 bp, Homo sapiens
atgatggggcacggacatggggggttaggtggggcacgtaattggagctcgcggggcaggatggggcatctaactggagcgacagagagcacgatggggcacttacaggggccggaggctgggtacgtaatgagagcgagcgggaaatgatggggcacctaacgagcacgcagagcatgatggggcacgggtgcgaggtggggcgcacagtgggagcgcgtggggcatgatgggacacatggcgaggccgtcagggcacaggggaagcacttttggaacacgtgagtgacagggctgccgcccttgaaggagccctcggagtggctgcgtggtggggcacgtggggcaggttcaggaaaaaggatgcagcatgtgattgcagggcaacctggtgaggacacgagagccacctgccaccagcagggttcagggctcccagctgtgggttacttccaccttctttcactttccctcttccattgtattctagagaatttaggcccagacaagacactgattgattgattgattgattgattgacagaggctcgctctgagcccaggctggagttcagtgatggatctcagctcactgcagccgccacctcctgggctcaagagatcctcctgcctcggcctcccaagtagctgggattacagacgtgcaccaccaggcccagctaatttattttttagtttttaatttgctggtaagatggtttgtagctttgttgcctaggctggtcttgaactcctggcttcaagcgatcctccagtcttgacctcccaaagtgctgggattataggcgtaggctacagccaactttcaatactgccccattgggggttacgtttccaacacatgaaattaggaggatacattcaaaccacagcagtatattatgaccataatattcattaactgtgtaacaggctgggcgcggtggctcacacctgtaatcccagcactttgggagaccagagtgggtagatcactcgaggtcaggagtttgagaccagcctggcccacatgatgaaaccgcctctctactaaaaatacaaaaaattagccggtgtggtggcaggcgcctgtaacctcagctacttgggaggctgaggcaggagaatcacttgaatccgggaggtggaggtggcagtgagcctgattgcaccactgcactccagcctgggcaacaagagcaaaactctgtctcaataaacaaacaaacaaacaaaacctgtataacagagtgtcattgaatttctaaacgttgaaagacttcacattaaaaaaaaaactcacaatttaatattattgagtgaaagaaaccagacacaaaagggtacattctatatgatgctgtttatgtgacattcaaaaacaggccacatgacaacatggtaataaggacagtggctgtccttgttaggagttatgactggaaggaggcaggagggagctttctggaaacactgtacatcttgctcttgagagtgcacgtatatacatcaagtgtttatcaagctgtgtggttaagatttgcacacttgtatatgttatacctcgatttaaaaaatctaaataagtaaataaagataccttcaaatcttttaaaaaaaaaaaa

SEQ ID NO: 174203 - DNA, 492 bp, Homo sapiens
ccgagttctcggtaactttatttattatacccagactcactcccttggtgatctcatgcaaggtcatggtttaaaagtccatatgcatgctgatgaatccagcccagacttctctccttaatgcctgctcatgtaactgcctacaaaatattgccacttggatatctaacaggcacttcaaatcccatacatccatgactgaactcctgaatccctgctaacagtacctgatttacctccacttccctatttctcttgttggaaaatccatccttgcaatggctcaagtcaaaagtcttatggttatccttgattaaaaatcctctcgtatcagaaaaaatcctacaggctctaccttcaaaaatatatctagaatctgggtacttatcactccacagttactgccctcaccaacagtgccctgtttcactctcagaaatgtcctgatttgaacaataatcgccctaacacaaagccctccatgatctcact

SEQ ID NO: 174204 - DNA, 274 bp, Homo sapiens
tgctggggttacaggcgtgagccactgcacctggccgcctttttactatttacatggccaggctgagtcttccaaatctttccactttacttcccttttgattataaattccatctttaagtcattttccccttctcacaacttaatataggtagttaaaagtagtcatgcagcaacctgaatgctttgctgcttagatattcctaatttctcccaccagatggcctaactcactgctcttcaattctgcattccatagagccctgaggcatgg

SEQ ID NO: 174205 - DNA, 463 bp, Homo sapiens
tctggtcccccagggctccactcccgcagcagcccggctccgtcggcgtcagtggagccccaggcctgggtccgagatgagcgagacgctgctctggctcgcggtcgcccgagcgctcccaaaaccagggaacaggccccaggagagaagcccctagaagtttcctggagcagggagtctcctgtatcctgttagctctgcaaaggaatctggactttattctgagggccttggagaacccctgcaaagttttttaaaaggtggactaagagattggcatttcacaacatgactctccgaattgaaacactaagaagattggcgaaatttaacatttacagattagtaatttaacccaggtgactcgcgatgagggacatggctacccttcacttttggagggagttttaagtgatacagatctttttgccaagcaattttttttttttttttgagacggagc

SEQ ID NO: 174206 - DNA, 512 bp, Homo sapiens
cctccagatgggcctgggtttccgcccggggcacagaatccagcccagcaggcagtgccaggctggtgggaccagtgactatggggaaaagtccagatatgagctctgggatcaggctcccagggcccccaggggcgcggaccacccccctaccctgggcataggtacacggagacctgcaggcacacaggcgcataaacacacctgcgcacacacacatcacaccgaggttttcatctccatgcagtgcgctcctgtgtggggacccacaacacacacacacacacacacacgccaccaccctggtccacagcctgcgcacacatattccctcctgtggggacacacgccctcacacacgcggccggggcgccaggccctgtctcccggacacgcggcaggaacctcgggcctccccggccggccgcctccctcgcagacgcgcttagtcacctgaatttgatccaggcgggagggagggatggggagcctgacgtcagccctcgcggccg

SEQ ID NO: 174207 - DNA, 269 bp, Homo sapiens
acatgcctgagatcacattatataataaattctatatcctgcattttaatttattaaatatcccgccagtttcatttcccccattaaaggctcttaagaagcatagttcttggtggcctcataacaccctgtgggtagagctcatatttaccaccagagccctaacccagttcctgagaggctggtgcagtgctgagcaggaagacctggatgccccaaggcagtgcccacttcctgcagactgagatggtaccactctctaagaagca

SEQ ID NO: 174208 - DNA, 1226 bp, Homo sapiens
ttttggccttcttagaagaaatttctcttaacatttctgtgattaaaatttttagtttaaaaacccagtctgattttagatgtctccaaactgttacattttcatttttcttattaactgatcaacattctaaatatttagtattctctatagctaaagtactgcatatactctagacacattcagaaagataaaaataaataaaagttcctcacatgtattctggtgacttcaatgtgtgtcatgggcaagggctatggaaaaagaaaaacaacaaaaacagactcctaacggtctgtcttaacttcagtcctgggctcttaagtcagtcagaaatttagagatatgcaatgcttaaaaggctgaacctcaagtgacatctaagacaactataccatttatggcataacaacttggtcctaggacttttggtttaaacagaattttcaaagcaaagcagatactctcccccagttcttatttgggattctattttggaatggagatagggctacgcccagacacaggccaaggcatatctgttatggtgattacttcagcatgacaaagtcaagcagaggccctaggtcaaagttttgcttcagtaacttacttgcctctgtaagtaatagagggctatagtctcaaaaacaaataaatacatgaaatctacagaatggatcaggacataagtaggtaagtaaaatcattttaaagagacaggagtcccaggcaaacaggacttaaaggtgccttgaatgaatgaatgaatgaatgaatgaacataactaaagaagaaacgtcaaggctgagaaaaagaaaagcctcagagggaaatgttggcagtgcccattcaagtacagcctttgagaattttggttgctctagaaaaaacattaccaaatgtagaaagaaatgtcaggggttgcagcaaacagcatttaagaattcccatctataggcatgaccattcctactgtgagatagatagatcaggttatctcagcctaatgcccctgagcatctgattcctctaaaaccttttaatctcatggtcactaaataactttctaattattatgtggcttttaaaattcatttgcccatggaaataatataaaatccaatgaacttgaaatatttaggtctctgtgataatgatttctcattgtaaattaataatctattcagctttaaacattagcctcatggtgaaaccctgtctc

SEQ ID NO: 174209 - DNA, 2526 bp, Homo sapiens
ggttgggccgggccggttgctaagacttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcgattggcttctccggctggggcgcgtgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctccaagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaaccccccccacccctcccccgccgtgtgtggctcctcgccgcatcgttggggttttgttatgtgaaaatatcctggaaataaatacatgtttctgcacttagaaaaagg

SEQ ID NO: 174210 - DNA, 420 bp, Homo sapiens
cctaagagggacctgatttaagaaacaagcccgccaagcaaaggcagcagttccgactccagcagctgggaaaggaaggaaagtgaccccactttcactcatgcacagcccactggtgaccaaaaccaccgtgcaagtcgggatgacagcagggagttctggccaggtgggaaaggtgcctggaagcgggatgcgcctgtgcgtatcttgaccatgatgttggtgtgggcatgttactcttggtgcagcgtcgggtgttgctgaaccgacaggctctccagctggagtccatggagaggccagagggtgggcgcccccccacccctcccccgccgtgtgtggctcctcgccgcatcgttggggttttgttatgtgaaaatatcctggaaataaatacatgtttctgcacttagaaaaagg

SEQ ID NO: 174211 - DNA, 2478 bp, Homo sapiens
ggttgggccgggccggttgctaagacttggcgaagcgctgcgctcgcgcccggatccctcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcgattggcttctccggctggggcgcgtgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctccaagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaaccccccccacccctcccccgccgtgtgtggctcctcgccgcatcgttggggttttgttatgtgaaaatatcctggaaataaatacatgtttctgcacttagaaaaagg

SEQ ID NO: 174212 - DNA, 757 bp, Homo sapiens
ggttgggccgggccggttgctaagacttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagctgtctttccaacgcacactcctccttcatctggtgtacctggtccgaggtggagtctgg

SEQ ID NO: 174213 - DNA, 2472 bp, Homo sapiens
ggttgggccgggccggttgctaagacttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcgattggcttctccggctggggcgcgtgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctccaagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaaccccccccacccctcccccgccgtgtgtggctcctcgccgcatcgttggggttttgttatgtgaaaatatcctggaaataaatacatgtttctgcacttagaaaaagg

SEQ ID NO: 174214 - DNA, 544 bp, Homo sapiens
ccagagtctcctctcttactagctttggggcctctctgggctccaccatcttggtcttggtctgtacagtggggatcacatgagcaccacctccccaggttctccggctcatggaaggagtgagtgagcacagggaccgctccagcagcaactctggatagtgacgtttcctgccattgctattctctgccctggagacggatgggcggttaggtggggcggggtggctctgagctagcggatcccactaagggtaacagatgcctgccaagcactttccatccctgtgggctgtgtcctcattcccaatttacagacaggaaaaccaaggctcagggaggccctgtgacgttcccaacgccaggaggcccaggagggcagatctcaaagccgctggcctcacactgcccttgaccctctgctggaccaggggagaggctgaggatgccggccccgccccggctccgcccccgcagcagcagggaggagccggcagccttgggaatgctggcgggtggggtggaggcggtgggagccgcggccg

SEQ ID NO: 174215 - DNA, 135 bp, Homo sapiens
gggcaaaaaagtaaggaataaagattaaattcacaaaacaagttggtatctttaccttttcatgactgtgatccataaatccaactaaatcagttttttcaagtccattccaatttaactcatcttctctggatc

SEQ ID NO: 174216 - DNA, 495 bp, Homo sapiens
ccaggcatgaggagctgattgggaatggtcatagtcagcattttccatgactgatgaccacattgagatccaagtggagacaaacttttcctttctctgttccaggcttttaggctccttatcaacacaagaatggacatcaagttacttacatattgggccaaaatattgagtgcagatgaaaataaatgctgactttgaagatttcccatccagcccgcagaaattcccctggcctgccacacttgggtaacttgagttctggaattccagacgtggttaaccccaatccacaaatttgctggagttatgaagctgagtgagagtactgcttttctattatgcattcccaatatgttctgttctgagctgacaccacagaatttacttctcccacaagtttaacccactgcatggagtgatcatggctcactgttttttggtaaataccaaaatacagataacagtttttcacagtacaaattttatatctga

SEQ ID NO: 174217 - DNA, 378 bp, Homo sapiens
accaggtgccttgggaaggtttctgtgcaggtgctgctctgtgcaagaacatttattgtagttgttttggctgaggttgaggattttttgtttggcttttgtttttaaatgtgagaggtaaattttgcaagggattaagcctaatgacacctagggacatctggttataaatattacctattttcctgaaggaaaaacctattcagatgctccctggcatggatctgttaagggcatgtaggctcctccctcattcatctcctttgcccgtcaaggaggagagtggaagactcttttccacatctgagtccttaagggggccttaagatggtctaggacaagagttggtaaatttttttctataaaggacacgttagt

SEQ ID NO: 174218 - DNA, 347 bp, Homo sapiens
acattgtgaaccctaggactcagggagtgtagtcctttcaccctgtttgcacctctctaagtgaattaccttaccccaattcattctccttgttttttgctcagtattttaatcaatttaataagccatgtggtttggtcattttaatttggtctgaaagcctttctgttcctcgacctctgggatagctcaccagttagtgcttccactgcatcaaggcaatttcccacatattgcattctcagctaatgtagtgtctttctgtattgaaagaagacttgggaaggaggcaaatgcttctcagcatcataatactaaggctatcatttttcaagtcaggtcaaagt

SEQ ID NO: 174219 - DNA, 453 bp, Homo sapiens
acacactgtgtttaactgcgtgtaatgaatctccagtgtcactttctcagtccctctccctccttgatctttatgaccttaacattttttgaagactgtaggatagttgtcttataaaatgtccctcaatgtatgtttggtgttacctcattactacccttggtatgcgtgtttggaggaaacagaagtgctgttgtgcccttctagctgcaccccataaggtgacacagggtgtcaatttgtcccatcattggtggtggtcacttggaccctgaggcaggtggtgtcagccagtctcccctggaaagttactctttgtccctttgtattggataaatattttatagggagatattttgagccttcgtaaatatcctatttctcatcaaagtttggcccattctttttagtaaacttccatctgagccctgaggatgtcatggtttccaggtt

SEQ ID NO: 174220 - DNA, 345 bp, Homo sapiens
aaacccagaaggcatgtttttcaaatagatgaatgacacagaatgcagaagggagagctgatacgtgggactccagaatcaagatccgaaacacctttcagattggaatgatgggatgaaagtaaggagatggatcttaacagaaacaaatggaaagtcttgcactgaggttccaaaaaatcgattctgtaagtacaggctggggaacacttgacttgatgtaggttcagatagtaacggttagagttgataacaagaggatcttagggtgtcttggctggctgctgaaatgccacggcaagatgctgaagatctttcttgagctgaattaaagttagattccaa

SEQ ID NO: 174221 - DNA, 453 bp, Homo sapiens
gcaataaatgttattgctgcaagcagaaagtgtctgggttggcaccacctttaagagctgtaacactgactgtacggtatgtggcttcactcctgaagtcagcaagcccacgaacacacctggaaagacgagcaactctggatgcgccacctttaagagctgtaacacttgtgcgggtattgacatttggcccccccgagcgggagatcagtgtttgcctaccagaagtctggtggcagaattgcgtggaagctgctggcgcctctgtgaggcagtggggctcccagcactttcttggctgatgggcagttctagatttagggtgaggcaagtgaggcactcaaatgggggtatcagaaatccagtaattaggataagtaacatttaatgccatatttttaaaaaacaaaaatcaatacagaaaattcgtgatgaatacagtgtggaaactga

SEQ ID NO: 174222 - DNA, 384 bp, Homo sapiens
atatatttcatagaaaaaaaaaatggagtctataggacagaaactccttcatcttatcgccgccaaaagaaaagaaaacacatacacagattcagtcatcctctcattcttttattctgttgaagtagataatagatctttgctcctaacaaaaagatcagtccttgtcaacattgcgatgaatccaaactctccaccctccgtctatctctcattcattataaaatcaactttcttcccgacttcacattgccttttagcttctgctctttctactccgctccacagtcaagcaccgcaaaagagttgtctactttcagaccttctcttgctaaaacctttaataacttcccttttgccaaatccaatggatgctttgtttct

SEQ ID NO: 174223 - DNA, 502 bp, Homo sapiens
tctgcaggctgtgcaagaagcatggtgccagcatctgctgctagtgaggaccgcaggaagcctcctatcatagtggaagatgaaggcgggccgacaagatcacgtggtgagcaacagacatgccaggttcttctaaagatccagctctcatgtgaatagagcaagaattcactcattaccacagggagggcaccaagccattcatgaggcatctgcccccatgacccaaacacctcccacttggcctcatctccaatattggggatcacatttcaacacgagatttagaggggacaaatattcagactatatcagccccctcccctaactcaagctggggttgcacctgtttcaacccagagaataccatgcaggtgacatccctatgatttctttttttgtgtgttgttttgagatggagtcttgctccgttgcccaggctggagtgcagtggcacaatctcggctcactgcaacctctgcctcctgggttcaagcaattc

SEQ ID NO: 174224 - DNA, 585 bp, Homo sapiens
atagccttgttggccacatgttatgtcttcttttgaaaagtatctgttcatgtcctttgcccacttttgatggggttgtttgtttttttttcttgtaaatttaagttccttgcagatgctggatattagacgtttgtcagatggctaggttgcaaatattttctccctttctgtgagctgttcactctgttgatagtttcttttgccgtaaagaagctctttagtttaattaggtcccatttgccaatttttgtttttcttgcaattacttttggcatctttgtcatgaagatcatttccaggtcctatgtccgcaatggtatttcctaggttatcgtccaaggttttaatatgttttcattttagatttaagtttttaatcctgcctttgcctcccaaagtgctgggattacaagcgtgagctaccacacccagcgaggaagccaagtttaacgtgtgtgctccactcctccaacctggccaaagggcagtcatcatcactggccactgctgaccacagcctttagaaactccccttgaacgtgctgggctgaccttcctctgatcacaggcaaggtaaccata

SEQ ID NO: 174225 - DNA, 209 bp, Homo sapiens
tgtatcagttaggatgctctcagatacaataatttaacttgtaagcaaaccaacttgtccaagattcaataacagagtagtggctgatgtaaatcaagagtccagttgttggacaggatctgtggttggttgatctagcatcttgacaatgtcatcaatgacccagtttctttccatctttctactgtgtagtccacagtatcaatttc

SEQ ID NO: 174226 - DNA, 269 bp, Homo sapiens
gcgctcgcaagtggtcagcataacgccgggcgaattcggaaagcccgtgcgtccgtggacgacccacttggaaggagttgggagaagtccttgttcccacgcgcggacgcttccctccgtgtgtccttcgagccacaaaaagcccagaccctaacccgctcctttctcccgccgcgtccatgcagaactccgccgttcctgggaggggaagcccgcgaggcgtcgggagaggcacgtcctccgtgagcaaagagctcctccgagcgcgc

SEQ ID NO: 174227 - DNA, 508 bp, Homo sapiens
cctggcacacacacgtttacttttaaaagctgctggcttatagctctttctgtgcctttggtcttttgggtgacattctggccgtgtaacttttatccgtcccttgacttctgcatgttaactaagactaagagcatattcatagccaactcctgtcaagtgttaactatacaatagctactgcacatatattacttcatcttccctaaaccatagagagtggttactatcactgccatttttaaagatgaggacccagactcacagcttcaagaccattaccaaggtcatagaactagaaaatgtcagagctgataggaaaatctaagtgtgtctgtttgacttggttgttctattttaggttagctcgtaagtgttttataaaagtagtcactcctccagacaatgaaagatttattgtcaagaaaacatctatctgaagagtccgatggggcctgtacttagtatatctggctccaaatcagcatttacttatagacttcatgca

SEQ ID NO: 174228 - DNA, 203 bp, Homo sapiens
ctttactggcccaaccagaaacagaaactaagaacctgtgactgtattctctccttcggacactcctggacatcctggggagttcaggctcctgagccaagcaaaggctgaagttccaggaacatggaggaggatgttccttcacaagcccaggaacgtggaggacaatgtcaaagaatcgaggaattcccagcaatggcttc

SEQ ID NO: 174229 - DNA, 176 bp, Homo sapiens
ctgtacttagacattaagccctcatttcgtttcacaaacttcccaccaatgatctaacccagcaagattctgtccctgcatgggcagccccagctacctcagccccgtctgtgtccacctcccaccctccagtccattcccttggcctcctccatctttctcatgcccatcatgca

SEQ ID NO: 174230 - DNA, 514 bp, Homo sapiens
atctgggagcagttctgagagacaagccccggatggctgggcactgaacagccgccctgcgagatgagctgccctggctttttcccctatcaagggcagagactgaattctttttaactgtgtcaccaagcccagggcatacaagaggtactcaaaaacgtgttcgccgacaccctgattcctatttatactgaccattacacaacatgtttgcttagagcccagcaaagaattttcagaatgtttcacgtctatctccccacattcaggagagatagtcacacaagatgacaggctatagggacgctcaaaagagccataatcaccaggggcacgcgggttccccagcgccagcagcccaacgctccaggctccagcacgccacaaaaccttgcggcattctctaaagtaaaaggactgattttaaaatgataatcgtcattcttgcgacagccccaggaagcctggctcctgaggtcctgagcccgcgtctttctttgccccaccgcggccg

SEQ ID NO: 174231 - DNA, 1286 bp, Homo sapiens
  misc_feature (23)..(23): n is a, c, g, or t
  misc_feature (63)..(63): n is a, c, g, or t
  misc_feature (72)..(72): n is a, c, g, or t
  misc_feature (76)..(76): n is a, c, g, or t
  misc_feature (96)..(96): n is a, c, g, or t
  misc_feature (114)..(114): n is a, c, g, or t
  misc_feature (117)..(117): n is a, c, g, or t
  misc_feature (121)..(121): n is a, c, g, or t
  misc_feature (133)..(133): n is a, c, g, or t
  misc_feature (141)..(142): n is a, c, g, or t
  misc_feature (150)..(150): n is a, c, g, or t
  misc_feature (152)..(152): n is a, c, g, or t
  misc_feature (156)..(156): n is a, c, g, or t
  misc_feature (163)..(163): n is a, c, g, or t
  misc_feature (174)..(174): n is a, c, g, or t
  misc_feature (176)..(176): n is a, c, g, or t
  misc_feature (180)..(180): n is a, c, g, or t
  misc_feature (189)..(190): n is a, c, g, or t
  misc_feature (201)..(201): n is a, c, g, or t
  misc_feature (205)..(205): n is a, c, g, or t
  misc_feature (214)..(214): n is a, c, g, or t
  misc_feature (230)..(230): n is a, c, g, or t
  misc_feature (238)..(238): n is a, c, g, or t
  misc_feature (241)..(241): n is a, c, g, or t
  misc_feature (249)..(249): n is a, c, g, or t
  misc_feature (254)..(254): n is a, c, g, or t
  misc_feature (257)..(257): n is a, c, g, or t
  misc_feature (259)..(259): n is a, c, g, or t
  misc_feature (265)..(265): n is a, c, g, or t
  misc_feature (268)..(268): n is a, c, g, or t
  misc_feature (271)..(271): n is a, c, g, or t
  misc_feature (274)..(274): n is a, c, g, or t
  misc_feature (277)..(277): n is a, c, g, or t
  misc_feature (283)..(284): n is a, c, g, or t
  misc_feature (295)..(296): n is a, c, g, or t
  misc_feature (310)..(310): n is a, c, g, or t
  misc_feature (315)..(315): n is a, c, g, or t
  misc_feature (318)..(318): n is a, c, g, or t
  misc_feature (325)..(325): n is a, c, g, or t
  misc_feature (334)..(334): n is a, c, g, or t
  misc_feature (340)..(340): n is a, c, g, or t
  misc_feature (346)..(346): n is a, c, g, or t
  misc_feature (349)..(349): n is a, c, g, or t
  misc_feature (354)..(354): n is a, c, g, or t
  misc_feature (362)..(362): n is a, c, g, or t
  misc_feature (377)..(378): n is a, c, g, or t
  misc_feature (382)..(382): n is a, c, g, or t
  misc_feature (385)..(385): n is a, c, g, or t
  misc_feature (388)..(388): n is a, c, g, or t
  misc_feature (391)..(391): n is a, c, g, or t
  misc_feature (395)..(395): n is a, c, g, or t
  misc_feature (402)..(402): n is a, c, g, or t
  misc_feature (406)..(406): n is a, c, g, or t
  misc_feature (418)..(418): n is a, c, g, or t
  misc_feature (426)..(426): n is a, c, g, or t
  misc_feature (429)..(429): n is a, c, g, or t
  misc_feature (433)..(433): n is a, c, g, or t
  misc_feature (445)..(445): n is a, c, g, or t
  misc_feature (451)..(451): n is a, c, g, or t
  misc_feature (471)..(472): n is a, c, g, or t
  misc_feature (474)..(474): n is a, c, g, or t
  misc_feature (476)..(476): n is a, c, g, or t
  misc_feature (515)..(516): n is a, c, g, or t
aaaaaaaaaaagtaaaaaaaaangaaggaaacggaaaggaaaaaacagaaaaaaagagcaaanaaaacacanaaancacggaacggaaaaaacacncagaaaccggaaaacaanganaacngaagaaaaaganaaaaaatnnaccctgtnancaancggcgcngcaggaaagancntggnaatgccgtnngggtgtgtgantctnggcgaaaanaagaaaaaaaaaaagnaaaagganganaatgaaanaaaanaananggaaanganaanaanaangaagannatagtgaaaanntccgggccaagganaaganganaggaaanaagcaaaantgcaanaagtancanaaganggaaggangcaaggagcggaaannagcnaanaanganaaangcatccncaanaaggagaagcancccaaaanccnaaancaggaggaagtntttgtnaaccgcaaagagtactttanntncntggagcaggccaaggggagggaggagtatgactggatcnnggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatagtagtatatcgcgaggcgcgacacagagcatggggtcaagggggttggagtgggtggtggagcgagagcggcgtgatcgctgcagaagaggccatctccgcatgagatggatgtctggcaatgctgcttctgataagaacatcaaggatggtgtctgtgcccagattgaaacagaactttgccagtgccaagtggaagaaggctgtccgagtgacacaccctcatgaaacggctccgggcaccagagcagtccagcacggctgcagcccagtcggcctcagccacagacacttgcacccccggggctgcagaccgtagtgccacccagccacagatggaagtgcc

SEQ ID NO: 174232 - DNA, 140 bp, Homo sapiens
tggtccgaagacagaagagggacttcatgattttaggatttctgaggtagaggctgggttgatatctatgatgcaacctaggaaaacttaccatgcctccctgttaaaggcagaataatttaatataaagcaaaggctta

SEQ ID NO: 174233 - DNA, 367 bp, Homo sapiens
cagctttcagaaagctctgaactatgtacgggacaccgcgggggaagtgcggtggcctcacgtggctggtgcagatggccctttgtccccttgaggacatcaacttcaactttcttccacccccagggtatacctttctcccccagccacactgtgggctgcagagttctagagagccacagcctcccgctggcctggggcagcctccgtccgtccatctgtctggcctgaggaccaggggccggtggtgggcggcgggacacagcgcctgctcagcaccgcctgctgggcgggggtttgtaccccgtgtctttcacagctgagagaagtatcagtgcacgatccaacccctaagcagcttagatta

SEQ ID NO: 174234 - DNA, 551 bp, Homo sapiens
tcggtaccggtaatccgtacataattgatcatgattgatttccttacctgtagacttctgtggggatagagagaaacaaacatggagttctgaggccaaacagactgcagttcaaatcctagttctaccactaaatagttggatagccttggattaaaaacaaacaatttagagcattgtaaattgttcagtaatttatgaacaattttctctttttcccctccaattcttgcctaccatgactctcggagccactaacagaatggcctctttcacaagccatgcctttcctaaaacttcctgccaccgaaaaggtagggctggaattccttttcttccttaaagtccttcatgccatcaccttgtcacttccaatctctcagattttcccttcactcaccaggtaggtttattctatatcacatttatttttcaatgccttccttcaattcttttgatgagttagctaaaggaaaggaactgagggagagaaaaggagggaagaatgggcatttttcctctcaagtgagagattacggcatgcttaagtg

SEQ ID NO: 174235 - DNA, 278 bp, Homo sapiens
gcataataccttcaccatggtgatttatttacacatcttacctgtaacggtagagtataaattccatgaggggaaaggaaatgggaaagacttaagaaataattttctcctcatccactatctttcatacatttctttttcctgcaaacttttctatagccaatgaaagcttcattaaggagaacacatttgccctggcagagcaggtccttaaattaacaatgccatcagctccttcccactgacaaagggtccctcaccatgcataaggcaattct

SEQ ID NO: 174236 - DNA, 713 bp, Homo sapiens
ccgattcaaactgagcgctcacatctgggtgatcgcgcggggagggaaaggccgcgtcgcgtcccggacacgccagggctgtttccacagtggccacagatactgcgggcgcgccatgatccggggtcacccccgaccgttctttgttcgccccggaacagcgaatcccgactgcggagatagggaaactgaggtccgggccccgcacagtccgcggccggctgcctacagctgggaaaactgaggcctggaccttgtacagtccgcggccgcccgcctacagctggggaaactgaggcctggaccttatacagtaggcggccgcccgcctacagctggggaaactgaggcctggaccttgtacagtccgcggcctctcacctacagctggggaaactgaggcctggaccttgtacagtccgcggccgcccgcctacaggtggggaaactgaggcctggaccttgcagtccttggccgcccgcctacagctggggaaactgaggcctggaccttgtacagtccgcggcctctcacctacagctggggaaactgaggcctggaccttgtacagtgggcggccgcccgcttacagctggggaaactgaggcctggactttgcacagtccgcggccaaccgcctaaagctggggaagctgaggtccgggccacacacagtccacggccatccgcctacagctggggaaactgaggc

SEQ ID NO: 174237 - DNA, 147 bp, Homo sapiens
gtcattgctctccattgagtccactggatgaacttgcttcttgctccatctcagagtccataagaatatgtctttgcagaggacatttaggggagggaatgtgttaccaattcatttccaggcctcagatctcaactaaggtgtttt

SEQ ID NO: 174238 - DNA, 177 bp, Homo sapiens
tcctaagtaaaactacatatagaaaaaagttcaccaactaagaaatacaaattaaaagggcaagtgctgtgtcacagttgggaaccgggtgctgctatatattgctaggggtgggggaatattaactggcacaacctttctggcaaattaaaatgccttaaacaagcccattgaccc

SEQ ID NO: 174239 - DNA, 373 bp, Homo sapiens
tacgtggctcgggagcccctgaatgaatgggcttggcccaacttaggggcgcattccgacgggagagtcctggctgtattccgaggctccagtgcgcatgcggagtcgatcccgcgcaggcgggcggggacggcagccgggtcttgtgggcggagcctgactaagtgccgcccccttgccggctgcagattgctatttctgccccccaccctcgcccatccccccgcgagctggactgcgccaaggcttctgtgagccgcttggggccggccggggcggggcctgcccgacccgggtttggctggcgggcccctaggaatgctctcctccccgcccccggcccaaagtgccacggtggcggtggtggcggccg

SEQ ID NO: 174240 - DNA, 210 bp, Homo sapiens
atgatcttggtgaggacatatatcttggcgcaaccctgagtagcaaaagacgaagactaattacctgacagagctcccctccactcgcctgggtcattgaaattaatttctgctttcaagcttggcagaaagcagctgcagaatttcagttcaatacttaaattaacggggagccgaaattatttctgtgcacaggcagtattagaggag

SEQ ID NO: 174241 - DNA, 640 bp, Homo sapiens
tgggtcactctgtcacccagtccggagtgtggtgcgcaatctctggccactgcagcctcagccttcctagctcaagcaatcctcctgcctcagcctcacaagtagctgggattacaggtatgtgccactacaccctgctgatttttgtaattttttttgtagagatggggtttcaccgagttgcccaggctggtcttgaacttctggactcaagcaattctcctgcgttgggcctcccaaagtgctgggattataggcacgagccaccacatccagccccttgccagttttgagtatcttcaacaattcttctatgttgtcctaacttttcttaagatttaatcatccagttcaagccagcaattgggcaactactttaaaactcatttgcaaagtgacaaatgcagcatcctagctacagataataaatactttgaactaccaactcatattgcaaagattgctaagtgtacatttgaagatattttctggtgattctgacagactgagattttaatatccttggggtataatcatcagggactaatatagatgagaagatgcacaaagatcttcattaaagggaatttaagtaagtgaaacattccaatttaatatcggggactgatattactgtaaa

SEQ ID NO: 174242 - DNA, 483 bp, Homo sapiens
ggagtgggaagaagtgatccccgagggccctttggaaggccccctgggaccctataaactgtcctgggtttaagacaatggaacccaggatgagctgacaatggaggggaccagggccaatttgacaggctgggatccccaaaagggcctgatcgtacgtgtgtgtgtctccagtgcagttggctgtggaccctggagtcagccactggtggtctcttctcatgaccatgcaggccagaagggccctcctcacagccgcacatcctgggtacctgtggtccttggtgtgctaacggccctggtgacggctgctgccctggccctcatcttgcttcaaaagagaccgaaagagacgtggtttgggcaaggctttgacagtgtcatttcccggggagagccagccattcacttctgggcagcccggtccttcaatcaagaaaggcccaagtgcatcgaggccacattggaaagcttgggcatcaa

SEQ ID NO: 174243 - DNA, 259 bp, Homo sapiens
ttttttagagaggaaaattcataaattgattgatgttgtaattaagtgtaacagttatttattctaggatgaattcctgttttgaaactgcttaattctatccaatgaccacagactttgcatctctaactgcaactatatattcaacaattagtcatcttcacagaggaaataaaaccaaagagtgcaataagaacagcatactttcatctccgctcttgatttcagataaagagccatgttcaaattacacctctgt

SEQ ID NO: 174244 - DNA, 419 bp, Homo sapiens
taggtccctgcagctgccacctccgcagggctccctctggctgcacgaggccccgctagagaaagctcagaagggcagggaagtgagccgtccacttgactgcaacttgaaaaggggccaccattgtcctttggcgcccctccctcccagcaggaccccaggccccacctctggaccaggccccacacgttccaagacaaagacacccccatcggaagccccgaggaatgctagatgccgctgagagggttcaagggctgctgtgtgctttccagtaagttggaaacgcctcggagaggctgaaactggcaaactcacaggcctgggccagagcttccacccgggtaggggtgggcccccaagagggtgcctctcagcagagtggagcccgatccaccgaggagagcaggaggcggccg

SEQ ID NO: 174245 - DNA, 479 bp, Homo sapiens
ctgggccaaagaatttctctccttccagcacattcccatggggctcaggaattagatgagttaatacacataatatgttttgaacagtacctggtgcagagtacgtactcagtgaatgttgagtgttcttaccatggttggccgaggtgaggatgaacgtgaggagggcaaggctctgccaacaggtgttggagaggcaggtgcatggcctgctcagggtggagctgtgtcggttccttggtgctgataggcgtcagctgctgccaggctttgggagaagactcctggtatctaggggttagacaagaaacacaccccaaagacctggtgagagctagtgtggtggcgttgctgcagatccaagcttaaggaagttgctcatgtgtctgttacagtagttaaattaccagccagtctgctgccaagggtttgtaaatacttgttttttggcggggggcggggggtgggatttaagggtg

SEQ ID NO: 174246 - DNA, 243 bp, Homo sapiens
aacttcacttttttcatctcataagagggggccatatgatctgcctaccttcctggggggccgtgaggattggctgaggtcaagggtgggcctgcttcgtaaactgcactgttatcattgggatctgggacggagcctgaataaacgtattcacactcgggctttagtgtttaataagacttaaaacaacaataacaaatccctatcgaactatgtgcattttaagaggggacaaagctctaa

SEQ ID NO: 174247 - DNA, 786 bp, Homo sapiens
cacaactggaatttctatcatattgtgttaaattactacttctagaaattcatgtaaatgaaatcaaccagaatgtgatgttttcagaatacctgaaactaagcaatggataaagaagaaaaacgtatttcatgtaattctggaggcttgggaaatcaaggtcaagagggaacatctggtgagagccttcttgctgacagagtctgtcaccaggctggagtgcagtggtgtgatctcggttcactgtaacctctgcctcccaggtttcaagcaattctcctgcctcagcctcccaagtagctaggactacaggcatgcaccaccatgcccagctaatttttgtatttttaatagaaacaaggtttcaccatgttggccagggtggtctcaatctcctgacttcgtgatccacccaccttggcctcccaaagtgctgagattataggcgtgagccactgtactcagccatatctttttaattcgcgtattaaattccatttggaattcatattcatgtttgaaattaggaagaggtttaactatatacacacacaaaacacacattgacatatatttacaaataaacaattgtataaattcctttattgaaaaactcgtattttccaagttggttgagtcaccattatcatatattaaatgatcatacatgtatggttctgcttatatttatttctctacactaggtagaatatttaataatgttggaacagataccactgtcttgttctggccttattaaaaatgtctttatactcgagaagcaat

SEQ ID NO: 174248 - DNA, 496 bp, Homo sapiens
tggggagctggaaacggtgtcaaggttgactgagccctgcttctagtgtgagaaaacccagcttatattcaaaacggatgccagggcaacatcaaagcataggaattcactacattcacctgggcctgcacacctgtgctcacttgcacacactgtcttcagggtgttacgggcagaggtcaggacttcattagccaagtagcctctaactgggcctcaccctcggtaggctttggtctcctcatctgtctgggaagggctgaccttggaagcctccaagggctcatctctggaatacgatgttataagcacagattctggagtcagcttgcctgagtatgaacctctgctccaccccttactagctgtgtaatgctgggtaagttactcagcttctctgtgtctcatggtcctcatctgcaaaatggggataataaaagaacctacttcatgagagttcagtgatgattaaatgagttaatatatctaaaaatca

SEQ ID NO: 174249 - DNA, 435 bp, Homo sapiens
gcaggggaccagacctcctgggtggcctccatcaccactaagtcacttgggcacctggagaaatggcaaaggtcccaaacaggaaaccaagattgggaagtgagggccctagaattagaatcttttggggtctatgattgtctaggtcagcagttcccaaagtgtggtctgaggatccctgtggttccctgagcccttttcagactgtccttttctaactgcaaagctccattaggctggattttcttcaaccaaaacaatgtatcacaacgcattggatgcccaagcccctatgaggaagcagctgttttcaattaagccagatattaaagaggtttgcaaaaatgtaaaaacgatgccacttttctccctaaacttttttgtttgttttggaaaatacggttattttttaataaaattgtgctatcgatgtta

SEQ ID NO: 174250 - DNA, 895 bp, Homo sapiens
ggtgcctgcttctccttctgccatgattataagtttcctgaggcttccccagccatgcgtaactctccttcccatttatgagagagccacatgacatcagcccatagactgtggagagtattccagatctatcacattctgcgattctgcgattcccagaaggctggtcatgaaaaaattccctcttcagtttacatatatggcagtgctccagtgccatgacagttttaatcttctggttccatctgcatagatttcagtctctaattgaggaaaatcatctgtttttctcaggagccccttgattcaagtttacacaaaatgtgcctttggagactatcctgttaatttaaacagttcagatcccacttgtatgtgagacagatgcttctctggccatcagccaggtaccactaaaggaggtacaggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccaggaaaattataccattagcaagactggcatcagcaagtagttcgcagtgttggttgttcttggtttcgcaggattttataggagatgagaaacaggcacaggttaagtggttctgaattttccatcgggtctggagccgcagatggagttgggcccaaatggctgttggatgggtcctccatttggtcccgtcaatgtccatatggggtggtccccgggtctgcatattgtttcctcacaggtgcggcacgtgtctgcgcaggcccgttggggagtcctgaaaataagagccgaaagggag

SEQ ID NO: 174251 - DNA, 531 bp, Homo sapiens
ggtgcctgcttctccttctgccatgattataagtttcctgaggcttccccagccatgcgtaactctccttcccatttatgagagagccacatgacatcagcccatagactgtggagagtattccagatctatcacattctgcgattctgcgattcccagaaggctggtcatgaaaaaattccctcttcagtttacatatatggcagtgtgtcaaggtgtcagctttgaaggccactcttgtgtggagacggtgctaccaactgactggagacaggatgtgccctttggataggggaccgcataactcaacatccaaactgggacactgttattatttaagcaggacaacaggaataagatgagactgcttattcaaactgggatttacagtcactttacttagggccaggtccacatcctgccttgcttgcttgttaaggaatcttgtcacaaattatttagtttctctgaaccacagtttcctcagttgtaaattgggcacaataatgccaacttgtaagaattagagag

SEQ ID NO: 174252 - DNA, 1705 bp, Homo sapiens
  misc_feature (1653)..(1653): n is a, c, g, or t
  misc_feature (1694)..(1694): n is a, c, g, or t
  misc_feature (1697)..(1697): n is a, c, g, or t
  misc_feature (1700)..(1700): n is a, c, g, or t
  misc_feature (1702)..(1702): n is a, c, g, or t
  misc_feature (1705)..(1705): n is a, c, g, or t
accagttgctaagaagttgttaccaagtttggtgaataattaaactcttggacatgacaggggaggagaattattgattcaaaggaccttagagctcaaaaggtcctgagagaccatcataaccaccctctttattttacagatacagcttctgaggatcacggggatgaaaggcatgaactgggctcacacagctaatgcattaggacaccagaaaaggaagaaaagacagtggcagctgaagacatttcaggaatgcttcactgagaacctaagtcttgttctgggccataaagaaaaggggagggtgtggtttctataccagagataagaaaggagaaaattggacgtggaggaaagatatgagtaccaatccgagcgaacaaggaagagtgagtaaatctgtccagctggagttggagtgaaaaaggtgcctgcttctccttctgccatgattataagtttcctgaggcttccccagccatgcgtaactctccttcccatttatgagagagccacatgacatcagcccatagactgtggagagtattccagatctatcacattctgcgattctgcgattcccagaaggctggtcatgaaaaaattccctcttcagtttacatatatggcagtggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccaggaaaattataccattagcaagactggcatcagcaagtagttcgcagtgttggttgttcttggtttcgcaggattttataggagttctgaacactgggaagtccaagagcaaggcaacaacagattcaacatctggtgagagctactctctgcttacaagatggcactttcttactgcattctcacacagaagaagagaccagtactgtgtcctaccatggtggaaaggcaaaaaggagccaaacaggctccctcaagaccttttcttttctttcctttttttttttttttttgagacggagtcttgctctgtcgcccaggctggagtgcagtggcgcgatctcggctcactgaaacctccgcctcccaggttcaagcaattctgctgtctcagcttcctgagtagctgggaggacaggcatgcgccaccacgccctgataattttttgtattttagtagagatggggtttcaccatgttggccaggatggtctcaatctcttgaccttgtgacccgcccacctcgacttcccaaagtgctgggattacaggtgtgagccaccgcgcctggccctcaagaccttttataaaagtactaatcccattgctgaaggcagagacctcatgacccaatagcctcttaaaggcctcacctcttaataccttcacaatggggattaagtttcagcatgaattctggagggaaacaaacattcagaccatagcaattaccaatctttaaggggctactgccctcaaattgcactcaatttacatcgtatcaattgctataccacttaatggacattgttttcatcatataattttttttctacttttctctgctttnttcttgccattattttttagcattgctattgaatatatgcnttnaancntcn

SEQ ID NO: 174253 - DNA, 2088 bp, Homo sapiens
  misc_feature (2036)..(2036): n is a, c, g, or t
  misc_feature (2077)..(2077): n is a, c, g, or t
  misc_feature (2080)..(2080): n is a, c, g, or t
  misc_feature (2083)..(2083): n is a, c, g, or t
  misc_feature (2085)..(2085): n is a, c, g, or t
  misc_feature (2088)..(2088): n is a, c, g, or t
accagttgctaagaagttgttaccaagtttggtgaataattaaactcttggacatgacaggggaggagaattattgattcaaaggaccttagagctcaaaaggtcctgagagaccatcataaccaccctctttattttacagatacagcttctgaggatcacggggatgaaaggcatgaactgggctcacacagctaatgcattaggacaccagaaaaggaagaaaagacagtggcagctgaagacatttcaggaatgcttcactgagaacctaagtcttgttctgggccataaagaaaaggggagggtgtggtttctataccagagataagaaaggagaaaattggacgtggaggaaagatatgagtaccaatccgagcgaacaaggaagagtgagtaaatctgtccagctggagttggagtgaaaaaggtgcctgcttctccttctgccatgattataagtttcctgaggcttccccagccatgcgtaactgagtgaggacctagaattttaatgtctaatatgcggtgtgaattaaagaagcggccttgctatgctgaccttttcaatattctaatctttgctttgctgacctctcaggcctcttcctggcaacagttaggcttttgagaggagagagagctgagactgttggctccttcccatttatgagagagccacatgacatcagcccatagactgtggagagtattccagatctatcacattctgcgattctgcgattcccagaaggctggtcatgaaaaaattccctcttcagtttacatatatggcagtgctccagtgccatgacagttttaatcttctggttccatctgcatagatttcagtctctaattgaggaaaatcatctgtttttctcaggagccccttgattcaagtttacacaaaatgtgcctttggagactatcctgttaatttaaacagttcagatcccacttgtatgtgagacagatgcttctctggccatcagccaggtaccactaaaggaggtacaggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccaggaaaattataccattagcaagactggcatcagcaagtagttcgcagtgttggttgttcttggtttcgcaggattttataggagttctgaacactgggaagtccaagagcaaggcaacaacagattcaacatctggtgagagctactctctgcttacaagatggcactttcttactgcattctcacacagaagaagagaccagtactgtgtcctaccatggtggaaaggcaaaaaggagccaaacaggctccctcaagaccttttcttttctttcctttttttttttttttttgagacggagtcttgctctgtcgcccaggctggagtgcagtggcgcgatctcggctcactgaaacctccgcctcccaggttcaagcaattctgctgtctcagcttcctgagtagctgggaggacaggcatgcgccaccacgccctgataattttttgtattttagtagagatggggtttcaccatgttggccaggatggtctcaatctcttgaccttgtgacccgcccacctcgacttcccaaagtgctgggattacaggtgtgagccaccgcgcctggccctcaagaccttttataaaagtactaatcccattgctgaaggcagagacctcatgacccaatagcctcttaaaggcctcacctcttaataccttcacaatggggattaagtttcagcatgaattctggagggaaacaaacattcagaccatagcaattaccaatctttaaggggctactgccctcaaattgcactcaatttacatcgtatcaattgctataccacttaatggacattgttttcatcatataattttttttctacttttctctgctttnttcttgccattattttttagcattgctattgaatatatgcnttnaancntcn

SEQ ID NO: 174254 - DNA, 2110 bp, Homo sapiens
  misc_feature (2058)..(2058): n is a, c, g, or t
  misc_feature (2099)..(2099): n is a, c, g, or t
  misc_feature (2102)..(2102): n is a, c, g, or t
  misc_feature (2105)..(2105): n is a, c, g, or t
  misc_feature (2107)..(2107): n is a, c, g, or t
  misc_feature (2110)..(2110): n is a, c, g, or t
accagttgctaagaagttgttaccaagtttggtgaataattaaactcttggacatgacaggggaggagaattattgattcaaaggaccttagagctcaaaaggtcctgagagaccatcataaccaccctctttattttacagatacagcttctgaggatcacggggatgaaaggcatgaactgggctcacacagctaatgcattaggacaccagaaaaggaagaaaagacagtggcagctgaagacatttcaggaatgcttcactgagaacctaagtcttgttctgggccataaagaaaaggggagggtgtggtttctataccagagataagaaaggagaaaattggacgtggaggaaagatatgagtaccaatccgagcgaacaaggaagagtgagtaaatctgtccagctggagttggagtgaaaaaggtgcctgcttctccttctgccatgattataagtttcctgaggcttccccagccatgcgtaactgagtgaggacctagaattttaatgtctaatatgcggtgtgaattaaagaagcggccttgctatgctgaccttttcaatattctaatctttgctttgctgacctctcaggcctcttcctggcaacagttaggcttttgagaggagagagagctgagactgttggctccttcccatttatgagagagccacatgacatcagcccatagactgtggagagtattccagatctatcacattctgcgattctgcgattcccagaaggctggtcatgaaaaaattccctcttcagtttacatatatggcagtgaaaagacaagaggaatcttggcctcaaaaactgatatccatcataagatcatggtgaaatacagtctgaagcaggtccagagtgagaagagaaaagaatcacagaaatggggctggagtttcaactgtattaagccagaagactacctgcctccaaactttcaagaagccaacaaagttcctgactgtttaaactaatttgagttggatttctattgcttgtatctaaaagaatcctaactggcacttctagatatctgttgaggcctggaaggggcaaaacaattcaggaagcagttgaagataaaggggtttaccatggaagagaagatccaggtgccttcatggaaatgcttgtggttgaaaagagatgaagatgagggtccctggaaagaggaagaaccagccaggaaaattataccattagcaagactggcatcagcaagtagttcgcagtgttggttgttcttggtttcgcaggattttataggagttctgaacactgggaagtccaagagcaaggcaacaacagattcaacatctggtgagagctactctctgcttacaagatggcactttcttactgcattctcacacagaagaagagaccagtactgtgtcctaccatggtggaaaggcaaaaaggagccaaacaggctccctcaagaccttttcttttctttcctttttttttttttttttgagacggagtcttgctctgtcgcccaggctggagtgcagtggcgcgatctcggctcactgaaacctccgcctcccaggttcaagcaattctgctgtctcagcttcctgagtagctgggaggacaggcatgcgccaccacgccctgataattttttgtattttagtagagatggggtttcaccatgttggccaggatggtctcaatctcttgaccttgtgacccgcccacctcgacttcccaaagtgctgggattacaggtgtgagccaccgcgcctggccctcaagaccttttataaaagtactaatcccattgctgaaggcagagacctcatgacccaatagcctcttaaaggcctcacctcttaataccttcacaatggggattaagtttcagcatgaattctggagggaaacaaacattcagaccatagcaattaccaatctttaaggggctactgccctcaaattgcactcaatttacatcgtatcaattgctataccacttaatggacattgttttcatcatataattttttttctacttttctctgctttnttcttgccattattttttagcattgctattgaatatatgcnttnaancntcn

SEQ ID NO: 174255 - DNA, 1219 bp, Homo sapiens
accagttgctaagaagttgttaccaagtttggtgaataattaaactcttggacatgacaggggaggagaattattgattcaaaggaccttagagctcaaaaggtcctgagagaccatcataaccaccctctttattttacagatacagcttctgaggatcacggggatgaaaggcatgaactgggctcacacagctaatgcattaggacaccagaaaaggaagaaaagacagtggcagctgaagacatttcaggaatgcttcactgagaacctaagtcttgttctgggccataaagaaaaggggagggtgtggtttctataccagagataagaaaggagaaaattggacgtggaggaaagatatgagtaccaatccgagcgaacaaggaagagtgagtaaatctgtccagctggagttggagtgaaaaaggtgcctgcttctccttctgccatgattataagtttcctgaggcttccccagccatgcgtaactctccttcccatttatgagagagccacatgacatcagcccatagactgtggagagtattccagatctatcacattctgcgattctgcgattcccagaaggctggtcatgaaaaaattccctcttcagtttacatatatggcagtgaaaagacaagaggaatcttggcctcaaaaactgatatccatcataagatcatggtgaaatacagtctgaagcaggtccagagtgagaagagaaaagaatcacagaaatggggctggagtttcaactgtattaagccagaagactacctgcctccaaactttcaagaagccaacaaagttcctgactgtttaaactaatttgagttggatttctattgcttgtatctaaaagaatcctaactggaaaaaagaagttattgccagaagaagaaagaagaggagaagaaagaggtgtcataaactttctaagacagtgccttgcctgaagactatgagtttctgtgcatcctaggacctttatggaaattagataatttttgatgaagttaaacaattatattataagaaactcctcaaatcaagaataaataaaaacaagagtagcattaaaatttactgcagagtacattaatacagttcaaatctaaatgtctgctcttgcatttctgtgacttttcatgccatgctgaaaatctggaatggaaactctcatccatcttggtgatttcctagtgccctgagg

SEQ ID NO: 174256 - DNA, 609 bp, Homo sapiens
gagacagagttttgctatgttggccaggctggtctttaactcctggactcaagcaatccgcccccgacagccacccaaagtgccgggattataggcatgagccaccatgcttggctgagatttgtatctaaatatataaaatcttcatcctaagccctataggggtaaggagacaaaaaagaaatgtgatgtgaccttccacgtggctagtctgattcctattatcccctccctaacttcttacccttggtggtccctggggcctgaggcataactgactaactatgtggtcagaactctgggtttatctaaccaatgagctgcagtttctggtcatacagccctgccagttttctggatgcaaaactgctcacatactaaacacctttctgaaaatgagcatggtttgggataaagctatagccattggtaatggtgagggggtagcctgagagggggttgcttagaagtacagagcaagacatagttggggaaaggaccatgggaaggacaagaggcctggaatttttccttggcagtgccctgtaatcattgtttcctaaaataccagctctgattttaaaggcattggggtcaaaagggaagatt

SEQ ID NO: 174257 - DNA, 240 bp, Homo sapiens
atctagattatcagaatcaaaggtgaaattttaaacttcaacacttttaagcttaaacacaaagcactagatttctctgctgccctctaatgtttaaattttaagtgtgatttatgtttacataactcagatagatttaagttccaaatcattctgaaatgaaatgaggccatagatgatgaaattttaaaaacacagatatcgggccgggcgtggtggctcacacctgtaatcccagca

SEQ ID NO: 174258 - DNA, 433 bp, Homo sapiens
tggggagtgttgtggatggatcctggcaccgagggctgggatatcctctcaaatgaatgtgaggtgcctcccagtgctggagagagcgggattcaggaagcagtggaagggaagagcctgggatatggggatcagctgtctgtgccctgctgcattctggaataaaaagttactagctcgattgatcatttttaaatttttagctacatatagtatgtgggcctccatttgtcctcttatcccaggccttgcagaatttaggaataagcctcaatacagtgttctaacccagtgacttccgcctcgatgtacagtagattgaacctgatcctttatactttagtgatcattagttgataccagttcaagtcaggctttctagaaatctcattgtatgttaggggttcgattagagtacagtcatgcatcactt

SEQ ID NO: 174259 - DNA, 497 bp, Homo sapiens
ggccagcatcatcctgataccaaaacctggcagagacaccacacacacacacacacacatacacacaaacccagaaaatcggcagaagacaaggatgccctctctcaccactcgtattcaacatagtgttggaagttctggccagggcaatcaggcaagagaaagaaataaagggtattcaagtaggaaaagaggaagtcaaattgtctgtgttgcagatgacatgattgtatatctagaaaaccctatcatctcagcccaaaatctccttatgctgataagcaacttcagcaaagtctcaggataaaaaagcaatgtgcaaaaatcacaagcattcttatacactaataacagacaaacagagagccaaatcatgagtggtgggtgagagagagaaggagagagagagtggggacctgtgggactaagccatggacgtgatcccttgggccttcctgtgggggttgtggattgcacatgcaaggggaagagcttat

SEQ ID NO: 174260 - DNA, 147 bp, Homo sapiens
taaggcctttgagttccttgggttgtattgttgaaagggttgttttttctttttatatttaatattctttccttgaggcttaagtcagcatgtgctgacttagtaatgacttcacttttaataaattcttcctcatgtgaggattaa

SEQ ID NO: 174261 - DNA, 263 bp, Homo sapiens
cacgatatgtcactggatcgcacggctccagttgacgcttcccaatggctcctgtgtcgctctcaggaaaagccggggaattattgcgtgccctggcctccttgcctgcatcctctgctctcctccctgcaccctcctctctctggctgcactgcagaggcctcccctggggtatcagttgaggcaggctggggtgtgctgtggtgaccatccctactcactgggccttaaaacagaaaggggcatttctcattccagcttca

SEQ ID NO: 174262 - DNA, 209 bp, Homo sapiens
aactctatgctttcctgggtagaagaatgtttcatctaaaagcttgatagcagatattttcagaaaagatctatctacaagcacctgagtgagtattctaactcagcctaggagcactatcccatcagggggaaaacactacagggtgactgtctcttggaataatatatttaaaaatacaacgcatttaattgtaaaagagtcctttc

SEQ ID NO: 174263 - DNA, 261 bp, Homo sapiens
acagcatgggagaagaagctgtggagagtttctatgggaaatttgggcactgaaattcggacctgcccatgtgtactatggaatttcagtagccatgcacatgctgagtgcagagcacattctcagaatagacctgagaaaggatgctgagctttcatctgtggctcctctccatcctccctgcaggcagggagtaaagcctagggcaaagctgtacacagactgggccgggtgcggtgcctcacgcctgtaatcccagca

SEQ ID NO: 174264 - DNA, 639 bp, Homo sapiens
aaatggaactttagctttcctgttcccaacagcttatgaaaacctcaacaagtatcttattgctacagctagactccaaaaagatgtactttgagttagaatctagaccccagattccaggaccacttaaacagcctgctccttttcacctgctggtggcagatgtggccttggtgtttagaaattagttgcgcatccactgaagagacaagcagaaagtactaccctctgggagagtgttatagcctctctggaaactgagatgaacatgtggggtggggggcagaaaatgcccaacctagttctttagatacttaaaagctaagaataacaaccccaagagagggtctgaattcagctgtagacagcaacttttggttgtcctgtttcttaatacacagggaagatcaacacatagttactgtgggccaggtcctgccgtgggcacagggatacaacagtgaacaaagcccctgcccatatagaatgcacttacaaggtgccaagcgtttggccaaatggtaggttcagaaataagtgggatccgtcctgttttcagtagaggagaacacaagagaaagacatatttgatccaacccaggagtttaaagaaagcttcctgaagacctctgaagctgc

SEQ ID NO: 174265 - DNA, 679 bp, Homo sapiens
acatttgatgagcccaagttcaatattcatcctgacccagatttcaaagataatgtacttaaaatattacagaatttgaaagtgatcagttatctcctccgcttagaaatgtcatcgctggcagtgcattggtgggtgttaggggctattttggtgcctgggtgttcagaagaggaggaagagagggtggagagattaccaattcagtaacctcctcacgacttttgaggctaagtcaatgcttgtcttgaatgcctaatccaaacagctgtgagttgtggaggtgtgttaaaatggtgacaaaaatagcaactgctttcttttactgggcacctacttaggaccttggacttaacgtgacttctctctgatttccaaaacaacttctcaagaaattttattttggccaggcacagtggctcacgcctgtaatcccagcactttgggaagccgaggcaggtggatcacttgagcccaggagttcaagaccagcctggccaacatggtaaaaccctgtctctactaaaaatacaaaaattagctgggcatggtggcgcacacctatggtcccagctgctcgggaggctgaagtgggaggattgtttgagcccagaaggttgaggctgcagtgagctgcgatcgcacactgtactccagctaagcgacagagacccatctc

SEQ ID NO: 174266 - DNA, 347 bp, Homo sapiens
tactgtactgtgaatattttctgtaattgatttttcctgtaacagttactctgtattatgaaaatggaatttacggtgaggggccacttctcatttgctaccatacttaatttctggcaatttcactagcagagtaaaagagcccgtgtttcatgctcagaatgcagtgacatggtagacatacttactgcagtttcatgttcggtgagatgagcctacttgagaatgcaagacagacatggtggctcatgcttataatcccagaactttgggaggtcgaggcagaaggatcgcttgaggccaggagttcaagaccagcctgggcaacatagcgagacctccatctc

SEQ ID NO: 174267 - DNA, 287 bp, Homo sapiens
tggctctggaaagtttaagactgtaattaagtgctacttaactgaaaatgtcacaatggaaattctcctaggaaacctgagagaagaagcaagaagaggaaactgcatatatggaggaagtaacaggtggctagaggtcaaagactgcttgtttgcagtgtccttttttggtaaactgtatttttgggtggaacaggaaagaaagtgtgaaggcttagggtctcttggacttaatgtaataggaggctctacagtcttaatctgatcctccttctcccaaccacctg

SEQ ID NO: 174268 - DNA, 2313 bp, Homo sapiens
cgaggtggggctcggcgacgagggcctctacacctgctccttccagacccgccaccagccgtacaccactcaggtctacctcattgtccacgtccctgcccgcattgtgaacatctcgtcgcctgtgacggtgaatgaggggggcaatgtgaacctgctttgcctggccgtggggcggccagagcccacggtcacctggagacagctccgagacggcttcacctcggagggagagatcctggagatctctgacatccagcggggccaggccggggagtatgagtgcgtgactcacaacggggttaactcggcgcccgacagccgccgcgtgctggtcacagtcaactatcctccgaccatcacggacgtgaccagcgcccgcaccgcgctgggccgggccgccctcctgcgctgcgaagccatggcggttccccccgcggatttccagtggtacaaggatgacagactgctgagcagcggcacggccgaaggcctgaaggtgcagacggagcgcacccgctcgatgcttctctttgccaacgtgagcgcccggcattacggcaactatacgtgtcgcgccgccaaccgactgggagcgtccagcgcctccatgcggctcctgcgcccaggatccctggagaactcagccccgaggcccccagggctcctggccctcctctccgccctgggctggctgtggtggagaatgtaggcgcaacccagtggagctcacctccccctgcagggggcctcaggccaagagtgagagaaacgggggagcaagagccgtgggtctcgtgggggcagaagagctctcggccaccaaggaagaagagagaggagaagaggaggaggcagaggaagaaagatcttcagagaacccatcactgtgagggataacgcaaaattatgcatctttctacagccattctcgccacccgttcacgtttccgattgtgacccactcccgccaccccatacccctctctcttagctcaggctgtcaactggcttgtgtgggtgtgggtgtgtgagtgtgagcctgcatgcatgtgtaggtgtctgtgtctctgtttgtgtgtgtgtgggggggtgggctgggggaagggactcagccgtcctcccgcccccaaaacccccatgtccactgtccccaaccctattgcctctcacctctggctggaggtaggtatgaggctctgcagtggaagctgtgaagagaggcttaccaggctccctgcttccccaatatatgcacgcacactacccctccccctgtcgaaagggcaactcctggcaggttgggagtggggaggggcatcgcactcacctgtcaagctgtcattcagcctttgtgagtaagtgggggacctccatctaggctctgggcttccctgctgtcaaccaccagcttcctgtagccagaggccccatcgctggctcagtggcctgagaccttcccacttttcctgtccctccacaccctggattttctggccccctcctgggccaatcggtgcttccatccaactgtcagactggtggcaggagtcacctgtctgtttcagtgctttgccctacccttgccaccactccccttggccttgatttcccccacctgcggcaccagccagctgcccttggggcctttgcagctggcccacaggtgtgagcttgctggtctatcacttcctggcctctccaccaactgtacctcccaaaggctacctgaccgccctcacagacactcagacgcaccacacacacatacacacacacagacacacacacacacacacacacacacaccagcgactgtgaccagcaatagccccctggctccagctgtccggtagctggtgactagctgtatttccccctgggtaggcatctggtgtcaggaagggacgctgagaggccgcagcctcagctctgactgtaggaacactccaccctggtacaccacaccacacaaagtgggggacagagaggcatcacacagacatcctgagcccagacaaagatgccatgtcaccaactccgactcccaggagaccctctatataaacacccaccccaaaccacaccacccagagtctggtggagaaaaggagagggcaaggcgcagtgactgtacctcagacgggggcatgggccccatcccacattgtcttccattcccagggtccaggggatggggtgggacaggggagggatgctagggagggggtggggggccctgggggccatgtgttccaattcatggggagtgttgagaccaccacaccaataaacgcctttttccaaaatctg

SEQ ID NO: 174269 - DNA, 832 bp, Homo sapiens
tcgggacagaaggcctcctgcaagaggccagggacacaccagaccaagaaggcagcacctatgagcagatcccagcttgctggggtggcccagccaggccccacatcctggggccagtcccacatatagcccatgggtccatggctacaagaggatctcagggaccccagagctctcagagcctgggaacacctatgaacagatcccagcaaccaagagcaaggagactggacggacacacaagcctgacaagcttcggaggctcttcttcacgtacaggaagcacaaattctgagggcctggcatccggcagcccaccagtgggtttcctggtacccaggccatgccaggggttatcgcaaaggcctcagctcacttgaaggcaccctttggatcttgagactcatccagcctgctacagaactaggctccgagacagccgaggtgcctgcctgagagcaggtggaagaggaccttgcaggtgcctgcagctcctggctatgtcctgctttccttgtgcctcccatccatgcacaggagggactggagaggaatgagattggccaaaggcaggggtcaccacccccatttcccagataagcatgctgaggcccaggcagactgactgaacctgctcccactactgagcacttaccgaatgtgtggcaggctgtgtgctagcacagacacctttctaactggccaagtgacatcatgcaattgctaccgagaacaaaaccagttcccctccttgcggccccatcagcgaaaaggaggggagggccagaagccacatcctctgcttcaggcctcttcgctccagctgtaccct

SEQ ID NO: 174270 - DNA, 321 bp, Homo sapiens
caaaaaggcactttcaaattaaccacattcaggtattctattttatcttttccataatacttttctaccatcactctacatccaaccctatttatataatgtctttcaatggttcctgctgagtctggactatgccaagtggtacttctgcatcactgttcaaagtaacccttttacctttaatacagtaatacactatggcttcatgaaattgaagccattctttaaaatcctgttttacttacacacgttccatgaagcattccctgatgagcctagctcacggtaatcctttccttcttcaaatttctgtttttttat

SEQ ID NO: 174271 - DNA, 214 bp, Homo sapiens
gggggcagtgataacaagaaaagaatcgggctctgtaacacctcttcctacagacagtagggggtggcagtacatatggcttacagtcagaacaaaacaggaagacccaacagaattctctttattctcctctggccctttcctctgttcttcagccccaacagcttctcaaggtaagggacatatctacagaaaagactaaaacccaaaatca

SEQ ID NO: 174272 - DNA, 456 bp, Homo sapiens
gtgtctctttgtcttggcaggtggaagcccctctgcttggaatagcaaacaatactaccagcttgccctctggcaagctcctttaagagttagctgtaatttcaccctctctctggccttgattctgcatgcagaatgattgcactgacttgagctcctgtggtctcttgctatacctcctatttgggcatctcccccatattgctttcccccaccattggggaggggaatggtaccttggttatctttgaattcccaggaggtggcccagtgcctggtgcataggaggagctgaagaaacggaagacttcttaaagggatactcgccattcactttgaagcacttctttgtacaacaaatttattttcatctgatcattgcacctctgctagccaaaacattttatcacaccagttactgctgcatggaacttgaaagcaataaaattttcttta

SEQ ID NO: 174273 - DNA, 333 bp, Homo sapiens
gtgatcaaagaatattttctataagacttcaatccttttatatacgccaagatttattgtacagctcaacagagagtttatcctagccaatattctatattaactttgagaaatatacattctacttttgttaggctaagttgattgacaattttgctctagacttttaagcatttatggattttctttatctgcctgctcaatgaataacataaagagatttgttgcaatttacaattacctatgtgtatttatttctccttttagttctgtttagttatttccatgtattttgaagctctatttttaggcaagatgcatagaaaatatctg

SEQ ID NO: 174274 - DNA, 474 bp, Homo sapiens
tcataagggccaacactagtgtacaccaatctctatttttaaaaataataaaataaggctgagtgagtggctcatgcctgtaatcccagcagcctgggaggttgaggcggacagatcgcttgaggccaggggtttgagatcgcgccattgcactccagcctgggcaacaagagcgaaactccgtctcaaaaataaaaaaagaaagaaagaaaaggaactcccgcagaaaccagtagtcctgacttggtggaaggaaatgtacaggcatctgactggtagagaacggagcctactcttccaggggcgcccatctccagaacattgtgtctcccagaggattaccgactgatctcatgattttgttggcacttgccaaagttctcttcttttcctctgggttctgttgcctgcctatatgtgtgccctctcttgtacccagagttggcctgtcccaaattctttccctctatccca

SEQ ID NO: 174275 - DNA, 321 bp, Homo sapiens
cccgggaggtggaggttacggtgagtgagatcgcgccattgcactccagcctgggcaacaagagcgaaactccgtctcaaaaataaaaaaagaaagaaagaaaaggaactcccgcagaaaccagtagtcctgacttggtggaaggaaatgtacaggcatctgactggtagagaacggagcctactcttccaggggcgcccatctccagaacattgtgtctcccagaggattaccgactgatctcatgattttgttggcacttgcttcacagaaccgcatcccagtgatctgctgtgcctacactagtggagggtaccgagc

SEQ ID NO: 174276 - DNA, 184 bp, Homo sapiens
ggggaggctgtgagaccctgcccctggagatgggaagtgtgggggtcgagtcacacagttaggccccccgcacggggagagccccagcttccaggtacaccaggccccattttttgttttgttttgttttgttgtcgtttggggttgttttgagacaggatctctcactgtcacccaggctgga

SEQ ID NO: 174277 - DNA, 336 bp, Homo sapiens
tatgtagaacatcctggagaaattactgagatactgagaaacttgctggagagaaagctgctttttcggcttcctactatgtaaggaatttaaaaaagaaactaagtaaaaaaagcaagcctagttcacacactgaaaagggcgggctaagatcgccatctgtaggagaatcgcttgaacccaggaggtggaagttgcagtgagctgagatcttgccactgcacttcagcctgggcaacaagagtgaaactccgtctcaaaaaacaaaacaaaaataagaaataataccctttgcccagtatcctctaatgatgcagaagtacacaataatatcac

SEQ ID NO: 174278 - DNA, 734 bp, Homo sapiens
gcctcagcctcccagagtgctgggattacaggtgtaagccactgtgcccggctgatggaagaattcttaaatgactcgttctactttctgctggtccaggcactccttggcttggggcagcatcccaccagtttctgcctccatcttctcaatgcttacacctacctggttgcctctgtcttcacacccattcttctgtgtgtgtcttttctcttcttcagattatgatatcactcagatcagattaggactcatcctaattcgttatgatcccttgatcataacttaaatgcatttgcaaagactctatttccaactatgttcacatttatagctaatggggctcaggatttcaacgtgtatattagggggaacaagtcaatttatgacagtgtctacaagaaaagtatgcatagaaatacatttaaccaaatacaaaaattaggtgggtgtggtggtacacgcctgtaatcccagctactcaggaggctgagacaggagaatcgcgtcaacccaggaaacagaggttgcagtgagctgagatcttgccattgcactccagcctgggcaacagagtgagactctgtctcaaaaaaagagaaatacatttaaccaaagagatgcaatacgtatacattgacaattttaaaatactgctcaaagaaataacaaaagacctaaatgaggaaaaagtcatcccagtatcataaatcaaaaggcttaaaattagttat

SEQ ID NO: 174279 - DNA, 491 bp, Homo sapiens
gtttggctctatgtccccacccaaatctcatgtccagttgtaattcccacatgccaagaaagggacctagtaggaagtaactggatcatgagagtggtttttcccatgctgttctcatgatagtgagttctaacaaggtctaatggtttaaaagtgtatggccagtctcccccttgctatctacctcctgccactagataagatgtgcctcgcttccccttcagcttctgccataatcataagtctcctaaggcctccccagccatgcataactgtgaatcaattaaacctctttttttataaattactatgtctcaggtagttctatatggcagtgtgtaaacagactaatatgctgcccaaagcaatttacagattcaatgctattcccattaaactactactgacattcttcacagaattagaaaaaactattttaaaattaatatgaaaccaaaaaagagcctgaataaccaaggcaatcccaagta

SEQ ID NO: 174280 - DNA, 166 bp, Homo sapiens
agtctttggctacaacgagtaaagtcactataaacacttgccagaggtttctggacgaacaggttttcatttctcgtgggtagatacctaggagtgggattgctgggtcacatgtgtggtaagtatatgtttaacttaaaccatccaactgtttcaggaatagctt

SEQ ID NO: 174281 - DNA, 422 bp, Homo sapiens
ccctctcctttctcttataaagataccagtcattgaatttaaggcccatcctatatccagcatgatttcatctcaagatccttaactacttacgtcttcaaagccccagtttccaaatgcgttcacattttgagatgctggatagacacgaactttagggaacatattcaacccactacaggtcctgagcactaagccttgtgggaggacactctggaagcaggtccagacttccccggtcttgcctcttcagaacctgcgcactctccacctccaaaaggcccttctatcagtcacttacacctgagtataaaactaagcatgatagctgtgcaattttgaccaaccctcccatgttcatgagtgtaggtgttggggaacaggctgtgtctccacttggggaactcacagcttcaggggca

SEQ ID NO: 174282 - DNA, 268 bp, Homo sapiens
gtgcatctaaaattaacttattatccatgaggttaattgtatcttgttagatacaaacaaatgtccatgttccttttttatatgagtcctgaaatattgtaaaattatacaacagaacctggaggagtaggtttgattgtatttgctgtgtttcacctcatagctaaccatggtagcatctttcttctagaatactcctgttctgattttatgttccctttttgtagtcatcagatccagaatgtaaattattttacaagtacatcta

SEQ ID NO: 174283 - DNA, 280 bp, Homo sapiens
agttcaatatgattttaagtaccacctgcatgattaggagatatgatgtatctggttaattttttttaataggagtaatttaatgcttatttaatacagcttgctggacaaaatttttcacaaggaattcatccaagaaaatgaaataataaaagggctcatgatgttgagaaggttgggaaccaggacttgaggaatttacagcacaagtcctcatggagcccagaaccagatacaaatcacatctggtggtccctctgaggatggcaaggcaggtggg

SEQ ID NO: 174284 - DNA, 615 bp, Homo sapiens
tatgcaacttcatagtacttcttaaaaatcaaaaaacatcttgggaggcagtactgataccggagagaacacatttgctgatgttgactttgtaaaccaaaacttacaaggaaaccacagtgctctctgtacatcagaaacccaaaggaaagcttcccatgcacatacaaagctataattcctttacccagtgaccacctaaaatgctgaatctacaagttttgtgttagcgctttggtgaaataactagccaacagggggaaatacataggatgtttaggatttaggctggccctttcatccctgcccaaacaaatcctaattcctaggttcctggggaactccaactacctctaaattaaaccagcttcctctgtggctcacattccttctgtccaccgtattggcaggatgctgatgggcctcagaatggacttgtggcatgaagtatgaatacactctggcctagattttcactgatttgcccagatattttcattataatattcaccagaatgaaactaatcgagtcattctgcactctctgaaaaccttaaggcaggaaatcacagagcttaaaatgggataggaacactgctttgcctactccccagg

SEQ ID NO: 174285 - DNA, 258 bp, Homo sapiens
ctgctaaggcagggccctggggtctagcaagagcctgatgagctcagaagtcaggagctgcctgagtctgaacttgagtctgaacttcttggctgtgccactgtggggattttttccccttctctgtgtttcagcttccttctgtaaagtgggggtgataacattttaaaaacagtctaacatgtaatacaaactcaagaagtattgtttatctctgtcagtacttccaagactccttttctcccaggagtgtggcct

SEQ ID NO: 174286 - DNA, 793 bp, Homo sapiens
gcgctaggtagcaggctgggtttacttattttcaactcccgagtggctagacaggaaaaagaaagaaatgatgtgaggaaagttgggaagctctgcacagtgatccctgagagccctggcaccactttaggagacgtggtaggtcactctgtacatgttcttcctcagcaaggggggttttcccaaaagggacacaagaagaaatcttactcagtggagtaaatggaaagaagagggagcatgtctgtctggttccttcctatttctcctttcctcagagtcaagtttcaccccacagggagttcacgcttccatgttgcctcatccagcccttcaggaagccagagtctgtgctccagtgtggcatttcagccaacctagaaatgaagggtgacttagcacagagaggttcaacaagtggggcatgcaggccactgatctctgcaagggcagcagtgccggggtgctctgggatacaggcagtgccttcggaaagaagggcaattgaagacagttgagaaggtgaacaaagtttacatctaacaaattttaaagttttattatttttatttttatattcttggggtctcactattttgcccaggctggagtgcagcagctatttgcaggctgaatcccactactgatcagtactggagttttattttatttaattaacttatttattttgagacagagtcttgctctattgctcaggctggagtgcagtgttgcgatctacggtcaataagaagactccaggtcaatgactgtcactcactctgaaaaggaa

SEQ ID NO: 174287 - DNA, 922 bp, Homo sapiens
gcgctaggtagcaggctgggtttacttattttcaactcccgagtggctagacaggaaaaagaaagaaatgatgtgaggaaagttgggaagctctgcacagtgatccctgagagccctggcaccactttaggagacgtggtaggtcactctgtacatgttcttcctcagcaaggggggttttcccaaaagggacacaagaagaaatcttactcagtggagtaaatggaaagaagagggagcatgtctgtctggttccttcctatttctcctttcctcagagtcaagtttcaccccacagggagttcacgcttccatgttgcctcatccagcccttcaggaagccagagtctgtgctccagtgtggcatttcagccaacctagaaatgaagggtgacttagcacagagaggttcaacaagtggggcatgcaggccactgatctctgcaagggcagcagtgccggggtgctctgggatacaggcagtgccttcggaaagaagggcaattgaagacagttgagaaggtgaacaaagtttacatctaacaaattttaaagttttattatttttatttttatattcttggggtctcactattttgcccaggctggagtgcagcagctatttgcaggctgaatcccactactgatcagtactggagttttattttatttaattaacttatttattttgagacagagtcttgctctattgctcaggctggagtgcagtgttgcgatctcggctcactgcagtctcgacctcccaggctcaatcgatcctgccacctcagcctctggagtagctgggactacctgtaggtgcgtgccaccacgcccaggtaatcttttattttttgtagataccagttatcctatgttgcccaggctggtctccaactcctgggctcaagcaatcctccca

SEQ ID NO: 174288 - DNA, 524 bp, Homo sapiens
agtccatgcagaagagagaataatccaagcttttcaggccctttctgacccatcctgaaaccaaaggtaacgacctttgaattacacgttgtccataatcagtgtcccccaaggatcactgggcagtcttaggagaggtgcttcctcccacagagaggccccctgcctcccaggacaggctcctggagcccaacacctgtgagagccgcagcacctctcttggagatctaagaaatccctgaaggaggctcggcacagtggctcacgtctgtaatcccagcactttgggaggccgagcagacagatcacaaggtcaggagttcgagaccagtctgaccaacatggtgaaaccccgtctctactaaaaatacaaaaaatagccgggtgtggtgctgtgcgctatagtcccagctactcaggaggctgaggcaggagaattgcttgaacctgggaggtggaggttgcagtaagctgagattgcaccactgcactccagcctggtgacagagcgagactgtgtctca

SEQ ID NO: 174289 - DNA, 152 bp, Homo sapiens
caaagttcaagctcatcttttgcatcatttgtgaaaaatagttttactgagtagaagagggtttttagcataatttcaaggggaatggctatataatttgaaatgtcaaactcctagccatcagaattatatgatgttttgaatatattttt

SEQ ID NO: 174290 - DNA, 760 bp, Homo sapiens
tcttctcccttcatccacataatcaattattcaccaagtgtacctaagtaagcctttcctaatcctcttcttataccagaaaaattaaaacactccagagtttttcttccaatctatgtctgcctcatatacagtcatccacactgatgccagggtaatcctggaaaaaaaaatatgatcaggttacccctttgcttaaaactcttcagtggtttcctgtggaatcttcacatactgtccaagccccttgtgtgtcatttaagaattcttatgcatgtaccataacattcttttcttttccagattcatctcttattatctgtaacctgtaatacagttgcactaaattatctgcagtttccaaagcatgtcatactgctttacttttctacaatgtggttctgaaattttgtgcatgagaaccatctgtagaaccaggtacacagcaggcttttatgccctgtgcccaggggtttttacgtagtgggtttgagttggcactcaaagatgcacattttaaacaacaactccagatgattaggatgtacatcctaatcatcatcgcactttaaggaatttacatcgcactttacatcgatgttacatcgcactttaaggaacactttttttaagccttaccataagtttctttctttgaaaaaaatatcattccctccttgcaactatttggcaagttgaatcttctccttgttgatgaggtattccttgcccaacctgaagcaggtttaatcatttatcc

SEQ ID NO: 174291 - DNA, 746 bp, Homo sapiens
aaatgtgaaggaactccttcagcagatatatttttaaaagcatttaaaactgaggtttagagaaatgaggcaatttgcccagcaacacaaactgaatgtggaacagacttcaaagacaggaatgctgactcccactgcagcacatagctctgcctctcagccaaactcccagggcagctcctcattaacatcctccagcccatccaccatacagctgctggagtgagatttgtaaaacacagatctgaacatggtccctcccagctagatgcaggcttcactctttagtcatgaagacacagtcacctcatttcaatcaatgttaagacccagcggctagcacagggcctgccacggagcaagtgtgggtaagcatttcttgcctgaatgtaataagtgctggctgtacatctccttcttaggcagccttgtgatggaggcatataaaagtgactatgggacagtcctgcctgccctcccgaatttcacaggcaagttgggaagatgtgattcaccacaatgtaatgtgtaatgacagaaatgtttggtggtagggcaagagtagaaagcagagaggttgatttcaaaatggaatattaaaacaagaagttaattaatgcagtgatgagaggaagacttttctattaaccttttagaaaacaaaattgtcccctagcagatagctctttcccttttcaagcttgctgcctgttatcagctgaataatattcccccaaattcatatg

SEQ ID NO: 174292 - DNA, 552 bp, Homo sapiens
tgttgtgaggcaggagacgggcctgtagacgcaccgggaggatgagcttgtcctggcgatgccgagttaagcacattctgggcctggacaggctgcaaaaggcaaaagctgtgcctggaaaagtcgccatggggcatgagcttggcctaaagaggccattgcaaggcaggagctgggcccgtagaggctgccgaaaggcaggagctccgcctgaggatgccacagtgagacaccatctgggtctggagggtccactgtgaggcagaggctggcctgtagagtccgacagtagacagaagttgagcaaaaggctaatttcaggaagttttgggcttcaagagtcagccaggaggcaggcactaggcctggaaatggcccgacagtcatgagttgggcctaaatgggccactgtgagggaggagctgtgcctgttgaggctgctggcaggcaggcagaaacttggcctggagcagcttccatgagacaagagctgggcctggagaagcccctgagaggtaagaggagggcctgcagaggctgttctcaagtcaa

SEQ ID NO: 174293 - DNA, 459 bp, Homo sapiens
gactgctgatgatgacaatttcatgtttcatgtgtatttcgtaaactaatctcactcctggctttctatttactttcttatccttatgttcctttaccttcctttttgcatttatcaaataaattttacccagctacactgtttgcatctttgtaagccatctcaaatcttttctgaaatagagtagtaaagaaataaacacatcaaaatgttttcaagtaggcttcaaaatagcccacagctgcggaccctttcattagactgtgtattttcctaagcaaactattctccaagaaacagaaaacattgcccttctttgtaccttagtaggagggaaaatgcttttatattctaaattacacaagcgttccaaaataatttggggaaagagaaagatagttagggcccagcaggataaaggaagaaagcaatgattctttgcacattcatgaatacatg

SEQ ID NO: 174294 - DNA, 398 bp, Homo sapiens
aacacatgatcaaagctgaacaaagttcattgtaattttgcaaacagatatttggattttagttaagctgtgtttaaagtgtgctggaacttcatttgattaaaagtagcccagttggttagacaggatcttatccacagtgagaccatgttcttgtaggaacacatggcaaggcaagggtccctgcccaccaatggcatggatggtgacctctctcctgtgctggcacctaatgtgccaggcaaaactggcatgggggcagctctcatttctcttgtgtacgtgaagcttagcttgacaggtggcacacaagacaagctttttgaaggccagaatgaatacatgaccgagttaatgagttaataaatgattctttgaaatgtttaaaattattacaa

SEQ ID NO: 174295 - DNA, 436 bp, Homo sapiens
ggcaaggaagtggcaggagcctatagactccaggtagaatcaggataggagattacaggcagagagtgatgccccggctcacttcgtgggtgatgcttgagattgcactcctgagcccagcagacattagtcctggagcttaagccaagtggtagggtgctcagggctacagacttgtatgggaagagtgagaagtgacattcagcaaaggttgaggtgctggaatcagagagtggaggcatagtctggagtcagtttgaggaggaaccagcagggcaagagggtcctctgttgatgtttgaaacaagaacatatattctcagaagattaaggcggtataactagaggcaaaccagaggagaggagttggagaccagttgagaaggtgtcacagatgagaatgtgccagtctcagtagcactgggaagtaagttag

SEQ ID NO: 174296 - DNA, 684 bp, Homo sapiens
tggagtagctgggattacaggtgtgcaccaccacactcaactaatttttttgttttgtttgtatttttagtagagatcgggattctctatgttggccaggctggtctcgagcttctggccttaaatgaaccgcctgcctgggcctctcaaagtgctagtattacaggcatgagccaccacacctagtcgagtcagcagttttctgagtccagtttttccactagagttttggaaattcttacccagtccaatgttataatcataagtttattaggcccttctattccagactacttgtcagagtcatttccatgaatcttgaagaagcaatttggggcaatagctgattgcaaatgcttttagagaagaaccaaaacactattgatgagcaagacagaatggccatggttaaaaaatctgatgagagttcattataaccagcaattgacaaggaaacctggttatttctgtggcatatatcatgttaacatagtaacaaaattatgacttataacattagatttctaggaatctcataatttttagaacattcatatcagtaacatatccagaaatataacttttttttttttgagatggtgtctagctgtgtcgcccaggctggaatgcagtggtgcgatcttggctcactgcaacctccgcctcctgggttcaagcaattct

SEQ ID NO: 174297 - DNA, 392 bp, Homo sapiens
aaatttctgaacctccttctcctcttcccccattctctaaagcattgttctcaaactttacaagaggtttgttaaaacacagactgctgggccatacccccagtttctgattcagggtaaaacccaagaatttgggtttctaacaagttctcaggtgctgctgctgctgctagcctagggaccatattttttaactactgctctgttttctttaatttctgtgtctctgtcactctgactgacaatatctgtctggagagttctgttgggaggaactgaggctgcttttaggctaaaacaaagacagtcagctctccatattcatggtttctgcatccatggattcaactaactttgtatcaaaaatatctggaaaaaaaaggttacctctg

SEQ ID NO: 174298 - DNA, 487 bp, Homo sapiens
gtagtagtagaattggccttagatagtaccataaacttaatccctagtaatagaagagaagaaagagatactgtatttgagaatagctgtaggtagctaggtagtgagagagaggtaagagcttgtggaaatctgattgcttctgctttttagtgaaatagcagctgataggatttgagaagagaagttatgaaatagtcatctaggggagtaaagattgaatgaaataaggaaattatgtacagcaaagactgacttgacattggtcatgattttttaactgacatcgttaatctttgatgaattcatcattcatttccctacagtcactcatctccagctatgttcagctgattgattagatacagaaacaaagtaggtggagagttggatttaatgatgattggggtttggctggaaaactaagatgcattcagagatgggcaaatgaattactctaatgatagacctaggattttacatttgg

SEQ ID NO: 174299 - DNA, 743 bp, Homo sapiens
cgatgaactcaggctgcagtctgaagccttcaaaaagcacagcttggatcttttaagcaaggagagagaactcaatggcaaactccgccatctctctccatagggaagtttctgcttcctctggcctgcaattcagaattcaaatatttgcgtcttagcattatggcaagagtaaagatgatatcccatttattatactttcaagcacaaaaggcaactcaaagaaaagctactttactatgatattgttgttattattgtaaagccattattaattttcatttctacacctagaatacacaagatttgccagatttccttctgtgccttagaaatcttaaatttactagtagtatcttctcctacccataagttattaattctcaacctcagatatcttcatttatgttaggattttaaattagcagcttctatgatttaagtcaatctaagtgcagtgagatgtgccattgtgaaaaataattagcacaattacccactgtagatagttaggcttatagtctcccatagttgagattgtaagcaaacatgtatcagcataatagcatgaatgctttgcagaaaaaaaaaagtgtctgactttattttattttgcgctagcttggaaaatgattgagatcaagttctttaacaaagaaggtcaattttattctgtatgagcaatatgattcaaataagttatacaaaacaacttttattttttctgcaagcttagataatat

SEQ ID NO: 174300 - DNA, 538 bp, Homo sapiens
tgcagataaggctgctccagtgcccccaaatttggaccttatgctctgtagtttcctgttataaccaatttgctatttgtgttaccaaagtatatttagtagattttatttgaaaaaagaaataaagttagaaaatattgacagtattacataacataagttctttgtttaaatttgtcatatttaatttttgaaagctaaataactaaaatctcatttctactaaattattctttttttcatgctaaggctaaatgtgagagctaacattttacaaaattttgtgtttttctttcaaaatacatgacaaagcacaaaagcatttttatcaggattaaagtaatttatggaaaatctaactctacgactatgtaagtgatgatctagttatattacaatattatgttgttttaatatccattattattgtgtgttaagtgctttccttgtctctatcgtaaagttacatacatagtaagcaattataggtataatgcttacaactgtaatgatgaataataaataatgacatttgtta

SEQ ID NO: 174301 - DNA, 1132 bp, Homo sapiens
  misc_feature (749)..(749): n is a, c, g, or t
  misc_feature (753)..(755): n is a, c, g, or t
gcaataatggttatgtgagtccagaaaagtgctttaggctgggggacccaggaatacttcgccaacgagaagggtttgagacggacgtgagagaagaaggtggtgtgagtgtcctggtttcctggctgcccaccatcagaacctcctgcctacatttggggaattcccatcgcaagggccctaatggaaagcaggccaccatttgccacaaagccccaatgcttgctctccctgactcggctctggggttgcaggcagaagacatgagctccgccaatcggatgctccaactgggaccttgaatctggagcaagtcacggaatagcaaggctggtttaggaattcatttctgcggcggcggtggaggcgatggggccaacagcggcctctagtgtctggaggaggaagtgtcagcgctactgccgcagcgtgaatgcatctcagtccacgtggggcaggcaggtgtccagatgggcaatgcctgctgggagctctattgcttggaacatgggattcagcctgatgggcagatgcccagtgacaagaccattggtggaggggacgactccttcaccaccttcttctgtgaaactggtgctggaaaacacgtaccccgggcagtttctgtggatctggagcctacggtcattgatgagatccgaaatgggccataacgaaaggtcttccacccagagcaggtcatcactgggaaagaggtgctggccaaaatatgccgtggtcctataccntggnnngggatcttggcccatgctgggtcggggaccggcagctgttgtacccgtggccggcgttagggggccgggggtccacgatgtggggggcccggccgtggtacccaaccccgagaagggggcccttgagactgaggaaaccacgggggagtacataacacgacccccgaggtattgtagggggggccgaaaaatttgtttgcacacccaggggaacagagtcctgtgtgggcaggaaaaatgctccgtagtaaggatgagtggcccccagccagcatagtatactagtgtagagaaaggagcgtcagacaaccaaactaggagagcgcgagcgcgtcggctttcgtactgcgtctgtcttgatccactaaccttagtat

SEQ ID NO: 174302 - DNA, 271 bp, Homo sapiens
actctcgacttccgtactctcgacttccgtactctcgacttccgtactctcgacttccattcagattgtgagaccgcgtctcagttcaagagggtaagatcccaaaccaggagtgccagtgagcactgatgttgtgtccacaggtttaaatagctacacatgcatgcacaacacattaagtaagctattttataacttcacactggaaaaacttgctctttaaaggagctctggccaggcatggtggctcgcccctgtaatgccagcactc

SEQ ID NO: 174303 - DNA, 289 bp, Homo sapiens
cttttcttttgatagccacttaataaacgtaggcgaggaaggatgttcggcatggaatgtgaattggttctcatgggcctcatgtgtaataggcgttttgggagagaagacatttatgtcttcagactatttttggactaattatgaaattaaggctcataaatttaaaaagttcacatcatgagttaagccacagagagatgatgggaagtatctaggagttaggtaaagggcttcacactatttctagtctgtctgtgaaagctttctggatatgttggtgtttgag

SEQ ID NO: 174304 - DNA, 424 bp, Homo sapiens
ccaaagtgacaccagtaaaattacttatcttattactagataggatgtctaattactcaaaataataggatgaagctgggtacggtggctcatacttgcaatcccagctatttgggaggctgaggtgggaggatcacttagccctggggtctgaggctacagtgagttatgatcacgccactgcactccagcctgggcaatagaggaagactctgagactactactactactactactaataaacaatgagatgatattagtaaactatctttatcagtactgagtgtggagagaattgttgtcagcaaggcttccaaagaacccttgaacccagcatttaagcatcactaagagttgaccacggggttagtgtggattgaaggatggggaaagggcattgtagtcacagggaatatgaaaagc

SEQ ID NO: 174305 - DNA, 340 bp, Homo sapiens
ctcgtacttttgtatatgtaataatttaatagctttcagaataaagaaattaatagcattttcttattatctgagtacaatgtttgcatcaatagcaacaaatggcacggccaggaagtcttctttaagcatgttaatccttcacattgcttaacttcaaatgattagtgtacttggccatgcgtccacattaggtgctcctaagctttccagtgaaataaagtcttatataaatgccttaaacacaactttgctaacattcaaatgcaagccctttctcactacgttctgttgattgccctttcagtccctatacactggtaacacaagcatgtagcca

SEQ ID NO: 174306 - DNA, 617 bp, Homo sapiens
cggtggccacggtttccaggaaagaagagagaggcggaaaagttaactttccgccacccacacaaatatttttggccggcgttgtcttcacgctgccaagccaggagggaggagttggcaggagcactccaattcaaggttccctcccaaggaggaaggaggactcccaacccagtcggggagcttgggcaggccctatgcaagcctgagccccacagcacccacctctgtgcaggagctgtgggggtcgggacccgaaacaataatagcagctgccactaactgagcacctgctaggtgctgaacccagccctttacctgacactcctgctgtgtcagtgcagtctatacaggaggaaactgaggcacggagagattcatgaccctcatctggacacaagctctaaaatacttgagccttggcagaaatggctgatagagtccacagaacacgctgtcctcatctcagagaggagaactctgaacccagaggggaaggatttacctgcagttgtatggcaagccagagcctaaccagcctaaagaaaccatgggaggagaggctcttaccctctcctttgcagatgtgggcccggctgcctcacactccagagcag

SEQ ID NO: 174307 - DNA, 557 bp, Homo sapiens
aatcccagcactttgggaggccaaggcaggcggatcacaggaggtcaggaatttgagaccagcctggccaacattgtgaaaccctgtctctactaaaaatacaaaaattaaccaggcatggtggcaggcaccagtagtcccagctactcgggaggctgaggctggagaatcgcttgaatccaggaggcagaggttgcagtgacccgagatcctgccactgcactccagcctcttgccactgcacttgacaagagcgagactctgcctcaaaaaaaaaaaaaaaaaaaaaagaagaagaagaagaagaacaagcctgaggtttcataatcctggttctaccacttatcaactttgacatcttgggaaatgccatctctcaatctcagtaaattagaaataatagcacttatctgcagtgttattcttgaagatgaaagacagacaacacatagcatcatgtagcagagtcagcactcaataaatcctttcgtttggaggaatttgtgcttcttccttcattttacagtgttatgggaccacaagaggtcactgatgac

SEQ ID NO: 174308 - DNA, 421 bp, Homo sapiens
acgattctatctgggtgcatataggattgtctgtgtctccagcttcctttctagtcatgagacaggatctctctctgtcaacccaggatagaatgcagtggcactatgatagcttactgcaaccttgaactcttgggctcacgtaatcctcagcctcctaagtagctgcgattacaggcatgtgccatcacacctggctaacttttttgtttgtattagtttttggagatggagtctcactgtattgctcaagctggtcttgaactcctggcttcaagtgttcccaaagtgctgggattacaggcgtgagccaccgtgcccggccacttgcacacatttctatacaaatttatttctacatctatatttacatctgcaaagacttgaaaaattcagatatttgaaatgactcatgggactg

SEQ ID NO: 174309 - DNA, 138 bp, Homo sapiens
aacctatagaggaacaatcacaagtgactagtattattcctttgggtccagtggaagcctctgatcttcatatggaatggacccggaaccgtaacccagcattttgttatatagcaaccttacctctgccacaaaggt

SEQ ID NO: 174310 - DNA, 373 bp, Homo sapiens
agcttttgggaggtgaaacctctaagtgcttgagggacgcgaagatggaagccacccatctgtggtggcaaactgaggcctgcaaacacagggtcctgccagctacttagcacttccatcccttggatccacccagcccttcactctccctctgtagcagtcaacacttttaaactgactccctagagaagtttaatgagcctcttggaattaaaaaaaaaaaaaaaaaaagcaaaacaagagtaatagaaatggacaagctgacaaaggaatagagaggttcattttcagcttggtgcttggggggttttcatcaggataccgcaatggatattgcacagagaagtggaaggagaaagaaagaaattagaaa

SEQ ID NO: 174311 - DNA, 334 bp, Homo sapiens
atgacattttctatacaaaggctaacatagatatatgactggctactattgattacattaatacagatagattacattaatacagatagatatatgactggctactattaatacattaatacagatagatatatgactggctactattgattaacagatagatacatgattggctactattgattacactctaagaggattaacattttattgtaaagaggtaacagtcacagtggtctctatctccctcatttagtctaggtttaagtaaagagtagactctggttcatgcaatctcaacacaaaggtcaggaaggcaacggtcatgcatcag

SEQ ID NO: 174312 - DNA, 114 bp, Homo sapiens
aaaaaaaaaaaaaaaacttggaaccaccattttatcatttgagaatctcagtcactgagttaacctgaatcactcctaaggcagagttaccaagattttaaaaactctgcaggt

SEQ ID NO: 174313 - DNA, 210 bp, Homo sapiens
attcaagtcctacttctaccatttttctgctatgtaaccataagtaaatttctaatgtttctgggtctcagtagaatgagaataatatctaatcagagggtagttgtgatgattaatggatgttaaagtagatgagctactcagtcgagctcctagaccctagggagtcaataaatagtcggttttcttcaccctttttttttttttttg

SEQ ID NO: 174314 - DNA, 346 bp, Homo sapiens
caggagggtttgatcatgtaaagacatggttgctccttcaagaattatatggctggagttaggagaagagcatggaagggttatgccgagcacggagttccggagacatccacatacccatcctgccatcctaggcagttggctcttgctgggaatacaaaagaacccctctaaactgcagccaagtagtgggagacagatgtgcaaccaaataagtgtgatagagtgatattggttctatagtaatggaggtacatgttagataggaataaagaacaggcagtcagttaggttaagtcagacacaactagcatccgcgagtaatgatggctaacaggccttctac

SEQ ID NO: 174315 - DNA, 506 bp, Homo sapiens
tggtatcagccatttctccaaaaagctgtttccttttagtgaagaatgatatttagaagtcaggttctgggctcatggttcttggagtgtgtctgctccctggtcctctcagtggacatggtgagaaaatagatatatttatgtacatctatatttatttatatctatatagatagaagttcacactagtacctgcagtgtatttgcagtactgcagggttcagcctagctctctttctctccatagttgactcttgtttcctattgtaactctcttctctttaatatactcatttatttcatcaatttcctgtgtgtaactaaggtcccgtcaccactatcacctccccacccagctgccctccttagcaccctcaggatcagactccctatgccaggccacccaccgcaccccacttgtttagacattcagctctaggccactgcagcccctccctgcccccagcatggacacagctaatggcttaggactgaattgttcctga

SEQ ID NO: 174316 - DNA, 483 bp, Homo sapiens
atttccatttgcttctttaccttcataggcaagtacagtaaaaaaattctccactcggatggcaacctggtagatttcacaccttgtacaacacaataattgacccttgaacaatgtatttttacctcctgtgcctccctaatcatgctagaaaatatttctgcagcttcaaggaattgttcaaaattaagaaagaagtgcagatggttaatgggtacaaaaaagatagaaagaaagaataagacctactatttgatagcacaacaagttgattatagttaataataacttaattgcacattgtaaaatatctaaaagggtataactgaattgtttatcactcaaaggataaattcttgaggggatggataccccattctccatgatgtgactatttcacattgcatccctgtatcaaaacatctcatgaaccccataaatatagacacctttatatacccacaaaaaataaaaataaaaaca

SEQ ID NO: 174317 - DNA, 753 bp, Homo sapiens
tgtgttgggttgacttttttgagacagagtctcactctgttgcccaggctggagggcagtggtgcaatcctggctcactgcaacctctgcctcgcaggagaatcacttgaacgcgggaagcggaggtggcagtgcactgagatcgcgccaccacactccagcctgggtgacagagcgagactccatctcaaataaaaaagataaagaaaaaaagaatttactctatggcggtttgttttatgtgagtaaccttaaatacagtaggggttatctgcacacagatgtttattacagggttatctacaacaatggaaagtgaaggaaaaaaaccccacctaagcaaggaaaatggctggttaagctggtatatctagtggattcctaccttttaaaatgttgactataaaaactcattaataggctggggacagtggatcatacctgtaatcccaacactttgggaggttgaggtgggtggatctcttcagctctggagtttgagaccagcctgggcaacatggtgaaaccccttctctactaaaaatacaaataaacaaacaaacaaaaaattagctgggtatggtggagtgcatctctagtcccagctactcgggaggctgaggtaggaggactgcttgagatcaggagttgagaccagcctgggcaacaaagtgagaccccaatcctacaaaaatccaaatcatctggctggggtgtcacggggccctgtgggagtgggagagtcgttacccg

SEQ ID NO: 174318 - DNA, 1047 bp, Homo sapiens
agacaaaggacctgaacacaagtatatggaaaaacattcagtctcagtaacaaatgcaaatttagacagtgggttttaagttgttttggcaagttttagaaaattattaccagtgtatttatagcttggagaaatgattttgtgcagtatgtatgtagacacaaaatgttcacaccatttgactcaagaatttactgtatgggccggacacagtggctcacgcctgtaacctcagcactttttgaggctgaggcgggcgtatcacttgaggtcaggagttcaagaccagcctggccaatgtggtgaaaccccatgtctactaaaaatacaaaaattagccaggcatggtggcaggcgcctgtagtcccagctactcgggaggctgaggcaggagaatcacttgaacgcgggaagcggaggtggcagtgcactgagatcgcgccaccacactccagcctgggtgacagagcgagactccatctcaaataaaaaagataaagaaaaaaagaatttactctatggcggtttgttttatgtgagtaaccttaaatacagtaggggttatctgcacacagatgtttattacagggttatctacaacaatggaaagtgaaggaaaaaaaccccacctaagcaaggaaaatggctggttaagctggtatatctagtggattcctaccttttaaaatgttgactataaaaactcattaataggctggggacagtggatcatacctgtaatcccaacactttgggaggttgaggtgggtggatctcttcagctctggagtttgagaccagcctgggcaacatggtgaaaccccttctctactaaaaatacaaataaacaaacaaacaaaaaattagctgggtatggtggagtgcatctctagtcccagctactcgggaggctgaggtaggaggactgcttgagatcaggagttgagaccagcctgggcaacaaagtgagaccccaatcctacaaaaatccaaatcatctggctggggtgtcacggggccctgtgggagtgggagagtcgttacccg

SEQ ID NO: 174319 - DNA, 4339 bp, Homo sapiens
  misc_feature (3343)..(3343): n is a, c, g, or t
  misc_feature (3361)..(3361): n is a, c, g, or t
atccagttcacgcagtcgtcattccagtatctcacctgtcaggcttccacttaattccagtctgggagctgaactcagtaggaaaaagaaggaaagagcagctgctgctgctgcagcaaagatggatggaaaggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggggagcaacggtgggaatgccctctgaggaatgcagtgatgtccatcagtcacctctcacccagagcctggcaaattcagtctctttcacagaacctaaagccaagccaggttcagtgggaaatcccacctgtccaaacactgtgtgagacaccagaattagaggcctgcaagcctgcttccttcatccccaatgcccagatgggacaggtcaccagcctcctgtgtctacccccacctttcttgcttgctggcctcctctctctgcagtgcctctctcatccctgcaatccagacagcacatgcagcagctcaaccaattccattcctggctacctcatcccctccagtctgaaaggacgtgtgaatgccaccangatctgaacccaagattncagcctcggtcaccaccctgaccctgagaatgccactgggatggggagaacttgtcagtcttcatccttccccacaagtatactgaagccaggacagcacctgccttagagagctcttagagggattatccgcagcctgaagaaagaaggttacaactgaggaagaacttctgaacagggaagagtggaagaaaagactgcagctcagctccagaagcagacccagaatggcatccttctctgagacccagaccccagccccttttcatggaagaccagcacaaaggaggaagtaggttagggaatggtaaggctccatgtgatgggactaatgtggagaggcctggggcctttccctgaggactggatggctggagtttgggagcctgagttgacagaggaggctaagcccgggcagctactttgttccagaaatctaaggtccctggagggaggctctgctttgggagggggaagggagctaacattgcagagcaccaactgtgaaccaggtacaatggcagagcctttccatacctgtactcacaactagcgggtgaggagtcaaggcaaataggtgtctcatagctccccatatctcggcagtcgaccacctcctcctttgattctctgatgtcactgccagttctcctcctattgctctgacctgtctttctctgtgtcctttgcaaactcattctcaactccttagactcagtcaagtcccccagttacacacttccatggtactatatatcattccttcagagcacttaacacagttatttcctatgtatttgtccagtcatttgaataatgatcctagtttcattggatggaaagttccacaaggtcagtgaccatttctatctgtgttcaccaatgtgttcccagtgcccagaaacaatgcctagcataaagcagctgttttgtaaatacttgttcaatgaatgaataaatgacaaaagaacatctcaa

SEQ ID NO: 174320 - DNA, 827 bp, Homo sapiens
cggtaccgtctgagcagctgggaagctgtggaatatatatttttagtacaggctcagctccagaagcagacccagaatggcatccttctctgagacccagaccccagccccttttcatggaagaccagcacaaaggaggaagtaggttagggaatggtaaggctccatgtgatgggactaatgtggagaggcctggggcctttccctgaggactggatggctggagtttgggagcctgagttgacagaggaggctaagcccgggcagctactttgttccagaaatctaaggtccctggagggaggctctgctttgggagggggaagggagctaacattgcagagcaccaactgtgaaccaggtacaatggcagagcctttccatacctgtactcacaactagcgggtgaggagtcaaggcaaataggtgtctcatagctccccatatctcggcagtcgaccacctcctcctttgattctctgatgtcactgccagttctcctcctattgctctgacctgtctttctctgtgtcctttgcaaactcattctcaactccttagactcagtcaagtcccccagttacacacttccatggtactatatatcattccttcagagcacttaacacagttatttcctatgtatttgtccagtcatttgaataatgatcctagtttcattggatggaaagttccacaaggtcagtgaccatttctatctgtgttcaccaatgtgttcccagtgcccagaaacaatgcctagcataaagcagctgttttgtaaatacttgttcaatgaatgaataaatgacaaaagaacatctcaa

SEQ ID NO: 174321 - DNA, 456 bp, Homo sapiens
gcggccgcctactactactaaattcgcggccgcgtcgacctaggaactagagaataaatgagttgggaaaaaccatgaaatgtgatttttttaaagtagaaaagttatacaaataatggtaccaaaccatcaaaagagttgagcttcatgtaccctgactcctcctgacaggagaggtaagtgggtttgagctcaactgtcatcaagggaagttggtaagaggctgtttagacccaaaggatagtcttaaaccagacttcaccacccaccctacctcagttcccatgttattacatgcagagtcagcatggggattagtgtacctacctttgctgagatttcccgatgcgttgccaatccagaaagtgaatcaaaaagttgtttaaaagttaaaatctctattgtttccaaaatctttcccatctccacctgaagacagaattgcttccccttctc

SEQ ID NO: 174322 - DNA, 7729 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgtacaatgagagatattgtctattaaatacattattttgaacagatgagaaatctgattctgttcatgagtgggaggcaaaactggtttgaccgtgatcatttttgtggttttgaaaacaaatatacttgacccagtttccttagttttttcttcaactgtccataggaacgataagtatttgaaagcaacatcaaatctatacgtttaaagcagggcagttagcacaaatttgcaagtagaacttctattagcttatgccatagacatcacccaaccacttgtatgtgtgtgtgtatatataatatgcatatatagttaccgtgctaaaatggttaccagcaggttttgagagagaatgctgcatcagaaaagtgtcagttgccacctcattctccctgatttaggttcctgacactgattcctttctctctcgtttttgacccccattgggtgtatcttgtctatgtacagatattttgtaatatattaaatttttttctttcagtttataaaaatggaaagtggagattggaaaattaaatatttcctgttactata

SEQ ID NO: 174323 - DNA, 8331 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgtacaatgagagatattgtctattaaatacattattttgaacagatgagaaatctgattctgttcatgagtgggaggcaaaactggtttgaccgtgatcatttttgtggttttgaaaacaaatatacttgacccagtttccttagttttttcttcaactgtccataggaacgataagtatttgaaagcaacatcaaatctatacgtttaaagcagggcagttagcacaaatttgcaagtagaacttctattagcttatgccatagacatcacccaaccacttgtatgtgtgtgtgtatatataatatgcatatatagttaccgtgctaaaatggttaccagcaggttttgagagagaatgctgcatcagaaaagtgtcagttgccacctcattctccctgatttaggttcctgacactgattcctttctctctcgtttttgacccccattgggtgtatcttgtctatgtacagatattttgtaatatattaaatttttttctttcagtttataaaaatggaaagtggagattggaaaattaaatatttcctgttactataccacttttgctccattgcatttacttcttaatctgtaccccctgagcatatctaatcatgtataaaggacgtttttcctccactttatcttaggggttctctgtctcagaatcattatagactcattaactccccctcccagcaaaaggttatcaggatttgaagaggtgcttgaaaacgctagactaggaactagagaataaatgagttgggaaaaaccatgaaatgtgatttttttaaagtagaaaagttatacaaataatggtaccaaaccatcaaaagagttgagcttcatgtaccctgactcctcctgacaggagaggtaagtgggtttgagctcaactgtcatcaagggaagttggtaagaggctgtttagacccaaaggatagtcttaaaccagacttcaccacccaccctacctcagttcccatgttattacatgcagagtcagcatggggattagtgtacctacctttgctgagatttcccgatgcgttgccaatccagaaagtgaatcaaaaagttgtttaaaagttaaaatctctattgtttccaaaatctttcccatctccacctgaagacagaattgcttccccttctc

SEQ ID NO: 174324 - DNA, 4836 bp, Homo sapiens
cggacgcgtgggtcgacccacgcgtccgtatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcattgtattttggttatcagcagtcatcaataatgtttttccctcccctctcccacctcttatttttaattatgccaaatatcctaaataatatacttaagcctccattccctcatccctactagggaagggggtgagtgtatgtgtgagtgtatgtgtatgtatgatcccatctcacccccacccccattttgggagtcttttaaaatgaaaacaaagtttggtagttttgactatttctaaaagcagaggagaaaaaaaaacttatttaaatatcctggaatctgtatggaggaagaaaaggtatttgttaatttttcagttacgttatctataaacatgatggaagtaaaggtttggcagaatttcaccttgactatttgaaaattacagacccaattaattccattcaaaagtggttttcgttttgttttaattattgtacaatgagagatattgtctattaaatacattattttgaacagatgagaaatctgattctgttcatgagtgggaggcaaaactggtttgaccgtgatcatttttgtggttttgaaaacaaatatacttgacccagtttccttagttttttcttcaactgtccataggaacgataagtatttgaaagcaacatcaaatctatacgtttaaagcagggcagttagcacaaatttgcaagtagaacttctattagcttatgccatagacatcacccaaccacttgtatgtgtgtgtgtatatataatatgcatatatagttaccgtgctaaaatggttaccagcaggttttgagagagaatgctgcatcagaaaagtgtcagttgccacctcattctccctgatttaggttcctgacactgattcctttctctctcgtttttgacccccattgggtgtatcttgtctatgtacagatattttgtaatatattaaatttttttctttcagtttataaaaatggaaagtggagattggaaaattaaatatttcctgttactata

SEQ ID NO: 174325 - DNA, 6259 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattactt

SEQ ID NO: 174326 - DNA, 5566 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctttgaggcatttgtttggaaaaaattactcatccttaaagtttactccacttggacaaagataggcccttctccctggacataaagcaggttgacaccgtggctttcttggggccagtagtacgatttaaccaagttcttacttatggcggagggggcacgccaccacattgcgaaactaacactcaaaacaggagagagatgcc

SEQ ID NO: 174327 - DNA, 567 bp, Homo sapiens
ggggctatttatcttggttgcaatccgacatatcaataatgtaaaaattttttgagacactttaaataggctctaagaatttctcttctgacctctcaattttaccttttctagatgtattcttggggaactattcacaaagaagcctatttttcaagccaatctggaactggctcagctagaactgatcaggtacagctgtacatgtgctcttgagtgcccaggtgtgataggtattctcatcctccagtttctaacactttctagtcattctgaatgagtttatgtttcttatgtccaagtaagtttctctttactcagtcaggtttaccatatattttgtcataggctatacatataaagaagttttatttcacctaatttttagatcttactttgcatattttttattagctcttcatataaaagcataccattttggggatggctcttccattcatagctcagatgagattaaatttattcagcaaacatttattgagcctgttatacaacagattacttttaacattaaactttaggattcagagataaaaaataggtccc

SEQ ID NO: 174328 - DNA, 939 bp, Homo sapiens
  misc_feature (367)..(367): n is a, c, g, or t
gcagtagttaggaaaacaaaatagaaaattatgatagaaattagtctttaaaattactgtaacataggaagctgaatgataatatggtagttacaatcctttcagactatgattttggggagacgtgactaaagtttggagaagcaagtgtatttttatacatgacagtaatgaaaactttttactttattttatctctcctatatattctttaagttttatttcaggttaacctatgtcatcaaacattctgtaaaatgtgttagccaagtccatgcaaggtctctgttgtagagcaagattatgtcctagaaatgtgaccacagcatgtatattgttccctctcatcttccttccttctgctttngttttaatgtttccatctaacagcaaaaaggggcagggagtctgccaacagcctgcatgttagaacagttctttaaaggaaggaaatggaggaaatcttagaccaaaatcaggataatcatttgaaacatatgatatttttacactagctgttagatccaggatgcaactgttttacttttaatcacttgatttatttataattgcaattttctgatcccaagattttattctttatatatctggttacttatattgatatttgtttatgttgcacagtgtgtgtgtttgtgtttataatcacatgtgctttttaagatggtgtttaaaagaagtaacccttccacagcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtac

SEQ ID NO: 174329 - DNA, 5447 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctttgaggcatttgtttggaaaaaatcgttgagatgcccaagaacctgggataattctttactttttttgaaataaaggaaaggaaa

SEQ ID NO: 174330 - DNA, 7123 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaaacataggttaagcccccttttacaaagaaaaagtaaacatacttcagcatcttggagggtagttttcaaaactcaagtttcatgtttcaatgccaagttcttattttaaaaaataaaatctacttataagagaaaggtgcattacttaaaaaaaaaaaactttaaagaaatgaaagaagaaccctcttcagatacttacttgaagactgttttcccctgttaatgagatatagctagatatcggtgtgtgtatttctttattattctctggtttttgatctggccttgcctccagggccaaacactgatttagaaagagagccttctagctattttggcattgatggctttttataccagtgtgtccagttagatttactaggcttactgacatgctattggtaaatcgcattaaagttcatctgaaccttctgtctgttgacttcttagtcctcagacatgggcctttgtgttttagaatatttgaatttgagttattgggccccactccctgttttttattaaagaacgtgagcctgggatactttcagaagtatctgttcaatgaaaaaaagttggtttcccatcaaatatgaataaaattctctatatatttcaaaaaaaaaaaaaaaaaaaaaaaaaaaaaattttgttggcgcgccgcgcctcggagcccccgagaaagaagctcttttaaacacccattctggttgtgggcgcgccgcgcggcgccccagtgtaaggttactgtgtgaacacagtgggttccatcagccgtgtgttcgccttcaaggagagaactcaggctgggtcctgagaacatgaggtgcttgtgggattttttcccaccacatattaaaaaacaccgcccgcgggggaacaacgagcgaaggtgttttcgtgaaacaaatcttcctcagaaggagagttcccggaagggcttaacatcacggggatgtccttttaaaaaggagggtttccacgacagagctcaaatttttctatttaccc

SEQ ID NO: 174331 - DNA, 5966 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggaggaaaacaacagtgacaagaacagtgggccacaggggccccgaagaactcccacaatgccacaggaggaggcagcaggcatgtcctcctcacattcttccaccagagaagaggccccctgagccccccggacctccaccgccgccacctccaccccctctggttgaaggcgatctttccagcgccccccaggagttgaacccagccgtgacagccgccttgctgcaacttttatcccagcctgaagcagagcctcctggccacctgccacatgagcaccaggccttgagaccaatggagtactccacccgaccccgtccaaacaggacttatggaaacactgatgggcctgaaacagggttcagtgccattgacactgatgaacgaaactctggtccagccttgacagaatccttggtccagaccctggtgaagaacaggaccttctcaggctctctgagccaccttggggagtccagcagttaccagggcacagggtcagtgcagtttccaggggaccaggacctccgttttgccagggtccccttagcgttacacccggtggtcgggcaaccattcctgaaggctgagggaagcagcaattctgtggtacatgcagagaccaaattgcaaaactatggggagctggggccaggaaccactggggccagcagctcaggagcaggccttcactgggggggcccaactcagtcttctgcttatggaaaactctatcgggggcctacaagagtcccaccaagagggggaagagggagaggagttccttactaacccagagacttcagtgtcctgaaagattcctttcctatccatccttccatccagttctctgaatctttaatgaaatcatttgccagagcgaggtaatcatctgcatttggctactgcaaagctgtccgttgtattccttgctcacttgctactagcaggcgacttacgaaataatgatgttggcaccagttccccctggatgggctatagccagaacatttacttcaactctaccttagtagatacaagtagagaatatggagaggatcattacattgaaaagtaaatgttttattagttcattgcctgcacttactgatcggaagagagaaagaacagtttcagtattgagatggctcaggagaggctctttgatttttaaagttttggggtggggggttgtgtgtggtttctttcttttgaattttaatttaggtgttttgggtttttttcctttaaagagaatagtgttcacaaaatttgagctgctctttggcttttgctataagggaaacagagtggcctggctgatttgaataaatgtttctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctgtctgtctcgcttgctcgctctcgctgtttctctctctgtctgtctcgcgcgcgctctctcttgttctctctctggagggtgtgtgtggaaagatctcggagagatgcgcgaagagcgaggagatatttactatagttagtgagaatataagaggaaaagatataccagactcttagtattgttctgctgtatctcgtaaaactactagagtggttgtgttttagaacagctatgttgtgatggggatgtttgttgtgtgatgtgtggagcgctgtggatattgatgccagactgaggatagagaagatgctatcatatagagagggggaacgaacgattgcagatagtggacacatatatttttgttgtgtaaaaaaaaaaaaggttttaaaaacaaggcgagttgggattgttgcaagagaaaaaccatcgtcgaatcttcgggaatgtaccatcggcgggggtattggaaagaacaaactgcgggttgtaaaacttttacacggggtggggagacaatttttgttcctctgagttgccggagcttgagggttcccaaaatgggttgtgaagggatatgtcacacacctcttttaaaaaagggggggggtatgggctcttctttgaaatgagaattcacg

SEQ ID NO: 174332 - DNA, 3756 bp, Homo sapiens
cttttttcccttcttcaggtcaggggaaagggaatgcccaattcagagagacatgggggcaagaaggacgggagtggaggagcttctggaactttgcagccgtcatcgggaggcggcagctctaacagcagagagcgtcaccgcttggtatcgaagcacaagcggcataagtccaaacactccaaagacatggggttggtgacccccgaagcagcatccctgggcacagttatcaaacctttggtggagtatgatgatatcagctctgattccgacaccttctccgatgacatggccttcaaactagaccgaagggagaacgacgaacgtcgtggatcagatcggagcgaccgcctgcacaaacatcgtcaccaccagcacaggcgttcccgggacttactaaaagctaaacagaccgaaaaagaaaaaagccaagaagtctccagcaagtcgggatcgatgaaggaccggatatcgggaagttcaaagcgttcgaatgaggagactgatgactatgggaaggcgcaggtagccaaaagcagcagcaaggaatccaggtcatccaagctccacaaggagaagaccaggaaagaacgggagctgaagtctgggcacaaagaccggagtaaaagtcatcgaaaaagggaaacacccaaaagttacaaaacagtggacagcccaaaacggagatccaggagcccccacaggaagtggtctgacagctccaaacaagatgatagcccctcgggagcttcttatggccaagattatgaccttagtccctcacgatctcatacctcgagcaattatgactcctacaagaaaagtcctggaagtacctcgagaaggcagtcggtcagtcccccttacaaggagccttcggcctaccagtccagcacccggtcaccgagcccctacagtaggcgacagagatctgtcagtccctatagcaggagacggtcgtccagctacgaaagaagtggctcttacagcgggcgatcgcccagtccctatggtcgaaggcggtccagcagccctttcctgagcaagcggtctctgagtcggagtccactccccagtaggaaatccatgaagtccagaagtagaagtcctgcatattcaagacattcatcttctcatagtaaaaagaagagatccagttcacgcagtcgtcattccagtatctcacctgtcaggcttccacttaattccagtctgggagctgaactcagtaggaaaaagaaggaaagagcagctgctgctgctgcagcaaagatggatggaaaggagtccaagggttcacctgtatttttgcctagaaaagagaacagttcagtagaggctaaggattcaggtttggagtctaaaaagttacccagaagtgtaaaattggaaaaatctgccccagatactgaactggtgaatgtaacacatctaaacacagaggtaaaaaattcttcagatacagggaaagtaaagttggatgagaactccgagaagcatcttgttaaagatttgaaagcacagggaacaagagactctaaacccatagcactgaaagaggagattgttactccaaaggagacagaaacatcagaaaaggagacccctccacctcttcccacaattgcttctcccccaccccctctaccaactactacccctccacctcagacaccccctttgccacctttgcctccaataccagctcttccacagcaaccacctctgcctccttctcagccagcatttagtcaggttcctgcttccagtacttcaactttgcccccttctactcactcaaagacatctgctgtgtcctctcaggcaaattctcagccccctgtacaggtttctgtgaagactcaagtatctgtaacagctgctattccacacctgaaaacttcaacgttgcctcctttgcccctcccacccttattacctggaggtgatgacatggatagtccaaaagaaactcttccttcaaaacctgtgaagaaagagaaggaacagaggacacgtcacttactcacagaccttcctctccctccagagctccctggtggagatctgtctcccccagactctccagaaccaaaggcaatcacaccacctcagcaaccatataaaaagagaccaaaaatttgttgtcctcgttatggagaaagaagacaaacagaaagcgactgggggaaacgctgtgtggacaagtttgacattattgggattattggagaaggaacctatggccaagtatataaagccagggacaaagacacaggagaactagtggctctgaagaaggtgagactagacaatgagaaagagggcttcccaatcacagccattcgtgaaatcaaaatccttcgtcagttaatccaccgaagtgttgttaacatgaaggaaattgtcacagataaacaagatgcactggatttcaagaaggacaaaggtgccttttaccttgtatttgagtatatggaccatgacttaatgggactgctagaatctggtttggtgcacttttctgaggaccatatcaagtcgttcatgaaacagctaatggaaggattggaatactgtcacaaaaagaatttcctgcatcgggatattaagtgttctaacattttgctgaataacagtgggcaaatcaaactagcagattttggacttgctcggctctataactctgaagagagtcgcccttacacaaacaaagtcattactttgtggtaccgacctccagaactactgctaggagaggaacgttacacaccagccatagatgtttggagctgtggatgtattcttggggaactattcacaaagaagcctatttttcaagccaatctggaactggctcagctagaactgatcagccgactttgtggtagcccttgtccagctgtgtggcctgatgttatcaaactgccctacttcaacaccatgaaaccgaagaagcaatatcgaaggcgtctacgagaagaattctctttcattccttctgcagcacttgatttattggaccacatgctgacactagatcctagtaagcggtgcacagctgaacagaccctacagagcgacttccttaaagatgtcgaactcagcaaaatggctcctccagacctcccccactggcaggattgccatgagttgtggagtaagaaacggcgacgtcagcgacaaagtggtgttgtagtcgaagagccacctccatccaaaacttctcgaaaagaaactacctcagggacaagtactgagcctgtgaagaacagcagcccagcaccacctcagcctgctcctggcaaggtggagtctggggctggggatgcaataggccttgctgacatcacacaacagctgaatcaaagtgaattggcagtgttattaaacctgctgcagagccaaaccgacctgagcatccctcaaatggcacagctgcttaacatccactccaacccagagatgcagcagcagctggaagccctgaaccaatccatcagtgccctgacggaagctacttcccagcagcaggactcagagaccatggccccagaggagtctttgaaggaagcaccctctgccccagtgatcctgccttcagcagaacagacgacccttgaagcttcaagcacaccagctgacatgcagaatatattggcagttctcttgagtcagctgatgaaaacccaagagccagcaggcagtctggagttggaggcctctggagttgggcaggcctctggagttggg

SEQ ID NO: 174333 - DNA, 595 bp, Homo sapiens
cagaggaaaaaaaagaatttttaattttctttactgaaattttaatttttgattactgaatttttacttttgaaggttgtcaaattcatgcatctttccattttatgatgtagttgcttcctgtaaatcttggaaagatcattcatttggacattaaataaataggtggtttttttttacttttaacatttttatttttaatcactgtatatctttaataagtaatagcaataaatataacaagtaagtacaatagtttagttgccaagacttttgggaacttgactgtgtgacaattttctaagcattttacagtgctatagcagtggtcactatcatctctttttaatagttggcaaaactgaagcccagagagactaagtagctagcacaaagagagtacagaattgaaagcaaagcaatcaactcttaattactatgttatgatgcccctctaactgattttgaactgcattacatcttatatttatgttagtaaatggctttaagtgaaacattaactaatttttacttttcagtagaatgaaatgtttcccaaactgatttgtttcatcaaataaataaagtcttatac

SEQ ID NO: 174334 - DNA, 278 bp, Homo sapiens
aaattccagacattatttattttatccacaagtattttcaacatgtagatgatagaaatatgcttaaaataagttttcagttatttaaacctaaaacacattgttacacatataccagaactcagtcctttctctgacctttgtgcactcaatgttaggagttacatcagcctataggactagagaatgaatttctctggtccagcgttttctaatgtatactacatggaatgtaaatctcatgaaatgttatggggggaaaaggtaagataagataa

SEQ ID NO: 174335 - DNA, 471 bp, Homo sapiens
tttattatgttgtattgtaaaagttaatcagcttttctgaccacaaataatatatgtgaaatatgaacacaatcttgtactaggtcagtgttttgttttgtcttgttttgattttgagacagagtctcactctgtcacctaggctggagtggagtgagtggtgccatctcagcttactgcaaactccacctcctgggttcaattcttgtgcctcagccacccaagtagctgggattaaagtttaagcgaccacaccgggctgatttttgtatttttagtagagtcagggttttgccatgttggccaggctggtctcgaactcctggcctcaagtgatctgcccacctcagcctcccaaaatgctgggattacaggggtgagccaccttgccgggccctaggtcagtgtttcttaaatgtctcagtggaaacttgctgctttgaggagataattgagggatgtttcaaacaa

SEQ ID NO: 174336 - DNA, 451 bp, Homo sapiens
ttcgagatggagtctcactctgttgcccaggctggagtgcagtggcgtgatcttggctcactgcaacctctgcctcccgggttcaagtgattctcctgcttcagcctcccgagtagctaggactacaggcgcgtgccaccacgactagctaatttttttttttttgtatttttagtagaggcggggtttcaccatgttacccaggatggtctcgatctcctgacctcatggtctgcccgcctcggcctcccaaagtgctgggattacaggcgtgagccactgcacccggccctaggtgatatttctaaaggccaccttatattttaagtaaattgaatggttccagttataaaaataagtattaacaaccctattctaatttcttattagttacaaaaatttcttgttcagttttctgtcttcttcactagagtacagatttcttgaggac

SEQ ID NO: 174337 - DNA, 411 bp, Homo sapiens
acacgccaccacgcccggctaatttttatagttttagtagagatggggtttcaccatgtttgccaggctggtctccaactcctggcctcatgtgatccacctgccttggcctcgtaaagtgctgtgattataggtgtgagccaccatgcctggcccagaatcaataattgttaatgcttcatcgagactttcttaaatgaaactggcataaaagacaacaaaaagcccctgggatttcatggtgggaagaacataattcctgctagtaccgcctggcactgtcaccttgactcaggctaaggttcctgctgtcacaccaccattgctcttgcaccatcagtgcaaacgtcaacacaaggaaaaaggcaaatagtggctcagtattatcattaaagtggtttgatcatgagg

SEQ ID NO: 174338 - DNA, 369 bp, Homo sapiens
gcttgtgttctctgcaatggagaatacccacacctgaggccccttctgggcactaaggaaattgacagtgtggtggagaacacggcatgaacctctgaatgactccagtaattcaagtcacttcattatcaagcgtcaggttaactctgccgctactgacagctagaaaccagggcaggagaaagaagttcaggctgctgctgcctgcatctccatcctcccttgatctcacaagaatcactaaatggtaggcaagaggggtgcaaggaaataaacacttagtcaaccttatcgtctatgtctccacattcctcttcccaagctttcaaagaatttaatgctgctgccgacaagcagagaaagcactca

SEQ ID NO: 174339 - DNA, 513 bp, Homo sapiens
gatgaaggtgtgtgtacgcagggctgcgccaaatgctgacagcatctcttcatgagaaccccaaaccggaagcagccccagtggccatcagcagatgaatgggtaaacaaagcagtgtgtacatccagtgggaaaaatgtgtgcctattggtttgagttgcttttcttagctcacctgaaagtatgaggtctgtgggtaggtacagaccttttaggcagcaacacgcatgtttttgtgcaggtgctctgggtgaccttgtagatagatgctgcttggtactggtcccactttgttccttcatcctcaggtcaggtctgcactgcctgttccgtctccactcctggtagcctgtgggagtcacagctgaatagtcatctcgtactgggattttactctgagtgcatgagttgtttccctaggaaaaacatgctgtctttctggatcgtaagggacaactagctaaagctcctagccgacctgtcgtccagccctcactctcctctgccagactt

SEQ ID NO: 174340 - DNA, 981 bp, Homo sapiens
gataacttctctggataaacataaagcagttagagtggagttatccccctcttctgttaaatgaaagtttcttttcacagtctttccattgaaggaattagaaaagtcatgggatacctctggtcttagagcagaaatgaagttccccagaagggggtcctggacagaatggtctcttgggcagggactagatgctgttacttaccatcagatgtgtctactgtaagatgcttgggaggcatcaaagtggtgacagtggggggctgttggattttaccattctggaatataagagaaggggtgtggctggtgttttagtccagatagcagctgtgaccactgggagcctcattttccacacctgcaaaaggagaaatagtgatccccttcctagtgttggtgtaaagagtagatgaacctctgcctgagtctcagatgcctgctgcccacttggtgcttagtggatcgggctggctgtcacagtgtaagcttatcaagcctaaatacttagttggtcttgactttttcacctcgaccatgactcagtgtcatgtgctcctagtcattctgtctgtggtccaacgttagcctgggaagcacctgggactgagggaagaaccctcagctagttattcagcgatccaggttctcctcctgcctttgatatcacctcattatataaccttgggaaacactttggtgtgactggaatgtggatactcccaggggaagggtaggagcatggtagggcatttggactttatcatgaaggtggtaggaaatacttgaagggttttaagcagggatgacacatcatcaaatgtgtgttttgaaaacttttttctgcagaggacagggccacagcccaagcaggatcaaaccagttaggagattgatgtaacagtcccgtcagaaagtgatgaggtagctgggtgcggtggctcatgcctgtaatcccagcaccgtgggaggctgagactg

SEQ ID NO: 174341 - DNA, 302 bp, Homo sapiens
gaactaataaaggatgctgattgtttaaacatgaaaccagtgttcctaataaattttaaaatattggaggcaattataaagtttattaaaaacagtttggaattgtcatggatatgagggaattaagtcatttttgatatattttatgctggatgatgaggctgtgaaattgtataataagacaattaaaatcagtcctaatttgaccaaaagtatttcagactctgagctaaatgtttgagacagcacacaaatgaagatggactcaacatttcctcatataatctctttcaggtctcact

SEQ ID NO: 174342 - DNA, 267 bp, Homo sapiens
atattttatatcttcttaggaaatacagcaatatctatcagataatcatatgaatataagtgatttggacctaattacttatttagcagagtttcttttggcccaagggcactatgaaaaaattaccaattcactaagggtgctataaaccaggtgtcttggtgaaacttattttttggaaaacaaatgtcaccttatttgatgatttcagatgataataaaaaaagtatcagaacgtataatgcattcaaagaaaggttaacactt

SEQ ID NO: 174343 - DNA, 135 bp, Homo sapiens
cactggtggtagtcaacttgctcccatcagtaattgtgataattattgctggctccaagaaaaaagggtttcttccctgcccatagttgtctatgccagttgctaatctatttaaatttaataaatcaaaagctg

SEQ ID NO: 174344 - DNA, 334 bp, Homo sapiens
gttgcttgtgtgtgtgtgtgtgtgtgtgtgtgtgtgtgtgtacaggtctatgtcatacaagtgcatttcttgctataggttacagatagaaaagtgtgaaggccactgggctaggtgaccttttatgattctttctaaattaaaagaaataattctgggaacattcataatttctatcataattttgtataaaacagaggctatatctaattcatttcgaacaagaccctgaataaaatggccatttgttaggttatatctgacatatttatcagttcatattttattattcaaaccccaaaaacattcagtactttaggtcagattttggtca

SEQ ID NO: 174345 - DNA, 556 bp, Homo sapiens
tgtactccaatggggaaaaaatgtcacactgttcatgatacaagagatctgcatgactgatgggcacttctataaaccagactaccccacagatgtatttgctcatttgaaataaaccaaatgaaatagaaaaaaagcactcccatggaaagactatccctgatcttcccagcaaaaactgcatcttccccaactctatttgttcagatgtttactgtgtatctctctccattacaaaacgagctccacaaaagcagggactctgtcttagtcactacttcatcccccgcaccaacatgaaatgcttggcacagtaaatgctcaaatacttgttgcttattttccgaaacattcctcatcatcttaaacctcctggcatctaacagaaaacaccccttagttactaactgatcacaaatagttccattactttccggtgtgcattctgttttgttgaattattctgcttttgaaaccctctacaatgagcactagagctgtgaggagaagtcagtgaagaacaccagcatccgagtggctgactttggcagtgcac

SEQ ID NO: 174346 - DNA, 716 bp, Homo sapiens
tattccactaaggttgtttgcttgtgtagttgggcagcctaatcagaggtgtggaggtgtaattacttcaaccattcatttacttcttataatcattagaatttaagttaaatgagcagaagtaattgcatctttcagatgagctgtaattaattttaggaactagtagattaggaatgtggtgctttaaggttctgtttccagagacctgttgcaagtaaaagcagttatacttgtgttaatttaaatgtgagccttggcactcattagagtgaaatgaaattgggctggctatttacttccatctacctctcttctcatgatctccatgagcttaataggtgccctttaacagtatctttatttctcctagatttcttttttcagcccattgtaattaaaggcctctcctgggttcggtcagagaatgggttgctgtcagaacaaaaaacagttcctgtctagtggagactggcttagcaataactaccttttgcactgcctgttacagttatgatcaaggtactttcagagtccaggaaacacaggtaaccactacactttaagtcactgaagagctgatttagcaactgtccattcatttattaacatttcttggagtacagtgctgattgtgttaatgatggtgtttaagaattattcagattatataaggtgaaaatgataaagcttacattaggattgctttcttttct

SEQ ID NO: 174347 - DNA, 425 bp, Homo sapiens
aacaatctggctcacccatatctccacattctcattacaaatatttacacctgcttttgtggttaataaaatacaaaaatgtagacaaataacagatttcatattttttcatttaggcagttaaaaactataatttctatactctggacaatatgaaatttgatatcattcaaatttcacatgattcaataaaagagcttactaacaaatgtgagttagacaggattttgactccaggaagtaaacagctttctaaatggcacagctgctcagtgactccaaggtgtgatctctgacagaccctggggaaaccacatctagaaaaaagctgaatgcaaaagtcaaccaactatcattaaataggccaagcatttgcctgagtacttcctctgaagttcagtagctgtatggccttaggtaaactc

SEQ ID NO: 174348 - DNA, 319 bp, Homo sapiens
ctctggttctgtagtcattggctgtttagggtagtggtctcaaatgtgcttccttctagtatagctacttatttggtcctatcatattcttcggtcacaattctctctacctcctagagaatgtttcaccgtgaactatgtgctgacttggaataccaagagttgtgaactctaggaaaactgtcaccttgcctgttgaaatggaaaaaaatcagtattctaggcctctgtcctagctttctaacgtgagcatacctgatattagaacagggaagtcccaaccaagaagagcaaagaaaagaagacaagagcattcttc

SEQ ID NO: 174349 - DNA, 296 bp, Homo sapiens
  misc_feature (12)..(12): n is a, c, g, or t
gctggtaccacnttctggaagcaacacccccaacacaacacggtggctctaacaagacacagcagcaggggagaagccagtttgcccagtgggccctggaaagtgacgcagtctggtcatcagcaccccagaaatccctcccaggcggtgggccccttgatagtgcgaagggtccggatggccacagggaattgtacgttatctgaacacagcaactggggcctctgctctccgcatctgtgtggcaccttgctcatagcagctgctcagtgaaggcttgcagaattacaaggcat

SEQ ID NO: 174350 - DNA, 452 bp, Homo sapiens
aaaacggttcactacaaaagcaactaaacacaaaagaagttaggaatgctgaaaatgagagacaaaaaaaggtataaggtaagcctaggcaacaaaataagaccttatctctataaaaaatacgaaaaaatcagccgggcatggtagcatgtgcctgcagcccagctacttgggagacagaggtgagaggatcacctgagcctggggaggttgaggatgcagtgagccgtgatcgtgctactgccctccagtctgggtgagacagtgaccctgtctcaaaaaaaaaaaaatgggggtgaaagacttacagaaaacaaacggcaaattggcagaagtccttccttatcagtatttacattaaatgcaagtggattaaactctccatcaaaaagaaagggttgacaaaatggatttttaaaaacctcatgattgaactgtaagctgtctacaag

SEQ ID NO: 174351 - DNA, 430 bp, Homo sapiens
ttttataaattgctacatgaaaaaatgaatataagaaatgttgcatattaaaatgcctatgactggtacattccttttctaacctcctacccttaagtgtgttcacatgacaaatgtttcaataaatacttagtctgaaagacattctggaatgtagttgtgctaatatacttgctaactatagctgcagttgtctcttcttttcctggaatgtgaaataataaatcaccatctcagaagtcattttgaaagccttaatcagataaatcctcatttttccaggcagtatttctgttgttgagggttagtcataattttcttctcttaatgataaaagtgatgtctcgctattgagcagaggcaaaatgtgaatgctaatgtcttacaactgggagaacaaatctattaattaaaggagtattcccttgga

SEQ ID NO: 174352 - DNA, 281 bp, Homo sapiens
gtgggccacggcaggggtcacaagtgagcaaattgataggtgagacctgaggccaactggagatggcatgcctgtcttgagggagcagccactcggccatttgggactggttggaaatgtaggcccagtgtggcagaggtcttggtagagaggcaagaaccagccagtaactcattcattttacacacacacacacacacacacacacacacggtactatggtacttccttttttttttttgaacggagtctctgtcacccagactggagtgctgtggtgc

SEQ ID NO: 174353 - DNA, 419 bp, Homo sapiens
tctgtagagacagggttttgccatgttccccgggctggtctcaaaactgctgtgctcaaaggatccacctgcctcagtctctcaaagtgctgatattacaggcatgagccaccgtgcccagcccaatcctgcatcttttctagagcagctgattaccatagcatgtggagggagagggccaggcctcagttgagaatctggtgaaagctgtgatcccttaccccagaaacgtacattatacctgtagcatcagggattcacagaacccaaaagccatccatccatccatccatccatccgtctgtccgtccatccatccatccatccatgcattgcaggctaggaagttttaccttatgcttgcacttactcttggggttgagatggagagggaaagttctagagctctctccctgctt

SEQ ID NO: 174354 - DNA, 826 bp, Homo sapiens
gggagccgtgatcctaacagcagctgacatttactgaacgctgtgcacatggtgggcgctgagcgcttggcctgaagtcacactggtggctttcttggagtttctatgtgatcccaggcagtcatgattcctagtccaggggcagtgaagggcagactctggagccagagagcctggcttcaggtccaagatgtatagaccagggcagttcccttcactctgtgcctccatctccttgtctaagaaatggtgagcataaaagtagatatttctgatggattttatgaggattaaatgagttaatatgtgtaaagccaggcaagtgttaaccataattattaacattaaccacaacacgatgttattatcagtgacatggactcgtagtgtgttattagagccggaagggtcttcgcatgtggacactccctttgctttgtgttgggagcttggacttagtgtggacacctgatctcccgcctcctccatagctccctgcaggtccttgtcagttctgggcctcgcagaccatgcacctgcctctccatgaacaagttgtttgaaatggtgcttttgtttcaggtgataatacaagtcactcttctggaagacttaatttttttgtttctctgggtgtaagtggcccacccaggcatgccagttacatttggtacccagagcctttgaggcagccaaagtatggtgcctttagatgctcctcgtcacccgcacgaccccctcaacaggtactgtgtttattttctggtccattttctcctcttgtgaaggtggcaggtcttcctaggcactctcagcttctactaac

SEQ ID NO: 174355 - DNA, 388 bp, Homo sapiens
cagttctggggaaagaggatgggatgctgacatagccataactctctaagggaaaggataaaggccctgcagactgagttctgggacaagggaagataccctggaatctgagagtgatcctagtggtggatgggaagaaggtgggaataaagactcccccacctgtttacctgttaatgaacagggtggaattaatgtttagaaactgagcagtgagaagtgaggctgaaattagccacccaaatggtgggttggtagttgttcactatcctctgggctggtggaaggaggggagtatcataacaataagggcaacaagccccatggtcccacatgaaaggctgtggctgtgactgctgagccaaggaatcccctaaactaaaagaaa

SEQ ID NO: 174356 - DNA, 539 bp, Homo sapiens
atttgcagaggcagtgccttctgcccccagatgggtaaccctatgggcaacccccttcaacttccttgctcaacatttgaaactccaagctgcactgtcctcaacacattctccagatcctctttaccctgctatgttttgagccccttttactctcttacctactgtataatctcctaacatgtttaccttttactgtgtgttctgcccatgggaatttaagctctgtgggggcagggatttttaccaaggttgttcactgatgtgtctcaagcgctcagaacagtcctttgcctttggacagtgctcggatttgcatgagtgaatgactgtgctctctccagagtgatgaggatgtcaggattgctaggtttagaaatgaagcacatcctatagtatgacagagcctgcagaggagataacagcttctcgcttaaagatatggagtaggcgttaaaaatgatttctgcccaatgtaagaggaggattttccaattaccaaccagaaggagttgcttggggtacaggaaggtgtaggg

SEQ ID NO: 174357 - DNA, 422 bp, Homo sapiens
cttttcttctgcaatgtctaatctaccactaatcccattcagcatatttttcatttctagaagatttatttgggtcttttttctttttgagacagtctcatgctgtcacccaggctggagtgcaatggtatgatcatggctcactgcagcctcaaccttcctgggctcaagccatcctcctacctcagcctcctaagtagctgagaccacaggtgtgcaccaccacgcccagctaatttttgtacttttctgtacagatggggttgtccagggtggtcttgatctcctgagctcaaacaatcctcacatctcagcctccagaagtgctgggattacaggtatgagccatgacgcccggccctaggtcttttttttatatcttccatttttttctttatttttatcatatttgccctgattga

SEQ ID NO: 174358 - DNA, 353 bp, Homo sapiens
ggtctctcaaagtgctgggattacaggcgtgagccaccgcacccagccccaactctccctcttaagaggacacgggctcaggctgacaaagaggcttttaggatgccacctaaagctcagctgcagttcccactgtgcgtattcatcagacacttacagaaaaccttggtgatatggtttggctgtgtgtccccaaccaaatctcatgttcaattttaatttctaataccaggagagggacctgctgggaggtgattagatcatgggggcggctttccccttgctgttctcgtgatagttctcaggagatctgatggtttaaagatgtgcggcacttcccacttcgtgctctc

SEQ ID NO: 174359 - DNA, 394 bp, Homo sapiens
tcttcatgttaaatctattaactgtggcaatggcatgggggttataaaacaaaacaaaacaaaacccttacatcaagaatgcaccctggtgtgttatggatgtgggtgaaatgaaatgtctggaatttgctttaaaatattgtaaaatagcaagaaggaaaagaaaagcgggaactggaatgagattggcgagatgttgacaagttcttgcagtgggatgatgggtgaatgggggttcatggtgcaattctctccctgctttttgtgcgtatgggaaatttccataacgaaaagttagaggtcgggcacggtggctaatgcctgtaatctcagcattttgggaggctgaggtgggtagatcacttgaacctaggagttcaagaccatcctggac

SEQ ID NO: 174360 - DNA, 705 bp, Homo sapiens
gcctaagaccttgcgtttcatgtattcacagcccgcctctgaggaatgtactatcatctctttgatgacaggaaattggggcccaagaaacttgatctggggcctcaggatgcggggagctggaggccagcttttctgggggcagcccctggccagttacagctcacgaagctcgtcaaggatagagctgagaaaacaaactctgaaggctgagctcttaaccaccaagctagaggcctcccgccctcctcttgacctctgccctgggaggcctgcccagacccccgtgcccacgcaccctctgccctccagatgcacagatgcttctggtcagaaccgcaccctgctcttcagtgcaccagtgtcccttgtagagttctgtgccgtggcttctatcccaagtcactcgggagtaagctacgcgcactgtctccccatcttcacccagggatgtgaagagctggtgaccgcggagacgctggatgggacagcatcaatctcggcactcttgggaggagaacctcagaggaaagccgggaccccgtcagactgagctagcaatacgccaggtccggagctcccagtctgttactgcagcgagcctgcagaaagagtccgccatcaggaaggtggtggacttctttctccaggtgccgccactactgctctggagccgtgggaatgctgcagtctccttccacagag

SEQ ID NO: 174361 - DNA, 455 bp, Homo sapiens
cacacatatgtatagctggatatttctataacataatatagatacattggaatatatgttgcctaatacagtgttttttcatttattaatatgtattgagcaccaactcagtgtgtgtgcggcatcatttagaagctgaggatgcagtaataaacagcttagacctaaatcccttccctcactatttctcataaatatgtaatagtatgttgaacattgtctaagttggtttttgaacggtatgtaggtctttggaccacccaatgtcatgttacttgtttatgatgtcctccactgggttgtaaagagcagggaccatgtttcttccatctctgtgtcctcctttcctcaaatgtaacatgaccttggcatttgtagatttgaactgttatttcttgctagttgaagaaatgggacagattagataataaacacttttttacacaatttacaaa

SEQ ID NO: 174362 - DNA, 383 bp, Homo sapiens
tttgtctcccatttcaagtaatatggcaacatcacaacgattgaattttttccaaagaaaaacaattttagaacaatctacagtggatctttctcagctcatgggccacaaaccattggggagactatgttctcatatctatgtgctccttagtttcttaaccaaaggttaactaaaagttcaaatattacatgggaggtctatgaatttttgaacgttcctttgtacttctttctagtcaatcctcacctgcagagtcaactgctcctctgatttatacattaacattgcttgttcacaaacttcatatgaatggaatcttttgaagtacatttagagtatatcttttttttttttttgagatgggatctcactctgttgcc

SEQ ID NO: 174363 - DNA, 292 bp, Homo sapiens
ccatgaggatggttactatttttaaaaaacagaaaataacaattgttggtgaggttatggttacattggatccctcatgcactattggtaagaatgtgaaatggggcagccactgtggaaaacagtatgatgattcctcaaaaaattagaaatagaatcaccctaggacccagcaagtctgcgtctgggtatatgcacagaagaatcagaagcagggtctcaagcaatatttgctcactatgttcacagcagtattagtcacgatggccaaggggcagcagcaacacgggcg

SEQ ID NO: 174364 - DNA, 270 bp, Homo sapiens
tggctgttgggattggccaggactcagctactgttttaggtacatactcctaagttaggttttcagtctttctacctattaagttaggttgcagtttgtccacagggactcaaatctagaagtacagagtccttcccaggccatatttagttcactgtaacagttcctattatgacctcactgacagttctttttctctgaattctcctttcttctcaacagcttatccaaatgttccattggtccctgttcatcttgccctgcagttct

SEQ ID NO: 174365 - DNA, 292 bp, Homo sapiens
tcgataaggccaatgtctctcacaaatatagattcatgactggtgtggaggctcacacctagaatcctggcgccttggggcggtggtgatggcgggcggatcacgaggtcaggagttcaagaccagcctgaccaacatggtgaaaccccatctctactaaaaatacaaaaattagccaggtgtggtggcaggcgcctgtaatcccagctactcaggaggctgagacaggagaatcacttgaacctgggaggcggaggttgcagtgagccgagatcacgccattgcactccag

SEQ ID NO: 174366 - DNA, 182 bp, Homo sapiens
cgggcccggccattctctgctgttttctgactcaacatcatgaaacaggaccttaagctgagaagtggtgagattggggccatcctcatttccacataaggccgtgttcctgtttactggggactaggacttggcatgtctttttcggggatagcccaacccttctgtgtgaaaggggtcgt

SEQ ID NO: 174367 - DNA, 637 bp, Homo sapiens
tggtactctttgctgatttccacaaaagggctaggggactgagcacagggctgtgcagcccgagggcagggcgggggcccaggctgagctgaggcctgtctggcatgaacccccaggagcccaagaatgtcttgggtagggacctgtggtgtttgggctccagccactgccgcagccctgcttcatctgtagggaggaaggccctgcaggtgtgggtgggtttgcgccagcaggacatttgcaggcctgcccctgcctcccttgagtggggtgtctgtggacctctctgccagttgcacctacccgctggtccccacacccagaggagcgctctggacccctcttgggagagccctggggcctgccgagctgcctccgcggtggtgcattgcaggcagatgctgttgtcgtccatttgttccctggggctttcaggggtgtttgtggcttctctggaagggctgttagagttgcacaaattgtgtcagactgcctttcatttttcaaagaatgtggctcactttgacacctggaagagcaggcagaagccaaagttgtgctctgtggattaagtttcctgttcctttgcctccgggaggacagggccggggctgggccggggccaccgcgcggccgc

SEQ ID NO: 174368 - DNA, 606 bp, Homo sapiens
tagaaattctgcttcacataatccaatatcacctcaccagaactggtactggttctacaagaccaatttatttggcaaagagattttaattttatatactaaaccttaaaaggcaaaaatcaacattcgtgcggccttcacaatacactgcacttgtatagtgttcctccatcttctttactcctcaagaagtcacttagagctattctcccactttacaaaaaaggcaaataagggttacatcagggacaagaactgggtcaagagtgaaccattcacaacccagaggacattcaaatctggacacttttcttggcctatcttccccaagaatcagggtgaaacagggttaatgggcatcaaactaataaaaacacttgaagtgaagccttgctctttatgatttccctcaccatctttaatactttttttttttttttttggaatttaaagaagaggcggggtttaaccatgtgggccaggcgggtctaaaactccggatctaaggggacctccaacctgggcctccaaaagggctggaataacaggcatgacccaccgcccctggccaatattttttaattatggggaacagggctgcacatt

SEQ ID NO: 174369 - DNA, 355 bp, Homo sapiens
tgtacaatatcatttaattggaattgtatactcctagagaaaaaattttaagctaatgggagaagctaatgggagaaataaaatgaagctgtatttgccgcccttccagcgagactgcaaggctgggctcttctgctggagctgcatctggatagaaggaggctttctcctcccctccttcgccctcactccctttctttaaagtcagctagggaataatttgtccatataaaaaggtcctttcaggcactggagggctttgctaattgtatttgagagaataaaggtaaactacaagttggcttttaacaacagaaaaataatgagttcgcatggcaacatgtttaataagatt

SEQ ID NO: 174370 - DNA, 543 bp, Homo sapiens
gccttaaatagtgtgtggaagaggcttaaacaagctaatataagtcaaaacttgagcacaatccttggtgtagctatacatatgtttgtgtatataacagaagctcaaaattataccattattattaataacatactctggaccctcatcataatgctattctcaatatccaaacatttgatttctattgataactatctgttgaatgaatgggtgcactggtctgatcagggtgtgatccaaggcaggtgtccatgtcttccaactctgaacctccagaatggagcaggcagcacacagcaggctctgagtgaattagccaagaatttctaagccagaagactatgtggggaaggggcagatatcttctgcaatggtatccagaagatctggattcaagccctgactccaccatgtgttgtgttatttggaagcattaagaatcctctgtctggggccacatatgcagcatcagaaggaatgtccgtgaaacaaacaagaggaccaaagaagataagctgggagaatccctgagactgtcca

SEQ ID NO: 174371 - DNA, 502 bp, Homo sapiens
catctcgatcgctatatcgtctggatgtgatacgtcgtggtatgcgtttatagtcgaccgtgtcaggcttgtaccattgattattggtcgtctactcagaacgttcagaatggggctattctcaatatccaaacatttgatttctattgataactatctgttgaatgaatgggtgcactggtctgatcagggtgtgatccaaggcaggtgtccatgtcttccaactctgaacctccagaatggagcaggcagcacacagcaggctctgagtgaattagccaagaatttctaagccagaagactatgtggggaaggggcagatatcttctgcaatggtatccagaagatctggattcaagccctgactccaccatgtgttgtgttatttggaagcattaagaatcctctgtctggggccacatatgcagcatcagaaggaatgtccgtgaaacaaacaagaggaccaaagaagataagctgggagaatccctgagactgtcca

SEQ ID NO: 174372 - DNA, 835 bp, Homo sapiens
tgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaactggagagataatgatgctttctcctatgggtatgttagagcggaagttctggctggctttgtcaatggcctatttttgatcttcactgctttttttattttctcagaaggaagttgaggccacggacacagtcattccctctttaatggtgctctagatcaggcacatggccatgtcgatcattgccatagccatgaagtgaaacatggtgctgcacatagccatgatcatgctcatggacatggacactttcattctcatgatggcccgtccttaaaagaaacaacaggacccagcagacagattttacaaggtgtatttttacatatcctagcagatacacttaaaagaggaataacacttacaactataagaatggctataagaattgaacagatagatctgtatcatcagac

SEQ ID NO: 174373 - DNA, 1310 bp, Homo sapiens
tgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtctatactgtccgacaagacttcccggaacctgtttttcttcctgtgcctgaacctctctttcgcttttgtggaactactctacggcatctggagcaactgcttaggcttgatttccgactcttttcacatgtttttcgatagcactgccattttggctggactggcagcttctgttatttcaaactggagagataatgatgctttctcctatgggtatgttagagcggaagttctggctggctttgtcaatggcctatttttgatcttcactgctttttttattttctcagaaggaagttgagagagcattagcccctccagatgtccaccatgagagactgcttcttgtttccattcttgggtttgtggtaaacctaataggaatatttgttttcaaacatggaggtcatggacattctcatggctctggtatgatggttaggacactttgtttcttcattttctactaggtttctgtcataattatttacttgagagaattaagttaaactatactgatttctgatgtcaacagactatgtgaatatcttcctgaactatccctttcacttctttatgcccctccatctcagtgccttctcagagctgtgcttgtatcatggatcccaccagacctcagtagcttatctgtttagtgtgatatcatttatataaaatagacaaatatcagaaaaccacaaaacaaatctacttatcagaaagttttgtgtgggctgggcacagtggcttacacctataattccagcactctgggaggccaaggcagatggatcacttgaatccaggaggttgacaccagcctgggcgatatggcgaaaccccatctctacaaaaaaatacaaaattagccaggtatgctgggtgacagagtgagactccatctcaaaaaaaaaacaaaaaaaacaggcatgatggcgcattcctgtagtcttagccactcaggaggttgagatgggagagtcgcttgagcccgggaggtggaggttgcagcgagccgagatcatgccactgcactccaacctgggtgacagagcaagactctgtctaaaaaaaa

SEQ ID NO: 174374 - DNA, 497 bp, Homo sapiens
aaaaaaatacaaatgataagtgaaaatatgatctcattttaattatcagattaatcaaaatacaaaagtttgatacctggagctggcacagtcattcacctacactgttggcagtagtgtaaattgctgcagtctttcaggaaagcaatgtgtaatctctatcaaagtgcaaaatatatacactgataaactgctaggaatttacactatcagtctacccaaagaagttcaccaagatacatacaaatatgtttgtaattttaaaatggaaagaatttgttttcatgcccagttgaagtttaatgacaaatatctttgacgttccctcaccccctccccaaaggtgatgtcgctttcttccttattgaagaactgtatcccatattgtcctattttacaattatcagttgggtttacagtaagtttttttttccctagaaacaggggcttttcatttattctgttaatagttgtcactagagatgaggtgttcagaa

SEQ ID NO: 174375 - DNA, 122 bp, Homo sapiens
ctgaggttatgcagctgataagtgacagggccacagtttgaagtgaggtgctctggcttcagatgccatgctcccaaccactatactattctggttccccagataggcttggactatacccg

SEQ ID NO: 174376 - DNA, 687 bp, Homo sapiens
aaaaggtattttaaactccactaattgagagacgaaaatgggaacttatcttaaactagcttctttagaaaaagtatattagaacttaatccagctcttcctttgggacttataatcaaaattagaatcatgaaatgttgaagtaagttttggtattagagtaagccatcatgtataattcctttgatttttagattcaaaacattgaaggctttataatttgtgtttagttggggaaaatattaaagttaatcaactcttgggtgagttcagagctagtataaagatgtagttctggacctttaaatgaaagtgaaattaaaatcctttaaggataaaactttgcatagcttcagtctattacatagactgagaaaaggacccatacatggggcactctgctggggttggttgcagaagagggcagatatttatgcgggagaggtcaaagaattgccatagaatactttcatagcacatagcatgttgtattggagcagaccaacatccttattttaaatattaaaaaaactgaggccccacttaattactcaaactcttaagggcccttacttggccagtttctatttctgtatcacccagttacaacactgttccagaatacagatgaagcctctcaaagaaggtggggtcatccgatatctgtagttttgtttattattatta

SEQ ID NO: 174377 - DNA, 765 bp, Homo sapiens
aacttattcaaatttttgtataaccagctctgcagggaattgttcagaaatctttatccatatttctggtttttttgtaaggagaaattaatagacggggcattatgaggtcaaaggttaggtacatcttcaagacttcctgtcctccagagatgcgtcagttcctcttccactgctgtgtccgggagtgcccccacagaaaagctgtcctgttacctttaaagacttttagcaacttggaccttgcctaaaacatgaggcacactgtaagtagcttttctcttcagggacagcatgaattcaggctacccatggggttggacaggagactgggctctgcatgtagggtgagtagttgtccctataagagaagcttttcagggtgcaggactctgagggctaacaccaggatggtcccagcaagccggaacagttgtccttttaccccaagggcaagccccttacctcccattcagtagaccctccctctgcccctgtgagagagccagggtcaggggctggagctggggctggggaaacccagagaagctcagaaggagccctgccctcctcaggtccaggacgcaggtgagcagagaaacagccatcacccagggggaacttagtctaattccgtccctttccagctgtgtgacctgggcaaactgcaaaagcttccgcttcctctgctgcaaagtaacacaaaaccagcagcctcacagggttgctgcaaagattacacgcggtgttgaatgactgccctta

SEQ ID NO: 174378 - DNA, 160 bp, Homo sapiens
aggagaatcccttgaacccgggaggcggaggttgccgtgagccaccgcactttggcctgggtgacagagcaagactccctctcagaaaaaaaaattaaaaaaatagaaacagccggggagtggagggtgtggtcagaaagcctcagggacctgcttcagc

SEQ ID NO: 174379 - DNA, 605 bp, Homo sapiens
gtatttcaccagggtctttgttagccgggcgaccctgggcaagttacttgactctttgtgtctccgttctcccattagtgaaatggggatagaatgagctgggctgtgtgaagtgttgtaaagtagtaagcagaatggccccaggacactgctgtggtggtggtagtcatggtctgtcccactcccttatctgttggttcaataggaagtggcagagttcatcaaggtcccctgtggcagcacaggtgcccagcgtgctgtgcggtgaggtgaggctccccgctccatggacgtgtgcatacagacggcaacaagttcacgcatgcatacacgtgtatgcgctcagatgcagagacagccatgtgtgggcacatatgtatgtgtacacatgcgtatacacacagcacacacatacacatgtgcatacacctacatacctgtgcacaaacgagcacacatgtacatgcagcctggcagtcatgacaccttgggcgtgacatttggtcgaagtttgttgcaggccagaagctcatctgagtggcggatctgtttgcagccttcctccctcccccagctgtggggagctgaaggctagtcacagaggg

SEQ ID NO: 174380 - DNA, 249 bp, Homo sapiens
cccaatctactacttacttatctcattgtctaccccatgtcctgccacccatttcttgacatatcattctcttatctactcatcaattgccccttgtgttacctttcacccacccagttacctgcctgcccacctgttgatctccatctgtcctctggacaattcattcgtccaccaatttgtctaccatagatcccccatgcccatgggtccacacacacatctttctgcccaaactgccacccaagg

SEQ ID NO: 174381 - DNA, 231 bp, Homo sapiens
tgcagggattacaggcatgagccactgcgcccagcctctggatcttactttatagcttgtgtttcagcaggcctcctctaacattgcttctgtggggaaagtgcggatgctaccttatttttaccaggagggtgtggaagtccaggttttccacttggcctccattgacaccggtgttggcagggctccttcttactgctgggcaggggtgggagtccagtttctctatta

SEQ ID NO: 174382 - DNA, 633 bp, Homo sapiens
gatccttacactcaagagagcattatgacatgttcaaggggagatcttgtcaagatgctggcacggtattggtgtgtcattcacagtgccagtgttgcttccttcccatctcacctcttctgatctttaacagggatgtgtttcataatctggatagcatcactatattttagtgagtattgggaatgtaagggaaccacacacactcatctatattatgtaggaggttaggtgccatctctgtgctatgcaagtgtgatgaagttgggatgagggatgagtactcactcttttctatgtatgatggtatggtagtgagttacacttagtgaaccttaccttgctcatcaataaaattagcatattgctatttacctcacaggagtgttatgagaaatgagcaaaactaaagaaaccatctgatacataatacttcaataaatatatatttggtctcccctctgttttcccttcctcaaaagacttaaacatgaacatcccacagagattatttaaatttgaaacattgggaaaggaaacaaacatactcatatgttatagaacccttggtgacatttctttgtggatgagatacctgagaatggtgggaagtttgggatcaaataatcactt

SEQ ID NO: 174383 - DNA, 221 bp, Homo sapiens
tcacagaggaactaggaaatggaaattcactgaaaagaatatcagtcatgtgaagtcctgtaaccctgttcccagattctaaactcttactggaagggataagggcctctttggccacagccaacacatggggcctgtggttgaccacacccagcacgaaaaaatgtggtaggaaacctacagcctttgctgaaatgtccacagtcaccttccttttcaag

SEQ ID NO: 174384 - DNA, 2007 bp, Homo sapiens
ggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacacacacacacacatatcacagtttggttccttatgagttgaaaagtcaggaataaatttgttgaaaattatctggggattcaaaggaaaaatctttgggtgattccctgattagcactctgaatgtttaattatgaaactttgtagctataactggaaaattacctgactcttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaattttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgtgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaa

SEQ ID NO: 174385 - DNA, 2389 bp, Homo sapiens
ggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacacacacacacacatatcacagtttggttccttatgagttgaaaagtcaggaataaatttgttgaaaattatctggggattcaaaggaaaaatctttgggtgattccctgattagcactctgaatgtttaattatgaaactttgtagctataactggaaaattacctgactcttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaattttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgtgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcggagcttgcagtgagccgagattgcgccactgcagtccgcagtccggcctgggcgacagagcgagactccgt

SEQ ID NO: 174386 - DNA, 394 bp, Homo sapiens
tagagttctgatcggactttagggtatgatggggccagaattacacattacagcttgcgagaacagagccctggttggtctggcttcacacctgaaggtgctgggcacacaggcatccaataaatggtgggtgcataaaatatatatatacacacacacacacacacacacacacacacacacaaacacataatccatataccataaaaatcattttatgtgtataattcggtgctttaaaaaaaatacattcacagggttgtgcaaccatcatcattatttaatttcagaacatttttatcacccccaaaagaaacccatactcattagcagtcactctccgttctctgctattctagcccctggcaatcataatctactttctatctccatg

SEQ ID NO: 174387 - DNA, 1683 bp, Homo sapiens
cacttttgttccttctgtctgctttctgatgctaatattatttgaacatagatttttctcagtaatgatttctagttggcttttcctttccttttgtcattactcagggaatgataaagatattattgatttgaaacagtacagtgtagtgttatagacacacctgggttcaggtcctactctcttatttactagctggttggccatggtcaagttacctaatttccctaagcatcagtttccctatctgtacaaattattgagtaataatagtatctcttataggattggtataaagacttaaaaagttaatgtcatgtaaaatgctttagcataatacctgactcagagtaaaggcttaataaaccctagctgatcttactgtcagaatcaataatattactatttgtaatataattaccagacttaacaaatgggagaagtattaaccatctgcaggaataagtaccagagcctgcatcaaaatagtttatattcaacatgaagtctttaaattggcaaaagcactcagtttaatatatacctgttaagaaaattttaagagacagtcatggtttttagctggatactctgggaaaccaaataaagcagataattgtacagtatgataatcaaaaaaaggatgtctttataaatagcttgaaatagttccccagatgcaacttgaataaaggaaataaatagccgacttgctctaacttgaggttagagcagaattccttagtctgattcactggatgctggaaacccctgccccacattttcccactccctcttggttagaaaaatttacattggtttagcattatactcttgaggctattttctttcaaaaaaaaaaaactttaaaaaaatttagatattaagtgtgtaatctttgggcagtttccaggctttaaaaatgggttcaaaatttctgatgggattatttagcagaagttcttagaagtttgtccttgtgactgaaaacagatatttttggttcctgtatttgggtggcaaacaaagtaacagtacagctttaatgtatttgtaacattggccacagtgagtctttgataactgaaggatagtgttttccattgttctctgttatcctcaaagtaaaataaggggaaagtgttcagattcatccttacatgtgttctaggtactgtattgctcatgattaaaattaatttaaattaattggctaattgttcagaattaatccctttctatgagaacaactaaaaagggaacaactacaaaagagtacaactattgagcctactatggttggaaaatacttgaaagtatcatttaaagatggttactttaattagatctccgtactaaacgtgggaggatagctttatattttactttttgaagagcattaagttctggtctgtccatttcctgaaattctgagctatgttattcatctctgttgttggctctataatgtatgtatctgtttgctgctattcataataacaaaggtcttagcgaagacctagcaatcttagggtaataggaagacagaggaatttcatattggaatttttaacttgcagatcacaacttgttagtgttttatgaaatcagtgtagtgggtcaaaaccactatagtttttctaaaaaaaaaaaagtcgagggccgcgaatttagtagtagtag

SEQ ID NO: 174388 - DNA, 633 bp, Homo sapiens
ttatgatccattttaacagctgctttttatgcatttgctcaaatttttagattttaagtttagttttaggttttctgttaatttgctcaactaggagtggtggtcaaatactggacctcattagcatggtagcctgccctccttggcaggctccactggagtgccttggggcctgcctggattccagtcctggctctaccagttttgtgtcctcgccgttactgggagggagtattgaggaaatgcatgcgaggtgcctccgtgattcctggcacggagcaagtgctcagtaattgtcagctgtgagtattagtagtagctaatacactactactattcttggctaacaagccagctcaaagctttgatggttttccattacctgatgatggtgatgatggtttccacttcctgaacactcacacccctgggctaggcacttaacccaaatccaaggtcagcgttattgtttgggggtgggggagacacctcctgctctgactcgtgtgtttgggttcccgtattttcaccagagggtgttagttctgcccaagttcagctggtcctcaaagtgtatatagctctttaaccatcagcaagtgtcagtcagaacataatcttgatttcagctgc

SEQ ID NO: 174389 - DNA, 612 bp, Homo sapiens
ttgggaggccaaagcaggagaatcgcttgagcccaagagttcaagaccagcttgggcaacacagcaaactccgtctctacaaaaaatacaaaaattagctgggtgtggttgcacacgcctgtattcccagctattcaggagcctgaggcggggaggatcgcttgagcccaggagtttgaggctgcagtgagctatgatcatgccattacactccagcctgggtgacagagtgagaccctgtctcaaaacataaaaaataaaaatataagtaccacgaaagtttcattttgtttggagaacattctggaaatgttttcctgacaacagaattacctgactatgcccatattttcttgccatatgaagagctgaaacctcacaaaactgaccgcaacacttgttctgtgccatggtcagcagagcagccacatctcacactgcgtgaccggcaagatcctgttcgatggggcatgaatccctaggcaagtcacctgccaactctggcccatgtgtgtccccatctataaaacggagcagctgacccaggggctgcctccaagttctaagacatctttcagtcctgcttatctcctggggatcctctaggccaaa

SEQ ID NO: 174390 - DNA, 366 bp, Homo sapiens
ggaaaatgtatagggactattttacttatagtagacacatttaatttggaaatatagaacaatattaaaaatgagtctctcttttgaccatacagttaaatatatcctaagaaaacagataagcaaaaaagactcaaagaaattatgtttttatttacaatagtaaaaaactggaagtagctattggaagtagtgtatatattacatataaaataaaaaattatatatatgctaaaatattaactccagttatctttcagttatgagattacaaagtacattgaacagttagggtggggcagaaacaaatcacaatggtggaatgtcatcagttaaggctatttttacttcttgtgtggatcttca

SEQ ID NO: 174391 - DNA, 656 bp, Homo sapiens
caggagactgagatgagtttagcagagtggtgatggtggggataatggggatgatgatgtgggaggcaatgatcatagtggaggttggtgtgatgatgattgtggttggggtatgagaagaagccagctttgtaaagggtgccttctgtaaagggtgacttctaggaagaatacaggggttgctgagaaagaatttttttttcactcttctgctcccaccttctactctctataaagtcttgtccttttgacatttcaacttcctgattacctagctgctcaaatttggaaactgaagttgttctagaagtaattgtctaagagttgctgggagatttgagggaaggttttcgctagtctgtctggatttggtgagattttgttaatctggtctctttcagaaagctccctacttttctgtagtaagtttctcttccaagagaagctcaggaagttaaacaggagggatgaaaggaggacagagacagtcagagcacaagaggaccagtccttcttcatgtagcctatagggcatcttttacccagtcataccacatgaagagttaccgttctttgtttcatgaggaaaaaaggagcatttgctcttgttttaaagaaaaaggtgatgtattagctgcacagaaattcttcctggt

SEQ ID NO: 174392 - DNA, 211 bp, Homo sapiens
tgacacaattgagtggccacgacagtctgtatggcctgcagagcctaagatatttgctctctggccctttacagaaaaagtgccttgacctgtgctctagagccatatgtaccaggtttgaaactcagcctcacagctgggtgtgatggcacgcatctgtagtcccagctactctggaggctgaggtgagaggatcacttgagtccagaag

SEQ ID NO: 174393 - DNA, 133 bp, Homo sapiens
gcttggcccttactcaaactgaacatttagcttgtatttgtcttactcgttgttgtgcttgtaccttgtccattaaattaccagactcacatttagataatgtgctttcttatagttgaaaatgatgaaaact

SEQ ID NO: 174394 - DNA, 374 bp, Homo sapiens
gtattgtcctgtttctaaatatctcctagctaaagcctttaccacttgttagcaccagagggaagggaaagaaaagacaagaaggggccaggtgtggtggctcacgcctgtaatcccagcactttgggaggctgaggtaggcggatcacgaggtcaagagatcgagaccattctggccaacatgttgaaaccccatctctactaaaagtacaaaaattagctgggtgtggtggtgcgcgcctgtactcccagctactcgggaggctgaggcaggagaatggcttgaacccgggaggcagaggttgcagtgagccgagatcacaccactgcactccagcctggcgacagagcgagactccatctcaaaaaaaaaa

SEQ ID NO: 174395 - DNA, 542 bp, Homo sapiens
ctccctctcctttctaaacccaagtcctgtcatcccacttttatggcatctgtcccttcatcttcactcccctggccagcacccaaccttggcctaggctagtttgatattctttatactgctatcactgtcctcggtttctccctcactctattccatgctacacatccctgcagattaatttttctcaaacacaactttgatgtctccttctgttcaaaacattcggggcctccccaataactgctaaataaaaaaaccagattccttggttggcatttgggctctccatgatgtagctataaccattttctgcttctgatccatctgtctcacccaaaatagactattcagggttgtaccagaatggttctctgctggcctgcctctatctttgggacaactactaaaagaactaccatcacctttgcagttccctcttcctaaaaggcccttccaggaccacgaattcttgagggtaggataaatcccagcaccttcctgaagacttcactgctgcctcttatgtaaatctcccagcc

SEQ ID NO: 174396 - DNA, 337 bp, Homo sapiens
ttcctgactcatttcctcattctcttactggcatttcctgcaatctcttcccaaataaactactagtactcaaattcttgttccagggttggaggcactccacccaagacatatgcctacacagcagaattagttcatcaaaccaagtctttgtctcaccctcagactgtttctgaagccagacagacggggctgaacacctcagaatttccctgagtgcctcaaacggcatcttttctaaaaaacctctttatttcactgcttgagaacgactttctcttacttccatctccctcccgccacctctctctgcagtcttttcactgatggaagccac

SEQ ID NO: 174397 - DNA, 381 bp, Homo sapiens
ttcctgactcatttcctcattctcttactggcatttcctgcaatctcttcccaaataaactactagtactcaaattcttgttccagggttggaggcactccacccaagacatatgcctacacagcagaattagttcatcaaaccaagtctttgtctcaccctcagactgtttctgaagccagacagacggggctgaacacctcagaatttccctgagtgcctcaaacggcatcttttctaaaaaacctctttatttcactgcttgcttcctgcttctgcccaccctccaatggccattgttatggacacacgcctgagaaatgtgagcaccattcttgatggacccagaacacacaactgtacatccacaagattctggca

SEQ ID NO: 174398 - DNA, 505 bp, Homo sapiens
aacggtgatcaatcactttttaaaaatcattttagaagtttcttcacatccacggacattttcttctacttctacctcctcctcataattatatctttctttcttctcttcttctccttcccggccctccggccttctcttcaagaaatatttggagtgttcactgtgccaggtacaatgtaacatctcctgcagcagataccagcgcttacatctgccgccccctaccaccccgcctcccatttactgatgagtcatttttaagactcctgagaaaatagacccaaaaagtattcactacgtgttcctttccctcagagctgttatcaattaaggtagaagaataaatttctgattctgtcctattggtgaaagtggtataagattatatggaagaaagtaaatgttatatttcacttattcaacaggtttcgttgagccctactgagtgtcaggtgctgcagaggtgcagagctagggccagtaagataacacagtcctggtc

SEQ ID NO: 174399 - DNA, 712 bp, Homo sapiens
aaggctaggtgcgaggctgggtggcggcagtggtttaccctgtgacctcacttctctgtgagagacctaagaggagttgttgctttttcagtgttcagcttttgacttgttaggatggagtgatgacttctagctccaggcatgccagaccagaaactgagaatgccccatttgttttaagtatatgtaccatctctaatattctaagagcttatatctacaaggaagaaaagctgatatgtatcagacatagcatttagtaaagctctgattgtttaatacttttcagagatccccagattattgtccatcctgttaatgtgaaattaagtgggatagaattatttgacaggagccgggcatggtggctcgatcttgtggtcccacttactaaggaggctaaggcagaaggatcacttgagcccaggagatggaggctgcagtgagctatgattgcacctctgcactccagcctgggcaacagagtgagaacacatctctgaaaaataaaaattatttgacaggccaggcacggtggctcacgcctgtaatcccagcactttgggaggccgaagtgagtggatcatctgaggtcaggagttcaagaccagcctgaccaacatggtgaaaccccatctctgctaaaaatacaaaaaattagccgagcgtggtggtgcatgcttgtaatcccagctacttgggaggctcaaaa

SEQ ID NO: 174400 - DNA, 334 bp, Homo sapiens
catcagtgaatggcttgtgtttttacatttgtttgcattaaaaatgtttttataacttaaatatttgtttcttgtgtcttattcgaagaaccattttttataccaaagtcatacaggttttttttctatttcttattgaattttaggtggatatcagcctttgcttgctatatcctagcagtttttaaagtgatggatggactctttcaaagtgtctgcaagactaaaattatttttataatgatattaagatgtcatttgccctttcccccatatatgtagaattgggtctttttcaacttttattttagattcacgggtacctgtgcaggtt

SEQ ID NO: 174401 - DNA, 379 bp, Homo sapiens
gaatgggggttcaagggctcgggtcggggtaaggggattggtgtgtcatggggacagattgtcaggtttggaacatgaagaagctctggagatgggtgatggtgatggctgcacaaccacatgaatgcgcttaatgccactgaactggacacttaaaatggtcaaaatggtaaatgttgtgttctctgtattttaacacaataagaagaatgggggaaagtgaagagctagccactgagacaaccaatcacaacacggcaagggctcggcatgccaggactcggtgcccactgatcacaaggctgggaccagttcctctgaagcacaggggtagctctggctgagctttagaaggaaaatcacgttgtctttgcaaagg

SEQ ID NO: 174402 - DNA, 334 bp, Homo sapiens
ctccagtcctgagagtcaaagatctgggatctaggaagcatggaaccttgtgctggttatgaacaaatttgtccttgcattgaaagaccctaagcatattttcttcatgctaaataatgtgttatctacaacttcctggcctcggctagacctggacaagcctaggtgctcaggccccttgtcccacttgcctaatctccagcccagggccattgtcacagtggatcccaaagaggagggaaagtccttctaccaaaaggaaagtctattgaaaatgctgtgaaggacaagagaagttctccagggaattgcagctttgatgcatcctgtgtgg

SEQ ID NO: 174403 - DNA, 154 bp, Homo sapiens
atctggggacggagcaggaagactgttacttacgtcgcctgagggaaacccaccgtccaatcccccactgctgagacaggtctggatttcggacccaaggtgatgttcccttcttgattctcaacccataggctctggaactcctagagctaaa

SEQ ID NO: 174404 - DNA, 533 bp, Homo sapiens
gcgctctcgaggatttcaactacagcagcatccaaggaagagtgcaccaggagatttctctcagctccaggcatccacctgctccctcgagaggctacactttgtacctcaggcagtcctgtgggagaaaatgacccaggagctgatattcattaggcactctagcagacatagtcatggtgggtatcatggtttattcccagacagtactgaaacccaggaccaggaaaaatctgaagggtagccgaggacacatcaccccataaagtttccaaggggaaactgtgaccccccaaaattctgataagatctctgtgcctatggaagataaaaggaaaagaggcgcagagattttttacaatagtgtccagggattactctttgctttcttcttactgaaaatttttacaaacggaaaacaaatcttttaaaaagtaccatccaatgatttctcaaaaaatgattaattaaaatatagtatcaaaaatgtacactagggccgggcgcggtggctgacgcctgtaatcccaaca

SEQ ID NO: 174405 - DNA, 212 bp, Homo sapiens
tggctgtgactgcaactcccctgccttaaaaatgtaaatttaatgatcactttcaaactgtccctgtagtacattatttatgaacataggaccttgcctccctgaatagcaccaagcgcccatggctcagacactcatcagtggggccgtgccccacccactgcctggatttcctccctcctcctccttctccatctctccactctctttct

SEQ ID NO: 174406 - DNA, 181 bp, Homo sapiens
aagtacgcgagactctgtctccaaaaataaaaataaaataaaataaaatctgaccatatttttaaagagatatcattgaccatttcgactgaatactagtttttatggaacttttatgatactataaaactttaagatattttattactcatcaactactagtaacaacatttgttgaaca

SEQ ID NO: 174407 - DNA, 105 bp, Homo sapiens
ctagcaataccaagttgctcaccaaccatggcacttctacaactaaatcaaaataaatagaaaaaagtgtatatttttaaacaaagggggggatttagaatgttc

SEQ ID NO: 174408 - DNA, 224 bp, Homo sapiens
cctccacgcgcacgggccctggccccctccgctttaagcacacgcctctgccccattgctctgcagccagcttgggggcaggagtcctggactctcagatcctcctctcccctcctcttagccacaaaagaggggggagactggaggcacccctgcagcaggggcacttccctagggctccagaggggtgaatgggcctttgctcagctccaggcccagcggga

SEQ ID NO: 174409 - DNA, 595 bp, Homo sapiens
taatgcaagagcaaaccctaaagccagaagctgggtttgggcctggccccatccccatccccatctcatcaggcatcacagatttaaggagtagggctgtgggtccctggtgctctctgagcccttaagtctctggtggggcttatctctgtgtctctctttctctcccacacagatacagacacacacagccacacacacaccagagctacctcagaatggtgccttcagcatagagcctttaatcccacatgggtccagggccccactggctcactgtctctgaccgtctgtgccacctttatgggaaagagagtcagatcggttcatgtatctctgtgcctcagcttcctcttctgcaaaataggaatgctaatggtatttctatcccggaatgtctgtgaaggtgccatgggttagacagtgtgctcaactcattcaaactcaggcaagtgtacccctgcgcctgatagagaatgagtgctcaaaatggggtgtgactactgtccttcctattgtacagcgtccctggtataaggagttacgtgaacaaacgttttcagagccacctcaaagagaacacaaccagcataga

SEQ ID NO: 174410 - DNA, 287 bp, Homo sapiens
aggcgagctgcgccctgggccaggaaggtttgctgctgagttccccaaattggattccttccacagccccgagatataactcagtttgcggagcgaaatgagggaaagttagagaaaggaagggaaaggctgagcccggcggtgtctccctagcccagcaaaaccctctccatgtggcagaactccctcctctctgcttccttctggggagatctcgaggtcatttttgcgccttaggaggagcagaacttagtttctccttggcaacaggagtcttctacttcccg

SEQ ID NO: 174411 - DNA, 293 bp, Homo sapiens
ggcatcctcatcgccctctggactgcttggagcccgcccacctgtgcttttaactcatacctgagaaacacggctggtgttttacttagatttttaaatttaaaatgtctaatggaagataaagacttaccttccccaggctaacgcttaaagaatctcaattaactcaaaactaatgtcagagggaatggatgtgataagagaatcttacattacatctaacaaaaaaagtaacaaacatgcaataaaatggacatttggatcagtaagcaatcttcatactgtgttcgctc

SEQ ID NO: 174412 - DNA, 567 bp, Homo sapiens
ggaaaacacaggatccagacaaaaggggaataaaacacagaagagaatccctaagaaagtcataaaggataaagaaagtgccaagatgatggctgtgcagcagcccagattagaacaagagagcagagggctccaaaaaaaagatagtattgatagaatgcctgacaagtttgaacaaaatgagaggagatttacacttctggtggagagcctggggaatgagactggtgatgggtataaagataaaaacaaaaaaccaaagtgagcccacttatcaactccaggagaagcaaaacgttttataagaaatgtaatcacccaataggacccagtagtgaacaatgtttacatagtcacaagaacaaacgcattaaatactgatctaacgaaaagttatgataacactggctaggaggatgggtggaatggaagtgggaggtggggggtagacagcgatgtgtaagaaagctcaatcctcaccttccacactaggaactcaggattctaaaactgaaaaagaaaaatcaagaaacagctatatataggatttcttgaaaacacttgaaa

SEQ ID NO: 174413 - DNA, 659 bp, Homo sapiens
tcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatg

SEQ ID NO: 174414 - DNA, 485 bp, Homo sapiens
ctgtcgcctggaataagccccttccgctcttcgggctccggtttccccacctcgggtgcagcaacgcgcctggctcccgggagagctctcgtccgagtgggctggacggagcgcggtttacccactgaggatttggtttctcacactccttagcgaggctcgcctggaaagcgggctggccgggacacagccggcgagggcgccaggtcgcaggtcttcgcgggaccccgccgcccccccagctcccgcccaccgcatctgggctgctggcgcggcccctggcggctcggggggccgggtcttgcgcggtccttgcacttcctgcctctcccttccccaagtgtgaagacgccgggagtggagcggggagcaggagcttcttttcccggccatgggttaactctccccgccccgccgggccggcctccgacgagcctctggcctgcgtccagactcttgtttggcggcgacctgccgggcggccg

SEQ ID NO: 174415 - DNA, 880 bp, Homo sapiens
atcatcatcatcatcatcatcatctacaatgtcatttcccaccgtgcccagctgagatctgatggttttatacatgtttgacagttgctccttcacatgttcccactctctgtgcggccaccatggaagtcggacctgcccttctgccatgattgtaagtttcctgaaggacttccccctctgccatgattctaagtttcctgaggcctccccagccatgtgaaactgagtcagttaaacctctttcctttaaaaattacccaacctgaggtatttctttatatcagtgtgaaaacagactgctatactttctgataatcatgcttaagcaattggggaattcagactagctgggatcaaactatggccccacccttagcagtcatgtgaccttggggaggttgcttaccttctccgtctcaacaacttctgcaaaatctgtaacatgagattgtttctgagggttaaatgagcatagcacagtggggacactgtcaggcacacactacttgccagatgtcgagtattcatctttattgaaataggactgtggtaagccactttatggctctcgattttgtatgagaaaatcatgcttagtgccttgttagtaaaagaaagaaaacctgaaagtccctgccacggaaggaagaaatagcggggagaaaagggagttggtaagtttcagcatttcagagcttggaggggcaagttaggtttctattttatggagaaggaggtggaggcaggatgggtcctaaggtgtcattcaaaacacacagccataactctttattgagagtagagctagggccccagggattgctgtggtcaagttgcggacaaaaatgaccactcgttggaagacaggagaggagtg

SEQ ID NO: 174416 - DNA, 425 bp, Homo sapiens
aaatgggagtttttctcaatataaggttgactatgccttcttatattttgccttcttaaattttcatatctttggctcatggactgtggtgtaaagaaaccttcaattttcctataacattgtgctgctactcctgttccagcttaaaatcatttaaatacgttacttttgatatgtcgcattgtgaactcctaggttaggaatgtctaggggtaagttgatgcaaaatgaggataatcattaattattaaatttctaagatgttctttttatataccaaagctgtgttttagaaggatgactttgagtagtgtggattgaagtaggggagaggccagatacagaggacctaggctggagccagcttatctgggttcaaactttggctgtgccatttgccatgatcatgatgttgggcaagtttt

SEQ ID NO: 174417 - DNA, 595 bp, Homo sapiens
tatgagtgtatttccttatgctttcaaaaaacaatgaaaggataaaccacaaacttataactgtatttacttatagggagaaggaaggaacagagtagaggggacaggaatgaaagttaagatttacctgaatgttcctttttaatagtttagaaccatgtaagtgttttgtataattatgaaagaaaattagaacaaaaggaaaaaacaaagcaatccttagcaattaaaaaaaaatgagcctaactgtattaagttcatggcataatcacacaagtttttttattcttttttgagacacggtcttgctctgttgtccaggctagagtgcagtggcacaatcacagttcactgcagccttgacctccctggcccaaacaatcctccaaactcagccttccaagtagctgagaccacaggcatattgccaccaagcctggctaattttttaatttttgtagagatgaggtctccctatgttgttcaagctgttctcctgggctcaagcgatcctcctgcattggcctcccaaagtgctggtattacaggcatgagccactgttcccagcccacacaaatttttttcagtatctat

SEQ ID NO: 174418 - DNA, 581 bp, Homo sapiens
gtcagctatcctccagccctgacaccatgagatttaatccccgctctctgatccttgaggaaatgaagagacactgcccacagatattgtggagactgagtttgaggaatttcatcctaagagaccacgcaatgccaagcctccccaagctcttgtggaaggtggaggaggggagatttgcagacagaagcaaagcaaaagtggaagcatttggggacatccttaggtcaaggccagttggggtggatggggtaaggcaaccacagtgaacttatgaagggggctttggcccgagttcaccgactagaaaattgcagagctgagcgtgatgtggcctgaagccatggtcgtgtggctttgtttagtcaattgaattagtgaaccactaaaatgccttttctttgatttgttaaaaaacaaagggtagcaaatacatcactattgttatgagaggccgacttaggcatttggaagagcagtgcagtcacagcccatggtgtcacatcagttgtgatgggatttcttgatggatgagatgtgtcgtgtgacagagaaaatgcaagctccaaaatgattggccg

SEQ ID NO: 174419 - DNA, 323 bp, Homo sapiens
cccaattgctggccaatttagggagtagtggagagaagtagactgaaaaagagataataggagccagaaaggggacgaaaagatgaaaggaatgtctggaatgatagatacacagtactgaagagctaaagattgaagagaaagctaaggtgggaaaacactttcgaagggcagatcaggttttgcagtaactattagtggctgtgagttttaggcgctttttgtagtgttgattagttgatgttcttcctctgctctgttactgaaacctttagcattgctgatatatatgtacaaatatattgtgagttggtgaacatgtc

SEQ ID NO: 174420 - DNA, 288 bp, Homo sapiens
cgattgagcgctggaggttgaggctacagtgagccttgatagcgtcactacactccggcctgagtgacagaaggagacctggtctcaaataaaatacataacgtatataaaactccagctcctggctcttacagtcaatacagggtcattgattttattaaaaatctattctgttttgtctttggagagtctgagatcaaagaaagagtattggtttcttcagcatcacacaatatccccttgtaataaacctgcacatgtactccctgaacctaaaataaaaattga

SEQ ID NO: 174421 - DNA, 765 bp, Homo sapiens
  misc_feature (35)..(35): n is a, c, g, or t
  misc_feature (55)..(55): n is a, c, g, or t
  misc_feature (94)..(94): n is a, c, g, or t
  misc_feature (120)..(120): n is a, c, g, or t
  misc_feature (161)..(161): n is a, c, g, or t
  misc_feature (198)..(198): n is a, c, g, or t
  misc_feature (565)..(565): n is a, c, g, or t
  misc_feature (618)..(618): n is a, c, g, or t
  misc_feature (631)..(631): n is a, c, g, or t
tagccataaatgatctgtacagacataaaacaggnctgaatgggtcatatgacantttggatatattaggtccctacagagatggtagggaaantggtgccaaactgcccagatgcgtancactaatcattgaatgccagagagactacgtgggccagagnatgtggaacaatggttacatgccctctactaggtgtnacacactacacacatgccacacctgtgccatcaaaccctggtcacctactggacaatatccacaaagtagatttcattcaagacagacctaggggaccagctcaggttcagaaatgccccagaggtgtttttacttgttgagatgttgaattcatatgtccagaatgcagatgcagtagagtgctgcttaggatgactttcaagagtctggcactgtcagaggcaaatcccataaaatatcccattattggaagaaactaaaagtgtatcagtgtggctcatttttcacaagtctctcttagactaagcttgtacatattcattcagagacaattatgagcatcctttgaaatgtttaaagacccangatttctgaaatttggaagacactgcactggggataagaattaatatataggnactctagactagnaaactcaaaatcctagacttggaagcaacattagaggtcattagtccaaactgccactcaaagctggaatcctctttgctacattctttggcagatggtcacccagcctctgcttgaacatttccagaagtctt

SEQ ID NO: 174422 - DNA, 150 bp, Homo sapiens
aacttatattttgactcggggggtgcatgtgtgggtttgttacctgggtatatcatgtgatgccaaggtttggagtatgactgatcctgtcacccaggtggtgagcatagcacacaatagttacttttttaacccttattcccctctctc

SEQ ID NO: 174423 - DNA, 579 bp, Homo sapiens
ttgcatgtgggctacgggaaggaggacaactactgtcttcaaggagcaggtcttggctggtggaggaaatctgttttggacacgtgaggtctgaaatcccagacttcccagtggaggagtctggggttcaagggagaaggctggaggcaggcaccaggagtcatcaaatgggaccagctgaggacacggggagaagggcagacagagagaggttcaagggcacagcaccgctcagaggtcagggagttaaggtggagccagcagagatgagtaagagatcagagaagcaggggccgggcgcggcggctcccgcctgtaaccccagcactttgggaggccgaggcaggtggatcacctgaggtaggagttgcagaccagcccggccaacatggtgaaaccccgtctctactaaaaacacaaaaattagctgggcgtggtggagcacacctgtagtactcggaaggttgaggcaggagaatcgctagaacccaggagggtggaggttgcagtgagccaagatggcaccactgcactccagcctgggtgacagggcaagactgtctcaaaaaaataaaaaat

SEQ ID NO: 174424 - DNA, 695 bp, Homo sapiens
  misc_feature (14)..(14): n is a, c, g, or t
tgttctagaggacncgcttggatgcggctattgcttcaccttgttacttttctgttatggagacagcttcttttcttatattttatgaaccaacctctggtagcttcacttttcttctgcagcttcctcacttctctcggctttacagaattgaagagcgttggagccttatctgaaataggctttggcctaagtgtgcctggttggatcttttatacagaccactaaaactttcttcaaatcaacagtataaagccgttttacttcttatcagtcatttgctcactggagtaatcgtttacttttaatttcctttaagaactttgcatttgccttcacaacttggctaaatgtttggcacaagaagcccagcttttggcctgtatcagcttttgatatatcatcttcactaagcttaatcatttctagctttttatttaaagtgagagacatgcaacttttcctttctcttgaacccttagaggccactgtagggctgtaattggtctcatttcaatattgttgtgtttcaggaaatagatagacagggtaaaggcccctcccaaggagatggggagagacaggaatggccagtttgtagcacagtcagacatttattaagttcactgtcttaaatgggtgtggtttgtggtgccccaagacaattacaatagtaataccaaagatcactgatg

SEQ ID NO: 174425 - DNA, 197 bp, Homo sapiens
agccacatgaagaaacagtttttatgtactttaaaaatacaaagttctatatttgcaacattcaaaataaaatgttataggtgaagcctttccaccttcctatttaaaattgcatctactagatgaatatagtggggtgcacttgtagccctagctactggggagaccaaaagggtgagatcccattccccccccca

SEQ ID NO: 174426 - DNA, 443 bp, Homo sapiens
aagcccagcagctcctctcctcccaccactgactcagaagggacgaccacgttctcattcctgcccccagctaccccatggactagggggaggaggaagaaatggcttcaacaactagagcgcaggtggaatttaaaagccaccctttttctatggcaaatgtttctaccataagaaaaagtacgtcccagttattgtggccctgcatagacaaacgtttagcaagtccttgtcatgtgaacagagagggacccagcacagactggcctctgaggcatccgtccaagaggaaaggtctaggataggggaggccttggaggggtcaggccccgcaccgtatcaccccagcagcagggtggccacgggccagcgcccctggacagtccaggtttaggcctgccgtccctgcaagatctgtgatcactgtctgcccttcattctca

SEQ ID NO: 174427 - DNA, 768 bp, Homo sapiens
attctgattctattcaaaatacttagaatagctactattaatcaaatcctgacagacacagtcattagccattatttaagcattgatggaaaaaactatttttaatattcaactaaagtttgcttccttagattcaagaagcaaatgaagcccatgtaaaataaataaatctatacctgcatcttttttatgtaaaatttactttactttaggcaagggcacaaaaaaagccctgaatcaatgaggaaaagcaggtgtgtgtgtgtgtctacacatgtgcaggaaatgaataatacaaaacatactggacatcttattttgatctgctcaatatcttctccactgcttttactaaaagaatcccaatttttttcttgcagtattactcctccccataatagtgtctcagtagatttatgaataaacgtgtctctcaagtgatccaaattttcaattgtcttaaatagttggagttatgttactgacaacagtactgcagagacttcttgctacgtcaataattggaagggtactagtccttgcccataaaacctggtagttcatgcttttgattttatgaccacactttctgttgcttacaattaagggacacctcataatatgctcagtttgtgaaaagtgagtatatttataagcccaggagtccctcaaaaaaacaaaagaatattatatctcacaaaagaatcaaagtagtacatgcagtctggatagactacagacaacactaacttaaggaaacctgtaatt

SEQ ID NO: 174428 - DNA, 351 bp, Homo sapiens
atatttggggtacacttggctaagtaaaatgctattaaaatattttcacctgttcctttttattttttttataatgtgtacacttgaaaatttaaaatgactccatgtctcacattatgtttctattggctctaggctctagtctagactttatgatacaggtgaccagaagtcagagaagatctccaaacagggctgtaacagaattaaaggagtattttaaaaaagtaatcagtacacagaatatgtcccatggaaatacgtacataagtttgcaaatgcaaacatgaaaacgtatgtgtggcagcactgttggaaatgacaccaagatccatgtccagttcaataata

SEQ ID NO: 174429 - DNA, 683 bp, Homo sapiens
caaacagtagatgtgccttaaagtgaaataacaaaacacaagggaagaaaaggactattgtttgaaaagagacagacacaaatacacagaagagggttctttcactttaatagagagccaggtgctcatatcagcctacaaacagattctggagattttttatatatatatatagtgaaggggagtctgtgaaggctgtagaactaatggaagaataaatggtccagataccaccagatgtcacctttactagccccttcctttgtactcaggagctcagccttcctctgcccagtgctgccaaagctgggctgtcactcatctccattttgcattttggccgtcatgtctttcaagatcctgccgtgatgagtggaattgtacagggctagcagggggatcctggcatgatgagagagccttcctgggagcccagtacagattggatcatgccatcttctcaaaagggcagcctggcagcagagcatctcagccaagagaaaagtaagctcctccaaccctggcatcttctgtccctgtgccaagcccaaggtcaacttcatttccaatgtctaagaacttcgagacttttagtctgggaggttttttattattattatttatttatttatttttattgtatacctattactccccattctcgcccctccccccacaaccac

SEQ ID NO: 174430 - DNA, 868 bp, Homo sapiens
cagcttggctaactgcaatacggaaaataagacaatgttggctggctcaaaataaaatgacataggcaagaaaagattcaatcacttaaatgtttactgagcacccactacgagtcaaacactgttctaggtactaggaatagggacgtgaacaaaaaaaggtcccaccatcatagaactaaacttctattgggggaagcagaccatgaactctgaataaataatatcagtcagtgtaaatgccctggagaaaacaaaaagcagaataaacagagaaagcatgacattgggaaggagacagggatgcaactttaggaggaaagacatctctgagtatgtgacactgaacaaagacttgaatcaaacacaacagtaaactgcaaaaatgcggcaaagtgtgctacacggcacagccaagtgcaagaccagagaggcagcagaataggatgacagatccaagaatgaatactcagctgattatgggacaaaccccagtatatcatcatttccaactaaaggggcaaaagatgtttaaggctcaaggagaatggatttggagggaatgaaaggaagaaactttcatcattacaatctgtggcatgcccggagtcccccagaaacataaaacatgagacagaaaaccttgtgaaaagaattatctttaaaaaaaaactttcctacccacagctcaactgaaagattgcagacacaggctggttgacacatacttctctcagctgccacagaagggattcttgccttagataaagaagatggcctttggaagccctcataacctgagctctgtgagtcatatgtctatcaattctttttcttttttttgagacaagagtctcgctttgtcacc

SEQ ID NO: 174431 - DNA, 610 bp, Homo sapiens
ctatccccagctgatgaatagaggggatgagtgatacacgaatgagtgaatgaatgaatggtaatggtgatgggaatcaaatggcagcaacgcggaagagggagatgcggtgcctgtaaccatggtaacgatgatgtcgctgagtgataatgctaggaagatggtaaccatggtaacactgatggtgaggcctgctcggacagtcctggcgcctcagctgccgtggtccatgccaagcccgacctgctcagtggccgaacaagatgctaagcacaattagcaattgctgttctgttccctgtcccaagacccccgcccagggctgagtttcacggtagtcaaaccctcttcctgagtggctccaagactcaggaaagaacacatgtttggggggcgggaggggtggcgtgcagcttgcatgcatgtgtatgtgcgtgcgcggaagaggctgtgtgatgggcaagtgggtaaggtgtggtgtgcgctaagggcagtcctgctggtgctagcgccaggggactgggaagaggaacggttcccttcgtgcgcgccgggctgatgcgtggggggcgccgcgtgagtgcgccggtggctgggagtccggcggccg

SEQ ID NO: 174432 - DNA, 933 bp, Homo sapiens
  misc_feature (24)..(24): n is a, c, g, or t
  misc_feature (253)..(253): n is a, c, g, or t
  misc_feature (261)..(261): n is a, c, g, or t
gctccggccgcaaggtgagcaggnagccctgccagctgggccacccgaggggcgttgcggggctccgggcggggtcgacccggggggctccgtcgggccccaccagccttgcgcctttttcgctcggtctccttggcctcccgctcctgcgacgccgctttccttttctcttgctcccgagctcggacctcggccaggggccccgcccgccagttggtcgcctcctgcagcaccctggaggcccagggccggnggggcggnggctgtggggatcccgggcgcggccaacctgggacaatgagcaggaacccagggtcttgctgtgttgctgagctggtcttgaactcctggcctcccgcctcagtctcccaaagtgctgggattacagggaatgtgacttcactggacgcagtataaagatcttcagatgtcctcctgccggggattgcagggatcacagaaagaccatcgaggtccaggagctacctgcaagcggagatccctctggacgccccgtgcctcacccagcaaagccggctcacaaccctgcgctctcaaacctctaaaagggcttgaggtgccaataggaaaggaggcccgagattgccacggcatacgtgggccccaaggagggagccaggagtcactgcctgcttgggctaagggtaccgcgtacggaaaggcggcggggacgcggcccagttccaggagatgcgcccaacgaagaagcggaggaacagggtcacgggatagggcagacacccggctgctttttgtttgctagacaccagcgccagcccctgcccggccctcccggtctcctaagggttgggggggtgtcttaggctccacagcgcccccgaccgccctcctgcactcctcaccgtctccattgcaagaggcgcccggcttggtttcctcgctttaggaaac

SEQ ID NO: 174433 - DNA, 706 bp, Homo sapiens
gggaaaatcacacactgaggcctgttgggggcgggggacaaggggagggagagcatttggacaaatacctaataaatgcagggcttaaagcctaaatgatgggcggataggtgcaggaaaccaccatggcacatgtatacctatgtaacaaagatgcatattctacacgtgtatcccagaagttaatgtaaaattttaaaaaaatcaccactagattggacatacaaaaaatgcttaaatgaattgtaaacatgaaaacaaatggaagatactcactgtcagacaaagacacataagtacaaagttcacagatcacacaaagcaattacacaatggaaactccaaaataactaacactattgtaataggaagaaaacctcacatatcaatattaatcttgcatgtaaatggcataaatactccacttaaaggatacagagtcacaaaataagacccaaccatctgcagtctacaagagacccacctactggccaaaggcacaatgagactcaaagtaaaacggtggaaaaagatacaccatgcaaatgaaaaacaaaagcaagcaggaataaccactttcatatcagataaaacagactttagatcaacaatggtactaaaatataaataaggtcattatatattaagaaaagctccaataaaagaagatttatttatttaaattatatatgcaacagacactgga

SEQ ID NO: 174434 - DNA, 325 bp, Homo sapiens
accacagttacgtaaccaacagctcagcatctttctttacagctgttgaactgctaggtaaaaagtagtggtgcaaaagtaattgcggtttttgctattgaatataatggtgaaaaccgcgattacttttgctccaacctaactagaaaatagcattctatattatagatgaaaactcacatgtccatccatgaaaatgggccttatctagttgaaatccaaactccactcctatggagctggggggttatgagggctgaggggcctgagtgagacagcctcgggatggcctagggtttatgaaggagccatagaataatatgtt

SEQ ID NO: 174435 - DNA, 325 bp, Homo sapiens
taatattgcagttttctatagtgttaattccacaaaaggagaaaattctaaaatccccaagatccaacaataacatatgaaaatcatgttaaataatttttgaggatttaacactgatactatgacccatcacagtgcatctctaagtcaatcaagtttagtatataccatttagaagactaatgcacagtcttctaaagtagggaactatggccctacacctaattttatcatgaaaatgctctggttcatccccatttttagacacttagacagacacacattcacaaagaatgtgacccaaatctcaaatcctttgtactgt

SEQ ID NO: 174436 - DNA, 460 bp, Homo sapiens
ggatagcattaggagatatacctaatgttaaatgacgagttactgggtgcagcacaccaacaaggcacatgtatacatatgtaacaaacctgcatgttgtgcacatgtaccctaaaacttaaagtataatttaaaaaaaaatgccttaccatgacccacagagcctaccctcgactggcttctgcctgcttctttaacttcatttcatctcacctcttttttattgactatactctggctgttctgaactcctttctgctcctccagcacaagcttaggccatttcacttgctgttcttagtacctggggtactctacccttaactctataaagccggctccttcttttcttcagatcttagtttaaatatcagagaggtcttcccctcgcactcctacctctgctaaaatcttgagctttacaagagttgaggcctaatcttgttcaccactgtattcc

SEQ ID NO: 174437 - DNA, 460 bp, Homo sapiens
ccgtaccaccctgaaagtgctcgatctcctcaaaagaaaacatcaaccacccacacaaataaatgccactgtcaacaaaaccaccaaatcaaccgtgctgacgtacatacgtcatcagagtgtttctccagacactatccctttaccacgaaagagcaaacggtgacaaaagtttctgtagaaaccaaactcctggagcacttttataatgtccacttatctaagaaccaccacaatacagaactttaaagagagaaatcaacaatatgttctcacttaaaatgcgctggatgtcatgacccaccccactaacgtcctggctaaatgatgaaaggacgttcagccttttccttcctttttcattttctctttaaggaaacactgatagttcctaaaataagcaccattaggaagagaatacttaagttcactcatttgacattcccacaaaatcagtacc

SEQ ID NO: 174438 - DNA, 312 bp, Homo sapiens
cctcactgatggcaacatgtcaaaggagcacaagatctaacagaaggatctgccagtggctaaagctggggacagcttaagcaacaaagtaaagtagtattggatggttaacccaaactataaaataaatgcccatgagtccgtatgtatataaataaatgatttgataaataaagaggaaaaaatgggtaagtcaccttgcagaagaatcccaaataacttttgtcgatactcccacctcaaggaagtagaacataacccttcactttttcagtataggctgctcataatgaccttccaaagagtaaagta

SEQ ID NO: 174439 - DNA, 221 bp, Homo sapiens
ccagaagcaaggagctgatatgaacgaatcctcacaggactgtaaaacaaacacaatcaggacacctcagtccgtgggaaaatgcggtgcaactgaatctctggatgctctgtgagaaaaatatattttccccttatagaccaattatttaaacttagcgtgtctctgaagctctctgaaatcccctcaaaagaccccagttgtgatcattattcagtata

SEQ ID NO: 174440 - DNA, 318 bp, Homo sapiens
cctcacagtcactgaagccttttgtacctggcccagtgttcattctaagcctagcttctactataatcctgggttactataatagtcatgtaaatgatcatctgacatcctagcttcacaggtatcttaaccactccagttttgaaatctaacactccaaagtctactctgattacaggtcctatcactccagttttccaattactcagcactcaccttgttcacattaaagcctctttttggcccagactgaggctttaatgtgaacagagtgagacttcagtttaaaaaaaaaaaatccaaccgggactagagggg

SEQ ID NO: 174441 - DNA, 594 bp, Homo sapiens
ggtcggtaccgtgtaggatactatttgcagtgagctatgatcaccccactacactccagcctgggcaagagtgacacccagcctcaaaaaaaaaaaaaaaaaaaattcaagttgcaatagcatcataaagaataagatacttaggaataaatttaaccaagaaggtgaatgacctctatgcttaaaactgtaagacactgctgaaagaaattaaagaaggtataaataaacataaagacatcccatgttcatggatttaaagatttaatatagttaaggtatcactgttaccaaaagtgatctgcagattcaatgccagtcctatcaaaatcccaatgatgctttttgcaagaagagaaaactccatcctaaaatttatatagaatcttaagggacccccaatagccaaaacaatcttgaaaaagaaaaaaaattatctcacactttctgaattcagaacttactataaacatatggcaatcaaaacagtgtggttctggcataaaaacagacatgtagaccaacagaataaaaagcccaagtgggcatggtggtgtgtgcctgtatttctacccactgaggaagcttagacag

SEQ ID NO: 174442 - DNA, 685 bp, Homo sapiens
tactcttaaatctgtagggtgcttgttggcagtaagcagacaattgaaacaatacaaatatcataattacagtctggccaaaatgtaaaggaggcatagaaaaggcatattcctactttaaggagaaaatgccataagaaaggtactcctaaactaggacttgaagaccaattaattagctaggcaaatagagaaagggataagagaaggtgaaggaagggcatgcataaggaactagaaatataagccagcatgcgtagtcagagaactccaaatggtaccttataggtgaagagcaggtgagaattagggattcttcaacataattagtcattagggaaatataaattaaaaccacagcaagaaatcactagaaacctattataatggctaaaaattttaaaaaaaaatgacaatacctagtgctaagatcaacaggaactctcatacactgctggtagaaatgcaaaccagtgggccaggcacagtggctcacacctgcaatcccagaacttttggaggccgaggcggacagatcacctgagctcaggagttcaacaccagcctgggcaacatggtgaaaccccgactctactaaaaatacaaaagattagccgggggtggcagcagatatcatatccctccacagcatggctggtttctgtcactcaacaagcacatgaaa

SEQ ID NO: 174443 - DNA, 424 bp, Homo sapiens
caggaggattacttgaggtctggagtttgagaccagcctggtcaacagagcaaaaccctgtctctaataaaaatacaaaaattagctgggtgtggtggcgtacgcctgtagtcccagttaagtgggaggctgaggcaggagaatcgcttgaacctgggaagcagaggttgcagtgagccgagatcacaccactgcacttcctcctaggcaacagagcgagaaaagagaacactcccttttaattgccctttaattctcaacaactactttgtagtacattgttatggggaatggaggtaatatagtaagacacccagacaaatgcctagcacatagcaggagattaataaatggggaatcatttaaatgtatgtatacattttgtcatatacatattgaaatttattctcagaaccagcaactt

SEQ ID NO: 174444 - DNA, 373 bp, Homo sapiens
tggaaaaaggttagtgacaccaaagaatttaaaacaataaaagtattgtcatttcaaaataaaactgcttcaaaatacacagcatctgtggcattagaagcacaatttgaaatcttggcaaatttagaaaactctgagttcacaccataaatgggcatcaatgccagagcacgctggtaactgtgactatgccgacgtgaacggcagatggaggctgacaggagaacctggcccattttccactctctctccttagcgaagcctggtgatcccagtgaagcaactccggccccctaactctcacgatagtctctctgcctgtgaggtatccctcaggacgcctgaataaaatgtggctaacctgctacatgag

SEQ ID NO: 174445 - DNA, 384 bp, Homo sapiens
ggcagaggaaactcgtggtgatgtgtacctcaatgtaggatttagatgtgtctcttctgtttggtcattaatgactggaaactacttggcatacttattaaggaaactgggaatcagaaggatctttcttacgttaatacacagtttattcaaaatatatgtcaaatcctgccccaaagttttagaactagtaacacttactcagtgagttgagtaagttaaaaagccaacactatcttggtctgcatagttatacaattcttcataaaatagtattgcttatttgtttaaatcaaaacagccccatgaggtaaccaaggaaagcatatttataagaaacgggtgcgcatggagttcatgtgagccataaaacctcccagagtg

SEQ ID NO: 174446 - DNA, 549 bp, Homo sapiens
ggcttccttggagagtgtggcagtgctttccttgctaatgaaaaggctgtcataatgggttaggtccataggggctctgcccttctgtacttgtattcccagggagaaaaatctctaccttaattaccgacatctcatgctggcagagaggtgtggttgctaattgattagatgacagtccttttcattgatgtggcactgttggggtggttttgttgtgctttttcaagtaaacagatagatttgggccaggtaagttgattttggagagatgaagttctgtgtagggatttccctttattaagctcatgtctttagtgccacttttgtgtcctgattttctaacttgatagtaagaagtactaagttggcttgtcttgctattttggtgtgggtggtgaataatgtctcttctaccctgctctctggtgcgttcctgttctgtttggtagcaccacattcctctatttcgtttggttttcattccctctttctctcttgtaatggttggacccttggggctaaggttggggcttaagggacccttgg

SEQ ID NO: 174447 - DNA, 278 bp, Homo sapiens
attacaggtgtgagccaccgcacctggccttatagtaatacatttaatactgaaaatatacctaacactaattgatatcttatataaaagaaatggtgttatagttagtgatatgaattaagcaacaagagatagggtagctgtcaaatgtacctgttttgtataaatgtagagaaaaagagttgagtgagtggaaaagaggggaaaggtcaggtaatgttacagattctccagttctgagaaatggcgtctcttcaatgaaacctccggtgattcca

SEQ ID NO: 174448 - DNA, 367 bp, Homo sapiens
gatagcattaggagaaataactaatgtagatgatgggttgatgggtgcagcaaaccaccatggcacgtggatacctatgtaacaaacctgtacgttctgcacatgtatcccagaactttaagaaaaaaagaaagcatttgaagcagaggtattcctaacactgacaaggagtccaggggactcgagcttagaattcaggccgccctgggcccaattccatgaagagctgtgtgaccctgggcaagttacttcattttctaagcctcagatttctacagggatttttgtaaggattcaaaacaatgtggtatatccatagatgttcattataacattgttctaaaaatcaaaaaaggaaaccaactaa

SEQ ID NO: 174449 - DNA, 515 bp, Homo sapiens
tatcctctcagtactcaatataaagctattaactacatagggagtgaatctgccatcttgcccataatatcacaaagtgctaaataacctaagtaattcaagtaatggaaatgactcatttctgctgatctaattccatggtcccacaggagagctataggtattaaatgcagtacatgtatgttaagtggaatgatatacattacaaattaggaaaaagagtaattctgaggcaaataggaaaaagtgattttgttacacatgatattgtgagctcaggtctctttcccatcttctttctttcctacccaagtctcatcctgcaaggtctttctcagatttgaaagcagctgataaacaactaatttccttaagatggctgttgataatagctcaaagtattacttctctctaggggtatgtatactttaatagaaaactcaaaaccttcaattccaaaggaactgcagtcaagttagcagggaatattatactgaagacctcttggcagttac

SEQ ID NO: 174450 - DNA, 217 bp, Homo sapiens
tctaggggagaaggaaaaagctgtgattaggaaagggagctttgggttgggagtcagggatatatttctgaagtattggaaatactctgtttcatgaccttggtggtgattatatggttgttcatgttatacttttaaaaaattgaattgtatgtttatgatttattcacttttcttcatttatgttcgacttttgttgaggctaacttcttcattg

SEQ ID NO: 174451 - DNA, 155 bp, Homo sapiens
ataacataggatgtataaataaaaatgtaggtgaatttggcaattctctttggtctatacatattatatacacacataaataggctataagttaatttcacttaaggtgaaataacagttgcacaactcagatttctcaaacttgaatttatttt

SEQ ID NO: 174452 - DNA, 406 bp, Homo sapiens
ctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagag

SEQ ID NO: 174453 - DNA, 319 bp, Homo sapiens
cccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaacgctgcctctctgctcgggacgtgg

SEQ ID NO: 174454 - DNA, 143 bp, Homo sapiens
tggtttgacaatgaggccactggggcctatgtaagtgctatgcctgggaactatacagaagacacagataaaagtataaaaagaagagtgctcaaaaaactggtaactagttgaatttggaagatgaatgggagatgtactaa

SEQ ID NO: 174455 - DNA, 484 bp, Homo sapiens
tatgtacttgtgtctagaatcttttgctcaacattatgcttattgtgtgattgtaattcattcattttcattgttatgtggtactcaatcatgtgaatagaccagtttgtttatttgttctattgttgatgggcattggggtaactttccagtgtggggccattatgaatgatgctattgtgaacatttctgtccctgtcttttagtgagtgtatatatctaggaatggaattgctgggccactggatattcatttttcaactttagcagttaaagctagacagtttgccacagtgatattctgatttctacctcattagcagtgtgtgagagttcagttgcttcacattcttgtcaacacttggaattttgactttctaaattgtaaatagtcaccttcctttcattttgtgaggaaatagaaactcaaataagtgaaatcacctgtccagtaccaggcttggttctaagaatgcaaaagacc

SEQ ID NO: 174456 - DNA, 227 bp, Homo sapiens
tcaaatccacaatgctgggaaacaccatcatttaaggcagtgttactgaatatatgagctgagttattatgcctgtgtcaaaattacgtgggctgcttgttaaaaaaaatacaggttcctgggactcatccaaggttaatgaattacgctctcttggggcgggatttgggactctacatttttgaactgcctcaagtgctttttaagtgtgccttaaaatttgagat

SEQ ID NO: 174457 - DNA, 326 bp, Homo sapiens
aatactggttgcccaagatccaggatggccaagccttaaggggatattactgtcatacaagatgagcaaatgattgtcatagtactgtcattacaaaatcacacacacatacacacacacccctactataaaaacattcaagggcttatcaatgtgagaaaacccgataaagaccccaacccctcaggaccagattgaactagtctctcccacagctcttttactatcttgacttttctacagctctgtgcatgcatgcctgtctctagggatggttacacaggcatcacaatagcagaaattcctcatgcagtctctaagaaggg

SEQ ID NO: 174458 - DNA, 478 bp, Homo sapiens
gccctccccacgtgctcaagttgtttccagatacagaggctgggttcggcgactgagaaggcccccaaatcccttcaagctcctcacaagtgagaagctggggtcacaggggccctaaccatcctgagatgctctaagactgcaaacccgaacctctggggcctggctgcccggtcttggccccatcccagcacgccacatgctgacatgtggtcccttcagggcaaggcctcactgctacctggaactaaacagccacgctacctacctgggggtgtcccccaaggcaccctgagttgctgaaaggaatacagatgacagctagaggcacaggggttggggagcctcggggccaggctcctgtgttccctctcaggctgggtccctttaatttttggcaggtgctccctggggcctggcctcaactgtgaaatgggctaatcctccagcttgcagagtggacaagggtcagcggccg

SEQ ID NO: 174459 - DNA, 314 bp, Homo sapiens
atgagaaaactaaggcttgcagagagtgaacaatttgcccaaggtcaccactgataagtagtaaagaaaggatataaactcagctcagtgtgtcgcagagttcatctctctccattgtacagttacattcccaaccaacatgctggggctgccatgccaggattactccactctgttgctttttattaaaaaattatgttacatattttattacacaattattttacataaaataaaatgtacagatcaatgagttttgacagatgtatatatatatcattgtaatcatcagccaaataaagttatagactcta

SEQ ID NO: 174460 - DNA, 616 bp, Homo sapiens
tatgaaccacaaaatacaaggagggactatgggagagaagaattctcatggctgtggagtctagattaaggcagcagaggatagttctccaaagtaggaggcacaccttgatttgagaggcaacaacctgtttggaatgatagaaatatggtgggcaagctggcagcagaagctttcctgcaatctcactgccttctgcccttttagctccaccatttctaggtcactctcttacgtaccctaactccaagaatccttcaaacaacctccttctggaacaaaccattcattctgatctggttgccctcacccacctcatatcaccttccttgtttacccagtttaaatttcttgatcaattattgtatcagttatttgcatacattcttaatttccttgcccttttttcacttcctcttactcacctgggaaaattccaaccctgctttatcttagattctgagctttgacttgtgcagctgaatgtgggtggcgaaaaccccacaaccgtgctgctgtgtctcaaacgtgccgctgaggcatctggtgggctctgactgctgcttgataatcagagtacatgttcttggtcctttcaccctcctgctcttctaaa

SEQ ID NO: 174461 - DNA, 189 bp, Homo sapiens
aggcctagggtgggttccccctgcttggtgtctctggcccctgctctccattctgaggcctgacaagcacccaacctccaaagctgtgttttcctgggggagtgggtgttgggaccactggcacagaactcgcagcttagctacatgtttgttccagacttggttaatcaatgcagcagtaaacccgct

SEQ ID NO: 174462 - DNA, 457 bp, Homo sapiens
cccctgatgtagagaattggagaccttgttaagaatcttattcttgaacctttggattgtgagaagtgataaaaggattttaagcaagtgagtgatatgaaaaggtttaaagggatgacaagagtgattgtgggagactgattaagcttttgcagtgggccagataatagatgatgctaggttggtctagggtggtagtagtaaggattgaaaagggtggatagatttgaggtatgtttaagaggtttggttattgaattgggggtgggaattaaggaagtgggaagagttaaagctgcttctgggttactggcttgggcaatagggtaaatatcatttgaaaaagggattactagaggaagaactggttaggagaaaagggaatagtgtatgagtggctctgttggagacacgttgcataggaggcaccaatgatatatccatgtcaagctggcag

SEQ ID NO: 174463 - DNA, 152 bp, Homo sapiens
gtatataatcaaaagaaatgacagtatacatccacaccaaactcatatacaaatgtcgcagcagcattattcataacagccaaacaactcaaatgcctatcaagtgattagtagatgagcaaaatgtggcctattcatacgatgaaatatta

SEQ ID NO: 174464 - DNA, 281 bp, Homo sapiens
tatgagaatatccgtgatttctagtagtgacaaagtcacagatattgctaatccaattgtggtttattgccctgtgcataaaaaaatgttaatttcagttacagggtagcgaaaatagagatgtaatgtttttcccagccaacctcgtgacccactaatcttccatccttcaaaggtccatggacccgagattaagaacccctcaacgagacccgaaagaaggtaaaggcggagcagcttccaagggaaaagaacaactggggagtgtgggggcagattca

SEQ ID NO: 174465 - DNA, 320 bp, Homo sapiens
ggcttatttacctgcttgtagtttatattaaaaagtaaattatcattgaatgagattttaggtctttctgaaaatgagaaatttccattgaaagatatggctagtcatgtttttgttgcttaagattttatagctggaaatactgcattttaaaaatatcttcagtttttcatccacattacagctaggtgctcctaaatgtgttgaaagatttctattaatatatggtattaaatgattcataatttgaagactcttaaagttctttgatcttatagctaaaaatactgcaggtattatagttactagaaaaaatttcc

SEQ ID NO: 174466 - DNA, 376 bp, Homo sapiens
ccacatcactcctccctccctctctactacatctaacctacttttcacagataattccacagaaagatgagtttaaagttagtgtcctttcttggacagtacatttttcaaaaattattagtgaacacattgttgtagtttctatcatgagtttcttgctgtgtttattaaacatttgaaacaaagttggagaaatttgtggaacaattagagaattttgccaaatatctcattttttcatatttcttatttattgggtcctgtcatgtttagtaagtgtcttaagagtagaagtttgagcagctattcagtcttacactccgtaattatttggcttctattctgtatacctaataaagcatttaattgacagttc

SEQ ID NO: 174467 - DNA, 777 bp, Homo sapiens
atatatatctgcatctatatctgattacattgaaagttttctccccaaaaaatgttttgtaaaaaagtattcacaatgcagatgaaaaggactatatttgttaatagaaaatgctattaataaacataacagacatgaatagaatgttcacaggaaaagaaaaaggtgtccaataaacagtaaaaagtttattctccctcagaatcaaaagcataaaaattcagcaaaaaatgagtgcactgttgtcatccatttgattagcaaatatcaaaaatttgataaatgggttcgcacctgtactcccaactactcgggaggctgaggctggaggaccccttgagccaggagttcgaggtagcagtgacctacgatcacaaaactgcactgcagcctgggtaacaaagtgagccccccatctcttaaaaagaaaaaaaaaaaaaggataaatacacagtattgataaggatgtgtgtatttaagcattctctagcccatagatcaaaaaactacaacacttaggccaaatccagtctactacctgtttttatacataaaattttattgaaacagccacaccatttatttatgtattgccagtggctgcttttcacactaggatggcaaagttgagtaactgcaacagtgactacagttccctgagaactgttactttctggctctctgcagaagaagttggctgaaccctgttcaagcctatgtatgggaataaaaacaagctataaaacagtcaacctaaaatgcatatgttttgaccca

SEQ ID NO: 174468 - DNA, 856 bp, Homo sapiens
  misc_feature (27)..(27): n is a, c, g, or t
  misc_feature (33)..(33): n is a, c, g, or t
gtgaatgtctgcactgactctcttatntacacngctacggtgtttctgggctacgtgaggcaaaaataaaaacagagaaactcaccacagtgtttttccttggatcccatgatgcccagatgctctactttttccttttacctttcagaaggtgtttttataacatgtaaaatccagggttttcgttgtaccaagtagaggaataaggaaaaatacaccaactccatatttccggaagaatacaaccaatctgcatgtattcattgttcttattcgtgcttagctttctctactgcagtttcatatggtatgatgaaaacataatatgttggataccagtattctgtatagggtattctttcattgcaggcctcaaatagactttcaggaaatagacttttacaataacattaggaggctaggtgatgaagcgttagtcctacagaagcagaaagtttcaactaagacttccacataaagctgtagccctgaaggtcttccccatcagtgaagaagtgaaacacccaacacagagaaggaacaagaaatctcaactggtcagagagagggaagagtggggacaagtctccattgtgaatggacaatactaatcttttgtcacatgcgggcttggagttcaaaacgatactacccatatttggaaattgtcacattgagaagttaacacaaaaatggtactggtgtgtaaaacccctagagttgctgatgaagccagtgtaaaattattcttaaaggacatgacatatcttcaactaattccacaataaaaactgactggaaaggagctctcaatccagtactacgcaatacaaaagaaaaatattcactgtgaaca

SEQ ID NO: 174469 - DNA, 2387 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttgtaaggataagttacttaatttagtttcacttggtcataaagcatgagacagcctcatttactggcttctgcttttaatgctttatcaaggataaggaggaacttctaatcattttttttgaaacttttatatgtgttaagttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagggaaaattatgaacagccacaaagacttttttacttctgaaaaaaaaaaggacaaaataatttcagcaatttcaagtgtcattttcctgaagtcctggtaacataacaagcatttggctgctttttccttcacgttcactgcaacctgacagatgagacacatggactccctcttcctcccattccacctccacgacatttattttaaagactagagctttcctcctccaggatgttttggagaggatctagtgcatggacctccttgttgactgctgttcttcctgtattgtttcattaagttccaattctacacccacagccagagcatctccagggatgactttctggtatttcttaccattttatcttcctcatgccatttttcattgtgttccaattctttccatttctttgggttttgttgcactggctaatgtatttcttatacagaatatctctttatccttgatttaccaaatagctcccaatatctggctttgcctttcatatcattccatacctagacttttccctgtggttcttcattctcagagtagtttttgtcacatacacatacagcatttggaaaggcaattaataaatctcattggaccttccctctgccctgatccggaattggcagatatagcatagcacaaaattgttattgctgggttttgaccccaaagtaaagagaagctcttctcagtttgtttgaaattttatggaattttgtggattaaaatttctatgctc

SEQ ID NO: 174470 - DNA, 3962 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttgtaaggataagttacttaatttagtttcacttggtcataaagcatgagacagcctcatttactggcttctgcttttaatgctttatcaaggataaggaggaacttctaatcattttttttgaaacttttatatgtgttaagttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagacggagtcttgccctgtcacccaggctggagtgcagtggcgtgatctcagctcactgcaacctctgccttccaacttccagcgattctcctgtctcagcctcatgggtagctgggattacaggtgcacgccaacacacctggctaatttttgtatttttattagagatggggtttcaccatgttggtcaggctggtcttgaactcctgacctcgggtgatctgcctgcctcggcctcccaaagtgctgggattacagacatgagccactgcgcccagctgacaaaagagaatttaacagtttacctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccagtgaaattctgggagaaaaactacaagtgtttctgggctacgtgaggcaaaaataaaaacagagaaactcaccacagtgtttttccttggatcccatgatgcccagatgctctactttttccttttacctttcagaaggtgtttttataacatgtaaaatccagggttttcgttgtaccaagtagaggaataaggaaaaatacaccaactccatatttccggaagaatacaaccaatctgcatgtattcattgttcttattcgtgcttagctttctctactgcagtttcatatggtatgatgaaaacataatatgttggataccagtattctgtatagggtattctttcattgcaggcctcaaatagactttcaggaaatagacttttacaataacattaggaggctaggtgatgaagcgttagtcctacagaagcagaaagtttcaactaagacttccacataaagctgtagccctgaaggtcttccccatcagtgaagaagtgaaacacccaacacagagaaggaacaagaaatctcaactggtcagagagagggaagagtggggacaagtctccattgtgaatggacaatactaatcttttgtcacatgcgggcttggagttcaaaacgatactacccatatttggaaattgtcacattgagaagttaacacaaaaatggtactggtgtgtaaaacccctagagttgctgatgaagccagtgtaaaattattcttaaaggacatgacatatcttcaactaattccacaataaaaactgactggaaaggagctctcaatccagtactacgcaatacaaaagaaaaatattcactgtgaaca

SEQ ID NO: 174471 - DNA, 3658 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttgtaaggataagttacttaatttagtttcacttggtcataaagcatgagacagcctcatttactggcttctgcttttaatgctttatcaaggataaggaggaacttctaatcattttttttgaaacttttatatgtgttaagttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccagtgaaattctgggagaaaaactacaagtgtttctgggctacgtgaggcaaaaataaaaacagagaaactcaccacagtgtttttccttggatcccatgatgcccagatgctctactttttccttttacctttcagaaggtgtttttataacatgtaaaatccagggttttcgttgtaccaagtagaggaataaggaaaaatacaccaactccatatttccggaagaatacaaccaatctgcatgtattcattgttcttattcgtgcttagctttctctactgcagtttcatatggtatgatgaaaacataatatgttggataccagtattctgtatagggtattctttcattgcaggcctcaaatagactttcaggaaatagacttttacaataacattaggaggctaggtgatgaagcgttagtcctacagaagcagaaagtttcaactaagacttccacataaagctgtagccctgaaggtcttccccatcagtgaagaagtgaaacacccaacacagagaaggaacaagaaatctcaactggtcagagagagggaagagtggggacaagtctccattgtgaatggacaatactaatcttttgtcacatgcgggcttggagttcaaaacgatactacccatatttggaaattgtcacattgagaagttaacacaaaaatggtactggtgtgtaaaacccctagagttgctgatgaagccagtgtaaaattattcttaaaggacatgacatatcttcaactaattccacaataaaaactgactggaaaggagctctcaatccagtactacgcaatacaaaagaaaaatattcactgtgaaca

SEQ ID NO: 174472 - DNA, 3051 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttgtaaggataagttacttaatttagtttcacttggtcataaagcatgagacagcctcatttactggcttctgcttttaatgctttatcaaggataaggaggaacttctaatcattttttttgaaacttttatatgtgttaagttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccagtgaaattctgggagaaaaactacaagtaagatcctaaaatcagtgctcaattgcttttctccagtttgcacttcagaaggctcctctgccttcctctgttaggaggtccctggctccaggcttccccctgctgtggggccaggccaaacctgtctctcttgatgacctcctcagttcattgactcagctcttgggtctcagggatctggaaagaacatgactgatttcaaattag

SEQ ID NO: 174473 - DNA, 2395 bp, Homo sapiens
gcaggagccttggcaacacagttccccatgcttatcgtcaattttgtttgttcattttcagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagacggagtcttgccctgtcacccaggctggagtgcagtggcgtgatctcagctcactgcaacctctgccttccaacttccagcgattctcctgtctcagcctcatgggtagctgggattacaggtgcacgccaacacacctggctaatttttgtatttttattagagatggggtttcaccatgttggtcaggctggtcttgaactcctgacctcgggtgatctgcctgcctcggcctcccaaagtgctgggattacagacatgagccactgcgcccagctgacaaaagagaatttaacagtttacctcggggacctgcttcacaagttacagttcgtcctgacatatgtggctccttggcagatggcttggggttcttcgtttcacgtgtttgctcagctctttgccattcctcattctgccatgcttttctttcagacgattgccacatcaatcttttctaccccattgagcccatttcttgggagtgtcattttcatcacatcatatgtcaggccagtgaaattctgggagaaaaactacaagtgtttctgggctacgtgaggcaaaaataaaaacagagaaactcaccacagtgtttttccttggatcccatgatgcccagatgctctactttttccttttacctttcagaaggtgtttttataacatgtaaaatccagggttttcgttgtaccaagtagaggaataaggaaaaatacaccaactccatatttccggaagaatacaaccaatctgcatgtattcattgttcttattcgtgcttagctttctctactgcagtttcatatggtatgatgaaaacataatatgttggataccagtattctgtatagggtattctttcattgcaggcctcaaatagactttcaggaaatagacttttacaataacattaggaggctaggtgatgaagcgttagtcctacagaagcagaaagtttcaactaagacttccacataaagctgtagccctgaaggtcttccccatcagtgaagaagtgaaacacccaacacagagaaggaacaagaaatctcaactggtcagagagagggaagagtggggacaagtctccattgtgaatggacaatactaatcttttgtcacatgcgggcttggagttcaaaacgatactacccatatttggaaattgtcacattgagaagttaacacaaaaatggtactggtgtgtaaaacccctagagttgctgatgaagccagtgtaaaattattcttaaaggacatgacatatcttcaactaattccacaataaaaactgactggaaaggagctctcaatccagtactacgcaatacaaaagaaaaatattcactgtgaaca

SEQ ID NO: 174474 - DNA, 2514 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaaggtgtttctgggctacgtgaggcaaaaataaaaacagagaaactcaccacagtgtttttccttggatcccatgatgcccagatgctctactttttccttttacctttcagaaggtgtttttataacatgtaaaatccagggttttcgttgtaccaagtagaggaataaggaaaaatacaccaactccatatttccggaag

SEQ ID NO: 174475 - DNA, 2305 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttgtaaggataagttacttaatttagtttcacttggtcataaagcatgagacagcctcatttactggcttctgcttttaatgctttatcaaggataaggaggaacttctaatcattttttttgaaacttttatatgtgttaagttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagaggttagtaatatatccctcattta

SEQ ID NO: 174476 - DNA, 2840 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttgtaaggataagttacttaatttagtttcacttggtcataaagcatgagacagcctcatttactggcttctgcttttaatgctttatcaaggataaggaggaacttctaatcattttttttgaaacttttatatgtgttaagttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaaggcaagtgaattagctattttcttcattttaacattttaaagggggctgttcttatcaaatgttttaagagtttaaaacttattctttataaaaaaaattatgggaggatatgaaattgaattatacatgtatgttaaactcttgctaccatttggggaaaactgcccatggaatgtaagtatgccatgttatttgctaaaaatcactaattaaaatgaattagccattagtgtgactt

SEQ ID NO: 174477 - DNA, 3060 bp, Homo sapiens
gacgagggtatccaccaatcagtgttctggctacggatctggggaggggggaaatgccatcaaggatcacagttcttcatcacgggaaccctgggaatcggtgtcccggcttacacctgatacaggctccgagtctaaggtggggaaggaaggccagactaaccttgacccatcgtcttgtaagtccagccatgaaaagaggcatgcccgggtgctcagtgtggacagtgggacagatgtcttcttgagtaaaagttctgcagaaattgttaacgatacagagaaaacaatgccaacttccaaatctgacctagaggctaaggaaggacaaatgccaaatgagtccaacttcctggaatttgtctccctgttagaatccattaatacttccaagatgacggcatccagtcaactgaatggctcagctgagcagaatgaagaaagtgggcttctccgagataactgttcccaggaaaaaaaggaggaaatcctggaaaatgaaaagcccagtggacacagttctaagcaaggaaaaccagatttgcaaagtcaagaccatactagcaccggccccgcatgcactcagcctgccaagaccacagccttgtaaggataagttacttaatttagtttcacttggtcataaagcatgagacagcctcatttactggcttctgcttttaatgctttatcaaggataaggaggaacttctaatcattttttttgaaacttttatatgtgttaagttttcagggcaatagacaaagacagataatctacagggtaacttcccaacaagatagttctgtcttgcaagtcatcagtgggcctgaaacatctgtacaagaagagatatctgtggatgctatgcatgtcttcattgatgaacatggggaaattagatcctgttatttaaaatctggaaatcagaaagaaggccctttacagcctctaccatcaaataatgactgtctctctcaggctcgagagatgcaggtcagctcctccagtaccacaacttctgagagtcaagatccgtcttctggggaccctgccgtcagtgcccttcagcaacagctgttactgatggtggctcgcaggacccagtcggaaaccccacggcatgtgagtcaggatctggaagcctcgtcatgttcttcaacacaaggaaaatttaaccgagagcagttttacaaatttatcattttccctggcaagtggattaaagtctggtatgatcgactgaccttgctggcattacttgatcgaactgaagacatcaaggagaatgtactggcgattttactcattgtcctggtttccctccttggatttctgaccttgagccaaggcttttgcaaagatatgtgggtgctcctcttctgcctcgtcatggccagctgccagtactccctgctaaagagtgttcagcctgaccccgcctcaccaatacacggacacaaccaaatcataacatatagcagaccaatctatttttgtgtgctgtgtggccttattttgcttcttgatacaggggccaaagccaggcaccctcccagttacgttgtgtatggcctgaagctcttctctccagtgtttctacaatcagctagggactacttaatagtatttttatattgcttccctgctatttccctccttgggctcttcccgcaaatcaacactttctgcacttatcttttggagcaaattgacatgctgttttttggtggttctgctgtgtctgggataacctcggctgtttacagtgtggcccggagcgtcttggctgccgccctgctccacgcagtctgcttcagtgcagtgaaggaaccgtggagcatgcaacacatcccggcactgttttcggccttctgtggcctcttggtcgccctttcttaccatctgagccgtcagagcagtgacccatctgtactcatgtccttcatccaatgcaggctgtttcctaaatttttacatcaaaatctggcagagtcagctgctgaccctctccccaagaagatgaaagattcagtgacggatgtcttaaaatgggatctcatcgtctgcgcagtggttgctgtcctctcatttgcagtcagcgccagcactgtattcctgtcattgcgaccatttctcagcatcgtgctgtttgccttggctggagccgtggggtttgtaacacattacgtgctccctcagctccgcaagcatcatccctggatgtggatttcacaccccattctcaaaaacaaagagtatcatcaacgggaagtgagagatgttgcccatttaatgtggttcgaaagactctatgtttggcttcagtgttttgaaaaatacatcttgtacccagcgctaattttgaatgccctcactattgatgcatttttaataagcaatcaccggagacttggtacccactgggacatttttctgatgatcattgctggcatgaagctgttgcggacatcattctgcaacccggtttaccagtttattaacttgagcttcactgtcatctttttccactttgactacaaagatatttcagagagcttcttactggatttcttcatggtgtccattttatttagcaagctcggggacctgcttcacaagttacagttcgtcctgacatatgtggctccttggcagatggcttggggttcttcgtttcacgtgtttgctcagctctttgccattcctcgtatcctttctgcttctattttcaccctccagctgagattcacattttacggaagcaagcttttcattgacccctggcaataaaaagattttaaagtctataagattacattttaatggggacatgaagaggcactttggatccctttaggccacttagccttaaaagatatttctttattttgaactcttcctgcttcttaatgcatattcaggagttacttttattttttctggtccttccatttcccatgcccagatctgcattaaggtaccctgtcttttaaactgcttaaatgattgggttgccttgtgcaaaatagtgcaaataaatttgctgttattaagca

SEQ ID NO: 174478 - DNA, 557 bp, Homo sapiens
ctctatgaccacaggcaagtggtgttagctttttctaagtctcagccaccttatctataaaaatgtggacaaaaatagcacctacatgacaggttgattgtgagaactggatgggatgattcgtgacaaacatttaacacagtaactgacccacaataagcactcagtatatgtttcattactgctgaggcatgagacaacagggaaactatcttgcaggcattttccatttgtctttatgtatgttacatcatatgcattacatacacgcactaagttacatccattctgttcatcacttgggtttatgatgttctaatggtagataagtgcaaattacaataaggctaggtgactaataaaaatcaagaaataggctgggcgtggtggctcatgtctgtaattctagcattttgggaggccaaggcaggcggattacttaaggtcaggagctcgagaccagcctggccaacatggtgaaacccaatctctactaaaaattacaaaaattagccaggtgtggtggcacatgcctgtagtcccagctacttgggagg

SEQ ID NO: 174479 - DNA, 788 bp, Homo sapiens
aggagggagcagtcggtcgctgcgccccggcgggccactttcccgggaccccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggt

SEQ ID NO: 174480 - DNA, 820 bp, Homo sapiens
tttaatcatatgtagtatatatttatatatacaaatggtgcagggtctaaaatgagacataaaataaagcatgagatgtttcaagtagggtaacaagaggttaaaaaatgttaggggccactcagaggaaaatactctattaattgggttcaggaaaatttgattatgaatgccaagtggtttagtgaggccagaagactcctattccttttaccagttacccccaggctggagaaaatgtaattgtattctttcctcctgctattttcagtaattcagtcaacttttttcttggtaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggt

SEQ ID NO: 174481 - DNA, 874 bp, Homo sapiens
tccattccaaatgcagacatttacactcgtgagtattaaagcaatagatcttccttatgacaacaaaaagctgactgcagaaaagcaaagcttctgggaaaagtcttcgagcgcgtcttggcttgttcatagggggagaagacctgactaattagctccagcccttctaatccgaaggagcagaaataattaaagtatctggggcaagctgtgccgcacagcagcaggctacagaaggggcgacgcgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggt

SEQ ID NO: 174482 - DNA, 836 bp, Homo sapiens
acagcctgaagcagcaggaacctggacttatgggggatcccggggcccgagtctactcctctcactccatgggggcccgggtggacctggagcctgtctcaccaaggagctgcctcaccaaagtggagctggccaagagccggctggcaggggccctgtgcccccaggtaccccgtacccctgccaaagtgccaacctcagccccaagcctgggcaagcccaataagagccctcacagcagccccaccaagctcccttccaagtcaccaaccaaggtggtgcctcgacctggggctccgctagtcaccaaggagtcccccaagcctgacaaagggaagggccctccctgggcagactgtggtagtaccacggcccagtccacacccctagtacctggccccactgacccaagtcagggccctgaggggctggccccacactcagccatcgaggagaaggtgatgaagggcattgaggagaacgtgctgcggctccagggccaggagcgagcccctggcgccgaggtcaagcaccgcaacaccagcagcatcgccagctggttcggccttaagaagagcaagctgccagcgctgaaccgccgcacagaggccaccaagaacaaggagggggctggcgggggctccccgctccggagggaagtcaagatggaagcccggaagctggaggccgagagcctcaacatctccaagctgatggccaaggcggaagacctgcgtcgggcactggaagaggagaaggcctacctaagcagccgggcccgccaacgcctggtggcccagccccagggcccaacacggggctggggcaggtgcagg

SEQ ID NO: 174483 - DNA, 106 bp, Homo sapiens
cgctgaaattgcaggcgtgagccatcgcgcctggctgaggtttatttttcaaagaatgaccaagaggctaggtgtggtggctcacagttgcaaatcccagcacttt

SEQ ID NO: 174484 - DNA, 213 bp, Homo sapiens
tcagaaagtcatttgtagttaattttttaccaaacagaaatacttaaaatcttttagtactaacaagtgatctatagaaaaaaaataaaaatctttcaggaaaaattaattcaaaataaatttaaccactatttagtgaacaattaagttaagtacatggataagactaagaactatacaatttgtttcagtcctctcagatgctaaatctat

SEQ ID NO: 174485 - DNA, 218 bp, Homo sapiens
attaagcttccagtactgagtttttaaaccaattacgttcacagtctttgcaaaagcagaagttgaagcatctagtatgtataataataccatacaattcccatctcatggatggataaatcaatacatcaaaatatatattttgtacttatgatatgcttatctttgcattagatgctatggagaataccagaggtgtaacataagccaagccctga

SEQ ID NO: 174486 - DNA, 494 bp, Homo sapiens
attacaggtgcccaccaccacgcccagctaatttttgtatatttaggtgagacggggtttcaccatgttgaccagtctggtcttgaacttctgacctcagctgatccacccacctcggcctcccaaagtgctgggattacaggcatgagctgccacgcctggccagcaatttttttcttgatttactttttgaaaataaaaaccataagaaaataatattaaaattattttcaaatgctatttcaaaaaatataggccatcagttctttgtaatactcatcattttacatattattgaagtgctaggttttaaatatatatggcattgtaaatttatgagtttattgacttaagtcatattattgaaatttgttgggagtacattagcaaacatttgattattaagccttgcaggagtttaaaatttggagtagaaattgtgctcttacatacaggaattttcaactaatttttataagtgttgtgcatataca

SEQ ID NO: 174487 - DNA, 170 bp, Homo sapiens
taactaagcaattatgcttcttaattggcctgggcaaaaaactttgaataatttttaagactaacataaaaaaaaaacacatgtattttacacttatcagaagaattgatattcaattttcttcttagctttagaaatggattaatactttcaaactatcacttttttgc

SEQ ID NO: 174488 - DNA, 321 bp, Homo sapiens
acaaaaaattagccgggcatggtggcaggtgcctgtaatctcagctactctggaggctgaggcaggagaatcgcgtgaacccgggaggcggagcctgcagtgagccgagatcgcaccactgcactccagcctgggtgagagagcgagactcctttctgaagaaaaaaaaaaaaaaaaaaaaagatatcttgttttaattgatattccatggattattagtgaggtcaagtaacttttcatatatttaatggtcttttgtttcttgtaaattttcttaaaaatttgttaaaaaattaactccatacaaccttagtcactctc

SEQ ID NO: 174489 - DNA, 243 bp, Homo sapiens
gggaggcggaggttgcagtgagccgagatcccactgcggcactccagcctgggcgacagaggagactccgtctcaaaaataaataaataaataaataaataaataaataaataaataaataaaatggtgcttcaaggagtactatagatgagagagctaagattgtagaacactctagagatagttgtgggaagagagctcagttactcttcgtatatttatgtgtatgtcactttctttttt

SEQ ID NO: 174490 - DNA, 329 bp, Homo sapiens
catgagctgggcacagtggaagaacagaaagaagacctggagctggatcatggtgagcaagaaagagtgcgaaacgaatctgatcaggcagccaccagatcacgtgaggtcttctaaaccagaggtagcaactcggactttcttctaagtctaactttctcaggtgttgtcgattccatcctgggacaccaagggcacatctcatatctacccaaggaagaaatgtagatcttgcctcttggtctgggggctcccaagatggggtgagatgtgggcagatgctgaactatggcaatagtgatggcaatggaggaggggagagaaaaaag

SEQ ID NO: 174491 - DNA, 527 bp, Homo sapiens
ctttttgctagaaccgttaggtgatattagtttctgaatcagagggtttcacacctgtgtgccactcaaaaccaggtgtgtggaataacccggacaagactaaggtttatgaatgtcattagtgagatgccgaaatagtgtccccggttcacgatcaattatgataacattgtgaaaattgtctttcaggaggctggcagtcagaacaagcttcttcaagagaaattccatattgaaaattgccagcattcatatgactagttgaattgggtttttaggtgaggaggcagtgcaggatagtacaaaggacctaggctttcaagggaaacaaacctgaattgaaccttaactctaccgcatggtgattgtgtggcttgtctgtaaaatgggaataatgatactgctctgtcagcatggttttaagaattagaggcaggtatatacaaggtatatagtcgatgctcagtgagtggtagtctttattaattttcccccatccatttgaagaaggacaataatagtacatg

SEQ ID NO: 174492 - DNA, 266 bp, Homo sapiens
tattactggccattactatgaaagaattagaagcaatcatcttggaggacagcaaaaaacagagaggaaaataggaattcatcaagcctaggacccagactctttcaaagttatctgactgagccaccactttgtattacctattataatccctcttaatcaatcaagctgattttttcccctttcacctgggcctgtctcctcagagtcagagatgaaagggacaaggccaaattgctccaagtgactttagaaccaattactta

SEQ ID NO: 174493 - DNA, 128 bp, Homo sapiens
cccacgtgtgatttgtagccgaaaggggagggtgtctgtgccactgcggcaggcctgctggtggttgtagtctttgctgccgtgaggcagtggcgggtgaggtgctgggtgggtcattttctcctcat

SEQ ID NO: 174494 - DNA, 511 bp, Homo sapiens
gtgtagtcccagctacttagtaggctgaggtgggagaatcacttgagccaggaggttgaggctgcagtgagccatgatcagcgccactgcactccagcctggtgacagagtgaaaccctgactccaaaagaaacaaaacctagagtttgatcacataagtattgctaataataatttcaataacaataatagtagcagcagcaagtggcaagtgcttacacttaggtagcctactaagcttatcgcgttgttggggtcggtgtgccggtgggtgttggggttggggtcaccgtggtggtggtggtgatgggtgccatggttggggtctgtgtgccggtgggtgtcggggttggggtcactgtagtggtggtagacgatggggtcttgccaatgttgtccaggctggtctcaaactcctgaccttgtgatctgcctgccttggcctcccaaaatgctgggattacagatgggagcccacattgcccagccaaaatgtgtgtctcatagaaag

SEQ ID NO: 174495 - DNA, 548 bp, Homo sapiens
ggtggcagagtcagagtcagaaagaagtgatactagaagaagagatgagagagagagaaaaagatttgaagatgctgcactgctggccttgaagacggaggaaggggtcatgagccaaggatagcaggcagcttgtagaagctggaaaaggaaaagaaatgtattatcccctaaagattccaaggtgttgcgtctctatgaacactttgattttaggatttttgatccccagaactgtaagataataaatttttgttgttttaagccactaagagggtgttatgtgcttgtcatcgttttttttttaatttttaactttttgtgttgaaatactttcacacttacagaaaacttatgaaaagagaaaatcacccagatttccattttttcagctacattgaagtatgatcaactgagtcacaagggctagacatttaagatgtagaactcgtatatctgaaattgcatacatctaagatgtagaactcaatgttttgatattagtatatgttatgaaaccatcaccacaatcaagctaattaacatat

SEQ ID NO: 174496 - DNA, 1010 bp, Homo sapiens
gggtaactttcatgtatgtgcttattaggtttttttcgttagaattttcagtgtttctgaaggtggggaggaacatggaatacaggtgaaattaaaccttaaacctggcataacatggatagggttagtgtcttacatggtatccggcgtctgctcaaatgagacaaactggacagctgggtggatgatggtatccatggatttacttcattagcgcatgtctacttttttatttatttattttttttgagacagagtctcactctgtttgcccaggctggagtgcagtggcgcgatctcggctcactgcaaactccacctcccgggttcatactattcttctgcctcagcctcccgagtagctgggattgcaggcgcccgccaccacgcctggctaattttttgtatttttagtagagacggggtttcactgtgttagccaggagggtctcgatctcctgacctcatgatccaccctcctcggcctcccaaagtgctgggattacaggtgtaagccacggcgcccagcctagcatgtctactttttaatgtgattgggccattgtatgtaaggtaatgctctgcttagaaatatagaatgttttcctaggcctaggccccaagtccatggtgtgtgaagtgaaataactttgatgttaaggagttcttttttggtcttttgcggaacacgggagatgatcagacttcctgaatagagaaagcttatgtgcttggttacatgggggaacaactgaagagattcttgactcaaccttttagagcttagtccatgtggcaacgagaaatgggctttgggtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagtta

SEQ ID NO: 174497 - DNA, 550 bp, Homo sapiens
  misc_feature (40)..(40): n is a, c, g, or t
  misc_feature (97)..(97): n is a, c, g, or t
  misc_feature (136)..(136): n is a, c, g, or t
  misc_feature (193)..(193): n is a, c, g, or t
aaaagccatttctccagagccttcgtctctcctggtgcanagggcaactcttaaggaacaactcatcgcaccagtggcggaagaagaggcaacagtnccaaacaataagatcactgtagtgggtgtcggacaagtnggtatggcgtgtgctatcagcattctgggaaagtctctggctgatgaacttgctctngtggatgttttggaaggcagtttttaagacaaaacacgggagatgatcagacttcctgaatagagaaagcttatgtgcttggttacatgggggaacaactgaagagattcttgactcaaccttttagagcttagtccatgtggcaacgagaaatgggctttgggtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagtta

SEQ ID NO: 174498 - DNA, 546 bp, Homo sapiens
  misc_feature (93)..(93): n is a, c, g, or t
  misc_feature (132)..(132): n is a, c, g, or t
  misc_feature (189)..(189): n is a, c, g, or t
gagttttccagagtcttggtctctctggtgccgccgggtatcatctgaaggccacaactcatcgcaccagtggcggaagaagaggcaacagtnccaaacaataagatcactgtagtgggtgtcggacaagtnggtatggcgtgtgctatcagcattctgggaaagtctctggctgatgaacttgctctngtggatgttttggaaggcagtttttaagacaaaacacgggagatgatcagacttcctgaatagagaaagcttatgtgcttggttacatgggggaacaactgaagagattcttgactcaaccttttagagcttagtccatgtggcaacgagaaatgggctttgggtttttccacttaaaaactttatttataaaaaggaaaagtagttttcatattaagtttttatttcctttccagcagttggggctagaaagtatatgttggcactagaaacattgttaagatttgttctgtggtgtaggtatgcacattccataggtatgcacacggccatgtaatacctgtatatcccaagtta

SEQ ID NO: 174499 - DNA, 916 bp, Homo sapiens
  misc_feature (717)..(717): n is a, c, g, or t
  misc_feature (725)..(726): n is a, c, g, or t
  misc_feature (729)..(729): n is a, c, g, or t
atgctgagaggagcagaagtatgtcttgttgagaagattcaaaggaggggctacaaagaagaaggtcatcaatatattgaataaggtgagaagcagaggggtggaaagaaagtaaatcaggagaaacagcttggctgaagtaatgagggctgtccatgaaaccttgcagcagcacagcccagggagcttccgagacgattgggcagtgtcagtcttcagccgctaagctgagaagatctgggaaggagtcagagagagttgggccggagttccaggggctctgaaagtggctgccagatgcagaactcatagacatcgagggccatctgtatttgttatcagtgataaaagttgagctttcaaccaaacattagaattttggaaaacatgcacctaccaccaaaatcttgacagattcccagtacttaacctttgttgatgaaattgatgaggagttagaagttacttctttgtgctgatgtggtgatgcatgggatgttacagagccagccacagaaataattgacagctggacccagctcctgtttataaggtttaagtctactacccatctgatatggttaggctttgtgttgctgtccaaatcttatcttgaattgtaattctcataatcctcgtaatctccacgtatcaagggagtgaccacgtggagctgaacagagaagttctgattaactattggcactggatcctggnagggggannaancatgtgcgtcctggacaattttgggacccctcttcatcttaatgtggagttgccccccccctttaaggattttttatccccgaaacactttgtgtttggaggggacactcaggggccaaaaaaaggtgtggggacacacgaaataccgggcgcaaaaatactacggaagaggcctttgcccctcgga

SEQ ID NO: 174500 - DNA, 956 bp, Homo sapiens
atgctgagaggagcagaagtatgtcttgttgagaagattcaaaggaggggctacaaagaagaaggtcatcaatatattgaataaggtgagaagcagaggggtggaaagaaagtaaatcaggagaaacagcttggctgaagtaatgagggctgtccatgaaaccttgcagcagcacagcccagggagcttccgagacgattgggcagtgtcagtcttcagccgctaagctgagaagatctgggaaggagtcagagagagttgggccggagttccaggggctctgaaagtggctgccaggcacaagcttccaagtgaactgtgacttctgctgaggatcttcaccttcagttcactaaacaactatggcttttgacctagaactagaagcagactacatctgttgtggactgctttaactcaagactctggaccaggcctgtatacaaatgaacacttgtgtttattgtattatagccatcataatgattttcctggggatacaggcaattgctactatctgaagcaggacaggacacatgtcagatgcagaactcatagacatcgagggccatctgtatttgttatcagtgataaaagttgagctttcaaccaaacattagaattttggaaaacatgcacctaccaccaaaatcttgacagattcccagtacttaacctttgttgatgaaattgatggtttttggttgaccccagagctgcatgcaagattccaaaaacctgaggaagaaaaccacaactgcaaagcttgaagacctgagcagagattttaatggtttcccaatgaagtttggagtttgaatcttgataatataaaggaatttgttaaatgctttgaactttccatagatattctaggagagcaccccttatatactaagatattttccttaggactaagcacaaaacccaaatggactataattactaaatgtaaa

SEQ ID NO: 174501 - DNA, 1221 bp, Homo sapiens
ggcacgagggagggaggaggtgagagtgattagtgggagaagaaaagcaggcccaggaccaagccctggggactggggacatcctcggtgaccctgtggagcattgagccatgccagctctgtgcctggtgctgtgctggtttcaagggctgttgggagaggtatggaacgccgtggactccgggcactgcctgcagacctactccctgcacacagaggcagtgcgggccgcccggtgggctccctgtggccggcgcatcctcagtggtggctttgacttcgcgctgcacctaacagaccttgaaacaggaacccagctatttagtggtcgaagtgactttagaatcactaccttgaaattccatccaaaagaccacaacatctttttatgtggaggcttcagctctgaaatgaaagcttgggatataaggactggcaaggtgatgagaagctacaaggcgaccatccagcagaccttggacatcctgttcctccgggaaggctccgagttcctgagcagcacagacgcttccacccgggactcagctgaccgcaccattattgcctgggatttccggacctctgccaaaatctccaaccagattttccacgagaggttcacctgccccagcctcgccttgcacccgagagagcccgtgttcctggcacagaccaatggcaactacctggcccttttctccactgtgtggccctaccggatgagcagacggcggcgctatgaagggcacaaggtggagggctactcagtgggctgcgagtgctccccaggcggtgacttgctggtgacgggcagcgccgatggccgggtcctgatgtacagcttccgcacagccagccgagcatgcacactgcaggggcacacacaggcctgtgtcggcaccacctaccaccccgtgctgccctccgtcctcgccacctgctcctggggaggggacatgaagatctggcactgagctttttgtcactgaaccttcccgatgccagctgggctcttggactcccctcttcctcaagggtagatgagaggaacgagcacagaggttggctgtgggtcctgggtaccaccttctgagcctcagtttcctcatctgtaaagtggggagaaaagtctgtttgcctcaggagtgtgaggactacactagtgaaagcgcctggcgggcagccggcgatgcccaataaatgtgtgttttgctgtttgtt

SEQ ID NO: 174502 - DNA, 350 bp, Homo sapiens
aagttaatggtagtcaccctagggatgttataaatctcactttaagactagtattagagataccacatgtgaccatttaaaaatgtttcacaaagaaaatcacaggatatttgccagtcactgcttttcctaaaaccgttctgttcataggaaaggaagtataattgggaagtgaaggaaatgctaaaaatatcccatattgaacatttttgaatttaaacagtttgtaagccattctctctctcaaatttggaaccaagtcaagaaatttcagaaaacatgaccctagcatcaattacatataaccttcagaaggcccccccatcataatggtaccttgaacaatgatg

SEQ ID NO: 174503 - DNA, 470 bp, Homo sapiens
agtcagtaaaagtcattccaactctttcatgtagataatgtagtgtggtttccaaaattcatttttgtaattatctcagtgatgtccacagtaaccctgtcaggcaaacagggtagagactgtttttcatatttgtttgtttatatctccattctataggtgggaaaactgtgttgcttacccagtacaaaatcagagtgtcaaaagaaccaaagttgtatgactcctggtttgaaacccatttcaatatactgcttgcttcctgctagaccagaaaataaaaatactgggaaactattgtttaggatgctctaaggcaaatatatttgcatttaaataatcaagtaagcaacacaatacctagaatgtaatgggtactgattaaatagataattattgagtgactatttttatgaaatatattggatatttgttgaatgaatgaattagtttttaaagatttaatccat

SEQ ID NO: 174504 - DNA, 723 bp, Homo sapiens
gatgttgctgtcaaaatttcatcttcacagtcacaatccaccactgtgactttatggtactcccctgcatcatgggactggaagcaagatggatgtcacaatgctacctagatggctcaaacatccttcaagagggatatttttaggaaaacaaaagtggtctcattgtgtcattttgagatcccagtagctattttttagcagtcaagatattacctcaggtcttccttacttgaggtgccaggcagtgtttatccataacccagtggtgaacagttagcaccactagcagccacaattttttcagcccttttcacatgagagcctatcatgaagttcaataaagacattctaacaaaagagtcaaattcactgacagctcaggctactctgacagtgaatctcatcagaacgaggctccaagtgaattcactgagaaacagacttgtagcgttggacctcagcatctcgttataggatacgaattgtcccatgcatgcaaacagttctgaagtgggcaagcatggtgtgggttgtcatttgcaccaagctcagctagcatacagttgttttatcggccacattctgctatgtggaacccttaagccagcaaggcctacaacttcaacaggattcatatgcctggaattgtgacatcggtgaaaaaaagacccttcctggaattccccaactctttttgttttagaggttaaaatcttggaa

SEQ ID NO: 174505 - DNA, 360 bp, Homo sapiens
ccatggaatgctttttgcagagttatgactcctcatgaccctccaagttgttagagcagattagagctcccgatgactctgctgatgagcagatggtattctctctctgaaacagctggagaaccctggtggtgatggtggggttattgattcagggcctcaataactgctagagtcatcgttgatcccttgatttctctccctccctatgaggaatctgtttgtaaatcgtgtctatcttggaaatatatccagaatccaaacacttctcacttcctcctttactcccaccatagaccaagctgtcataatctctgctgaaacagcctgcaataaggccccccagcttccatccttatc

SEQ ID NO: 174506 - DNA, 376 bp, Homo sapiens
aggagggtgtgttatggtttgaatatggtttgtccccagcaaaactcatgctaaggcttggtccccaatgtggtagtattgggaggtggtacctttaagaggtgatttggctattaagatggatgaatgtcttctccagggaatggactagttcttgagagcaggttgttataaagcaaggtttcctcttgcattttcccttttccacgcctaattccctgtctccaccactatgttatgatgcagatgcagccctcaccagaagccgaccagatgcagctacccaatctggaacttcctagcctccagaacagtaagctaaataaacttctttgctatataaattacccaatctcaagcattctgtgacagcaac

SEQ ID NO: 174507 - DNA, 523 bp, Homo sapiens
cagcaggcgccgcggcaggtttccagagcagctttggactggggcgagaggaggtttcgatgctggggccgaggaggggcgcccacgcaggacaggggagggacaggctccggggagaacagctgagaggaccttggccttggtggaacctggtacgcccagcaggcttgattggagaaggcgccttttccttcagtgacgcctgccgcctgccctatttatgccagggtctcccctccccttcaggccccttgtgtgtttgctttctgtctcataagggctcttctgagccctcccgcctcctcccttctccgcagcctcctcctcgccctggtgtctttcagctccccgccgggctgcctgctctccaggctcaggctgtcctccctgggctttccactgggggcttgggatgctggccgggggggagtctctgaggctggctgcctcctacagttgatttccttgagaagggcccctggggcatcagggaggtccagactcaacctgggctctgcggccg

SEQ ID NO: 174508 - DNA, 326 bp, Homo sapiens
ttcttgggctcatgggggcagacgcaggcaggagctcagggaaattccgagaggactttggggtgtccaggagcactttgaggccacgggcccaggcaacttcctcaccagtacggaacaggggatgcacagggccgaactttccatctgctggcccctgctggtgtccaggagagagctgtgaccctcctttttccttaagtcctggagctgagagtgagaagccatggggtgcacgtactcgtctccacctgaggagcccgctctgagaaggtcagttcctgacactgtccctggcggcagactgccctcatgccccttggcca

SEQ ID NO: 174509 - DNA, 203 bp, Homo sapiens
ccatgcttgccttatctactataccggatacctctctctcacctttggtacattttgggcctgtccacataaacctttcccaatacccgcatcttcagtgtttacctaccctatcctctatcctacctgctgcaggtgggttttgagtctaggccctggcctctcttaggctgccccatccagatgcaagtaaccaagcctgg

SEQ ID NO: 174510 - DNA, 425 bp, Homo sapiens
gttaacatgtcatttatcttaaacctttccaatttctttgtggtgataacgttcaagacccacttttctagctatcttgaaatataatacattgttattatctgtagtcgccccactatgtaatagaacatcagcacttactcttcttagttcatctaactaactttgtagcccttcagaccatcctctccccatctttgccttccctccctttcccttcccagcctctggtaaccaccattctactgtctacttctatgagatcacctctcttagcttccacatgtaagtgagatcatgtggtatttgtcttcctgtgagaaaaaggttgtttcgaatagtaatactcagtcctttctcacaggcaaatcttgactcatttcttattttcctgtcatttcagttcttttacactcccaaaaata

SEQ ID NO: 174511 - DNA, 235 bp, Homo sapiens
ctgatgtgacatgtgcatgtgtggggtgtgtgtgtgactgtgtacgtggtgtgtgtgagtggggtgtgtgatcgacgctgatgtgacatgtgcatgtgtggggtgtgcgtgtgtgtgactgtgtacgtggtgtgtgtgagtggggtgtgtgatcgacgctgatgtgacgtgtgcatgtgtggggtgtgtgtgtgtgtgtgactgtgtacgtggtgtgtgtgatcgatgctgatgt

SEQ ID NO: 174512 - DNA, 774 bp, Homo sapiens
agggccgcgtctgtggaggagcttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattgacttctctcaggaagagtgggaatgcctggactctgctcagagagatttgtatagagatgtgatgttggagaactatagcaacttggtatcactagacttgccttcaaggtgtgcaagtaaggacttatctccagaaaagaacacttatgaaacagaattatcccaatgggaaatgagtgacagacttgaaaactgtgatcttgaagagtccaattccagggattatttggaagccaaaggcaagatggagaagcaacaagaaaatcagaaggaatatttcaggcaagggatgatcatatatgacaaaatgtccattttcaaccagcatacttacttatctcaacattcaagatgtcattctactgagaaaccctattaatgtaaggaatgtgggaaagccttcagacgagcctcacacctaacacaacatcaaagttttctactggtgaaaaaccctatgaatgtaagcaatgcgggaaggcctttagtcgtgattc

SEQ ID NO: 174513 - DNA, 539 bp, Homo sapiens
agaagaaaactgaggccctaattaattttcagtaaaaagttaagtttttcatacaacttgacaagaggactctgaaattcacagagtagtaacaaggccaggcattcacaatgcaatttgaagaaaacaggtggggaagcttatcttgctagatattaacacttacttatatagttgtagcaattatgacagtatggtattgttatagaggttatacaaatacagcaatggaagagaataagcaacccaggatgtgtggaaacctgatttgagataagtgacattacaaaccacaaaaacaagtttaactcttcaataaatggtgctagaacatagttgtttgtatgtaaaataataacaaatgagagtagatccctttctcatgcacaaaaagtaagtactgggttgagtaaagccctaatatgaagaatataagtttaaaacttttagcaaaaacacaggtgaatacctttgtgatttaggggtagaaaaagatttcttaaacaagactcccagaacacaaattgtaaagaaaaaga

SEQ ID NO: 174514 - DNA, 329 bp, Homo sapiens
caaacaacagcagtttaaactacttatttctctactcacccatgtagttaaaatatgtcctatttcccatcttgagataaatatgacctaatacttgatatggatattcctttatatagacataaattcttttcttaaatataagcataatccctttaaataaataaataaataaataaataaaaaggagacacggatgcagaggagaaggccgtgtggagacggaggcagagagtggagtgatatggccacaagcccagggaccccagagtccccaggagctgggagaagcgggaaggatcctcattagtccatgaaaatggactaaa

SEQ ID NO: 174515 - DNA, 475 bp, Homo sapiens
cacaaacacacactcacacacccttcccataagattgttgtgaagattaaataagataatgtatgtgatgtccccaacagctctttaaagcaggagtcagtcaacagaccccatcaaggacaagatagtagctacttaaggctttgccagtcatgtgacctccatagcagttactcaactgcacagtttgaacacagtagccatagacagtgcataaatgagtgggtgtggttgtgctccaataaaagtttatttatggacatagaaatttaggtctcatataatgctcatgtatcactgagctcctggtgttctcctgcatgacagcttagctttgtctgaccctctcagccctgctccagcttccgcagctcctccaccgcctgaaccgcctccattgatgcatctgttcttgttctccttgtagtaaattttttgggaagggtggtccccctgtgggggggcgtttttgaag

SEQ ID NO: 174516 - DNA, 266 bp, Homo sapiens
ctttatcctcctttgcctttccttcttttctcttattcctcctcctttgttcctctcctctctccctgtctctgatttaaataatacaagacttaaaagactactataaaatttatattcaacagatttagaaactaatagtaaggaaatgatttcttcacagagcattcatctcctgtctggaattcaatagttctgaaggttctgtgtcaaatgtctgagcttgatttttggaccagactggtcatattaatagtattcatagt

SEQ ID NO: 174517 - DNA, 492 bp, Homo sapiens
agcggaggagaggatttgagccttatgtattattatacttactgtaattcccaagaaagaatggggggtctctaattggtcctacagagttctcaaccctgtttgctcattaaaatcacctggggagtttctataaaactacaggaacttaggcctcactccaattaattgctctcttcatttaaaaggcaaacaatccaaaaagctctccaaggttaaaaaaatctgtagcttaaactaatcaaacctcaagaattccaggttgaccaggtacagtttttctaattggaatgtgggcagaggcccactcacggcaaattcagggtgaagtagcacagataatatgcaaatgtgcctgtatgggtatgactgtattctaatgcaactttatgtacaaaaatatgcagggcagatttagtagcgctgggatctactcgaagcaaggttccaagcacaacactagtatgaccggaggctcaactcagaagcgct

SEQ ID NO: 174518 - DNA, 294 bp, Homo sapiens
ctggcatagtgccttgcacactggagtggcacagtaaatagttttggaatgaacaaaaagaaagaaacctccttgaataggagatagtggattcgacttgaacatatagactggttctctgacaaccacaggatttaaggaacatttgtacagcattgtatagttggcaagcacttccatacatttatcgtctgtcagccaagtgtcaataagtttagttcactattgagtaaattgtccttaggaaggttacgggattcatcccagattttttaattccctactgtatggaat

SEQ ID NO: 174519 - DNA, 293 bp, Homo sapiens
tgggattacaggcacccgccaccacgcccagctaatttttgtatttttagtagagacggggtttcactgtgttgactaagttggtctcgaactcctgacctcaagtaatccacccgtctcggcctcccaaagtgccggagttacaggcgtgagtcaccgcgcccagcctgatatgcaaatattttaaacttctatgacgttccactttatctatttgttcttctgttgcctgtgcttttggcgccatatccaagaaatcattgccaaatgcaacgtcaggaagcttttcccct

SEQ ID NO: 174520 - DNA, 587 bp, Homo sapiens
catgtacagattggtattaagtgaatgctcaaagggaccttatgcaggtatttgagtttctttatttgagtatcttcctcctctctgctaccctgtctcacctctgcctccccatagcccactcttctcaattcagctagatcaccatgttgtgcttggattccccctccctgcctgacagtatgaaaactgcctccagccagaaaacagagttgattgcacaacttacttcatttttttcctatctcttagggatgccagccctgcacagccttttgtcctgatgtccaaagccagttgttttgtctgctttgtccagctttctagttcttttggcaaaaaacaaaaacagaaacagacagcataagttccatcctagctactccttcatggctggctgcagaaattctgaaaactgttttctgtgtttttaaaatcactttacttccttgggactccttagaattgtaacttgagaaggtccaaacagataattaaaccacctgtgacagatacgtgctaagcgcctgccagtgccggatcctgggaggctgacagggatatacaagagcccctgggcttggctt

SEQ ID NO: 174521 - DNA, 173 bp, Homo sapiens
tttgtagacatctaaactgatcctactaaatcatgaagcatcataaccaaataggatataaaattgatctgctcagtcttcaaagtcaatataatggacagcaaccatatatggttaaaagagaagtaaaggagggagggagaaaaggagggaaggtgaaaggaaactgttcc

SEQ ID NO: 174522 - DNA, 754 bp, Homo sapiens
gactgcattgctatttcaactagacacgtttacttttcccgcaaatgattactgagcacctatggtgtgcccggtaccatgttagggcaagagatctacctcatccttgcattgtaaacctgtagcatccgtggcaatgttttacaccactgccctcccagggttcctgcaagctgactccttttattttccttgtgcatgctgatgtgttcaaggtatttcagtgggctactgtgagactatctccccatcaggatctctcaaccttggcactaggaacatgttgggaaaagtaggtctctgttaagggaggaagaggggctttcctgtgcgtgataggatgcttggcagcatccctgtccagtagcaccacatctacctcagttgtgacaaccaaaaatgtctgcagacattgtcaaatgtctcctccctattttacatttaccaaagtgctctttatgtcctttacagttaaggaaacttaggaccaggaagaaacttgctcaagtcaaacagtgagttggcggtagagctttagctacaatttaagtcttgtcttcccaacccagtgtccatcttatggatccattcagtggtttgctcctaaatgcttaataaccaattatctgggataaacgaaagccaaacaaacttgctgggagcgtgggacaatttccatggtgtaaatacttccaccatggctggtttcaagctacttccatggcgtcactgaatgtgaagttgggaagggatc

SEQ ID NO: 174523 - DNA, 768 bp, Homo sapiens
ggctgcagccccagctggagagcagggccctgaggctgggctcttcctgggcacaagcctctgcccagagcttcctggcggggccctcagctcctcttctccaaggcctggaaacgagctccatggggctgagaatcatctctgtgtgtgggagacacatggtcaatctgagtaagcggaaaaaatggtatcaatataaaagtaagatataaacacaactcctcaacaaaattaaaacccacagaaagggaacctcacatttcactcccacctgtctgttctcccctctccttgagaagtaaaaacaaccactgtcttgcagtgtgttgccgcagaacttttcttacaaagttacctaaatacggtggcttcgaaaaacgtgcttagatttatgttttttacttaaatggaaacgtactttgcacacggttgtacaacttttttttgcatatttaatattcagaaatatgtcttggcgttgagtttcgagatggcttgtggcgagccacgccgtttgccctagggctgcttggttaccatttgttgcagggctctgtggttaccaggagcctgtgtgaccactgacttcacatctgcccttcgctgaacgtgtatttctagaaaaaatccagtgtcaaacttgtcccacactccagtgccagaggtgctgagggttctcttgggcaggaccgttcagcaaagtccacagagcaaaatgggagcttggcttaaagggtggcagagcagggggggcgccccctcatgagc

SEQ ID NO: 174524 - DNA, 585 bp, Homo sapiens
ggccaggctagtgaggcacagagaaaacccacaaatgtagagtatgtgacacagcacaaagcagtcccatgccaaactgatgcaatggcattccaagtttagagttccaccgcttgagaccatccaggattcttttaccaattacttgtcctactgtctcctatctatttcatgattaccagaaatccttcccttttcctctttgtcacttacagggagtttgagcgatttagggcgctgatgaaggaaataaatgaccacaaggtggcgtagcacaataagggttatggggtgattctgtgacaggtttgcatgaagtccctcacagcccgagcctgtacagaggttatggccactggtcaactattcggaagggcagaacgacaagggaagtgctggggcatcaagacgggggcttatttgtctaggtgatgtcattcagcagcaaagagaaaattctctgggtcagagaactctgaagggcagcagcagcagctttgggtattttatggcctggggcctaacttatctattccccaaagatgaaagatgtagtaccaggttttctggggtatgtaaagcagg

SEQ ID NO: 174525 - DNA, 833 bp, Homo sapiens
aataagctatgattgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttatgtatgttccctttcctgtgcttacgtattttcagaaattttagttggtgtgcataccacaatttgtattttatacttaaatatacatttcatggttgtatatttatttgatcaagttcttttatatcaaataacagagcttggcattggttgcttgtcataactcggcagtaagcatttttaagcatgaagttattcttggttgaattttattcttgatatggggcttaggagtgagatttctggtctacagaaatgatcatgtcatgaattttgacatttatcgtcatgatgctttggaaagggtggaccaatttagatcatcttagggtgaatgagtggataattaactacaactactgatgtggtggtgattcagtgctattggaggtaaggctaattacttgttgggtaggtgattcgaggcgaatgcgataatgcgtgggacgcctggtgacaagggggatactttgtcatgttcctaaaaaaaaaattgggggcaagttaatggggcaaaaataggtagagaagtgaaaggcatttattcatcggtttatttgatgaatg

SEQ ID NO: 174526 - DNA, 301 bp, Homo sapiens
cagttttaatttctttgtaggacctcagtgtaaagtgtggtggcaaggaaggatggaaggtgaagagaataattagagtcaggactttatcatgtttgtaatgtggagggaaggagtcactagttacaggggtaaccagtgaagcaaggtctaggagagaaggggatttcctcttggatggaaagacctaatcttgagcaaaaggaacactttctgaaatagaagaaggcagcaaaggaaaattttagatatagatatgtttttaggtatgggcatgagaactgactttactatagtttgc

SEQ ID NO: 174527 - DNA, 333 bp, Homo sapiens
tggaggggtggtctttgaagggttgtgtgtaggggagacagggcattgatacttgagcctttcttgaaagcctaggttggaatcttggccctatcatttattcaattcattaaaatgatactgagcatctgtcaggcacagtcctggaaactgtgaatacaaaaattaatgacacagttcctgccctctaggagcttacagtttaatgggagactcacggaagtttgtgattctcttaatttgtcatcctgcttccttatttacacagtagccatggggaacttttttttttttttttttttgagacggagtctcgctctgttgcccaggctg

SEQ ID NO: 174528 - DNA, 314 bp, Homo sapiens
ccaacagcttcctattgcaaccagattaaagccaaggcccatgaacaagacttgactgtaccctcatctcatcccaagctccaactccccactaaccagccctcaagcctgcctcagagtcttagaatatgctgacagttacacttctgcccctctctgtttgcaagactaaactctatgtatgccttcataactcatcaaaacttaaatatgtgtccctggccctcacagtattctccactgtttgtttccttgacagtgctgagcaccaatgaatattatatatttatttgtttgatttcttatttattgcc

SEQ ID NO: 174529 - DNA, 635 bp, Homo sapiens
ggcaagagctatgacaggaggagctataccgggaaacagctataccggggcacagatatgaccaggaatcagcttatgactccgcgcattacatatatagcgagatacacagctccatcaggtagagcatataaggcctcctgccagtaagttcatgttcttgtcatgcagacctctgtgcaactgctgtgtctgtgttgcccttagggtcctgagggccttgcctagaataatcctcatataattcctccgacaggaaagctgtgctttcttccatggctgcattctaaataacaaaaagtagagaacacgaggctggaaattcagctgtacagcaaattcctggaagtaactcctccgtggacttaagaatgcggataggtgggcctcccacgcccaccaggcacccactgcattctcagcctattgttctatgactttaggaagcaatgatccctttctgaaatcttgagtatagaaggaaattactagttcttggtgttctagatctcacttttcagtgttttacctgcccacttatagaaattaaggaagaaaagactcagtactcactggtacattttagtgggtttctttgttgtgtttattgtaactgatttcatatttgtcatgat

SEQ ID NO: 174530 - DNA, 205 bp, Homo sapiens
tcatcttgccaactgactccaacataaatgaactcatcagcattctagttttttcagttttattatgattcaattcttgaagtatttggcacttctgttatgctgattaaatcatgtttctgaatctgcaaagatggggagcagattcaggaaaatcagactacctagacatctctaccctgctatagtaattattttgtttcag

SEQ ID NO: 174531 - DNA, 445 bp, Homo sapiens
ggggaagtgtgttctggcagtgagaaccaaaacacagagccagagctcgaaggggctgggtgtgctggagggagaacgaggagtacagttctgatggggcggttggcaagtgacaaacacgcctggctgcttgtttaaagcatgattcccaggcccctccctggagcttctgattccataagtctgaatacagactcgtgaatgtgtatttttaattaagcacccaacgtgagcattaatgaacaggtacatttggcaaacactgcataaggacccagtaactaaagaacaccctccaataaaactctgccagggggctccaccaacttagctgaagttggaaacagactcacagaggtagaaaagatcaaaacagtggtcttcaacccttcccacatattagaatcacctgggacacctttttaaactcccgtgctgggctgca

SEQ ID NO: 174532 - DNA, 698 bp, Homo sapiens
tgcacagttctgatgatctgccttactgtgagtataaatctgttctactcttgcgtcctagtgtccctggggagacaagaggccttccatgcgaaggccctggacataggtgaagtacccattacccagatgtctcaccaaatcccaggtatttgactgctctttaatgagccaccatatacattccaacaaagatcacaagatgcttcaacaagctccttaccagaagcagggaagccatcggctcttttaactgatcactcagctattgaggaagtggtaggaatttctaaattgttgtcaagacaaccaaagtccaaatataaatctctttgggattccatcaggaagcatttttaagtgcacgcacacaaataccccaaggagataacaaaacaaaggtcccctccttctctttctcctcctccccactctctcccttcctcctgcttcttgccacatggtgatgtgtgttaaaaatgcatactgggaaacttttccacctttggggttgaagcagctgctgcctcagtgttgtttttgttaagtattttttgttgttgttgttaacatactttgttgcctttaagcttcatgtttcataataccagttcagatcacaaagtgggacgaatgacactttcctggtaagaaggaaactcatggggtcctgcccaagggtgcttccccctatcaag

SEQ ID NO: 174533 - DNA, 665 bp, Homo sapiens
atttcatgcgaacctcaatcctctacttttgccccatctcaaaaagataagaaataaataagcacaatagaagagacaaatattcctgacagaaaaatttcaaatgccctctgtaggtactcctttctccaggggctacagcttaattcctgctcctgggctggagtgtgggctctgcttggtgagctgctttccaaagagtagggcgtggaaggaagagaggggtgtaactttccagtggagagtctgcctaatactgccttggccaagactcaaggttaacatccccaaagataagtcatgtgatgggggaaacatgtctcctctgtgctactctctcctaaaacccacaaccccagtctaaacagcgaaaaacattaggcaaatcccaactgaaggatattctacaaaatactcaaccagtaccccttgaaactgtcaaagtcatcaaaaacaaggaaagtctgagaaactatcatggagtggaaagttctacagagacgtgacaggctgggtgtggtggctcacgcctgtaatcccagcattttgggaggccaaggtggtgggattagttgagctcaggagttcgagaccagcatgggcatcatagtgagactccatctttacaaaaaatgaaaattaaaaaagagagacatgacaagtaa

SEQ ID NO: 174534 - DNA, 195 bp, Homo sapiens
ggggactggccagtttgggcaggggggtgcagggcactaaccactattcctatctgtctgtccctcttcctcgagaatcctgttgctctgggcaagagtgatttttaccgggggcatcagcatgactgttcaagatgatatgggcacccaggatgttgggcagggtggtatatgtattcttgtgcccaggagggc

SEQ ID NO: 174535 - DNA, 192 bp, Homo sapiens
tgcacacgccgagggcccatacccccttggtgaccaaatcacgatgtgacgaagttgttgctgcacactgccgaatgcccacactaggtacttaggaatccagtcattcaggactgcacaagaacggccaagcaagatccagaagttcaccactcgtgtccttacacgaaaaaaatttactccaggagggat

SEQ ID NO: 174536 - DNA, 518 bp, Homo sapiens
tcacagtaaagtttaagttataagtttctcccaccacaaggggtatttgcatttaagagtttattaacccataagaacagtgagcagattttgagcagagaaatcctttgtactttgggctacaagaactgggaactctaagaaatattaataacttagaggcagttgttaaggaataaaggaatccagttaaccagagtgatgaataagcagttcttatagaaagaagacagacaactatataatttctctattcaagtggcaagaatttccattttgactggaagaggcaaaacaaggcatgatggctttcccaacatgaaagtaattcatacatacttgtgggtggttgggagtgggcagatgggatgtaattaatggcagtaaactagtgaaaaaatggggtagatctatattactaagaaggatatttaaaaagaacaagtaacaatgttaaatatgggcccatttacatttaaaagacaaacacaaataaaatgatacagaaagatactcac

SEQ ID NO: 174537 - DNA, 335 bp, Homo sapiens
tgagggcccaggcctgattacctggacttctgaattccttaatcacatcatagactgtatcctcctcctctccctgaccgttgctgctagtaggtagccctcaagagggaatcatttgcttgaagcctcaaaacttattaagcctccacaaacactgaagactgcagtgctacacctggctgagggggttgtgtgtgtgtgtgtatataataagttttgcgtttttttgtcaaggatggagtgtcactctgtcgcccaggttaaagtgcaggggtgcaatctcggctcactgccagttccacctcctgggttaacaccattttcatgcctcagcc

SEQ ID NO: 174538 - DNA, 265 bp, Homo sapiens
cctgactttacggccacgcccggccgagagcgcgtgccagcaaggctcgctctctctctctctctctctctctctcttcccctctcctctctctctctctctctccctctcctctctctctctctctctctctctgtcacacacacacacacacacagccaccggaggcgtcctgagcagcagcccactccctgtcccctgcaggcgtccgacccgaagtccacgcgccggaactcggaccaggagccagaggaccccagcgcag

SEQ ID NO: 174539 - DNA, 597 bp, Homo sapiens
ctaatttgcaggatgttaaacaactggatgaaatgttatgatttaatttggtcagtataaataatcaaatattgggacaaataatttaattcatttagtttattaattatatttcctgtctgtatcttttattgaacattgtttaaacataaccttaaagtactgataatttgcttaattttcaacacaaatttatctgacaaattctgtctatagtaacagatggtcagaatgcagataaattgtgtgcatctcaatcagtaaaaataatattcagtaaaatgtctataaatctatgcagattaagttgtgaaaaacaatgcaattttagtactactggattagatgcagtaaaggaatccctaaggaagtttacaataatatatttaattaaaatctactggcaattagaattttaaggaattcttttctaagaagttggagaacctaaaatagcttgcttattcgcctgggtactctcatgaagtaaccatgtacacctaataaagaaatagtaaaagcacatataatgaaaaataattaagatttcttacacctgattttttcattatcagagataattatcagagataattt

SEQ ID NO: 174540 - DNA, 364 bp, Homo sapiens
ttcctgttggcccgatccatactcgtggctttttgccagccttggctgcattgtggcggtgtatttcccttcggccgtgccttctagctggccgtcgtttatcacaactcaagttttagctttaaaggcaaagaaccagcacttatgtcttaataccatctctaaaatcagtctctagtgatgacagatgcaggtctttttattgagaactgtcctcagaatttaaattgggttttttgtcaaataagttcgcttaaacacacatacatcttgagttatcgaatatagcattttataatgatatattgaagaataaggtaaaaagcttcaaagctggacattttcccactgtgctatatagttg

SEQ ID NO: 174541 - DNA, 188 bp, Homo sapiens
tttctaagtccttgcttgatccgtgaagatcaaatagttaaatactgggcatttgggctttaacccttagcggttgatgcatgatggtgttgattagtgctttgagatgtgtcaacctttcttttttatactaacagcatcattttgaaatttgtggtgttgtttttcttttgagctttgtttgctgt

SEQ ID NO: 174542 - DNA, 180 bp, Homo sapiens
tagccggtccggttcaaaaacgggtgatgttatttggcataatgagtgacagaaattctacgcttatcctttaaggctattaagtaagttgtatgctgacaaatgcatatacctctcatgacatgtgtctgcctgcctgtcactcatcagcaggaaccacatggtcaccagatgcttgtg

SEQ ID NO: 174543 - DNA, 233 bp, Homo sapiens
ctacataaattcacagggaaccgtatccaacacatcctaaacagctggtgaggaggacgtgctctgggtggctcagcttgactctgggcttcataaaggcattgctgttgatgcacacgaagggtttgaagagaaattattttgtaagctgggtgtgggaaatagtattttatagtcaacaggatttttaagtatgtgtatgtaaacaaattaataaaacctacaaatcgtga

SEQ ID NO: 174544 - DNA, 364 bp, Homo sapiens
gaactgttcagagtcagtcttttcggcaagaacttcagagaactgtgacactggttatgatgtgattttggggggtttcaggtacctaagcatgatttttaaaatcacttctctctttacatatttcgaacatatgtttgctttctacactttgcagattttatttaggatttaattctttaaagactatattcatttagtcactatagtggatctcttctactgcaagtattcatctgatttttaaattatgtaaaatgtaaatcagccaagtatgtcatccgttatagtttccccatgctttcagcgcatggccatgagatttttacatgtgcataagtatttagccaatacacattttgct

SEQ ID NO: 174545 - DNA, 150 bp, Homo sapiens
gtgcccatgacaggcatgtgtgttgtatgcacgtgtttgttgtatgttctctgtacatgtgtgcatgtatgtgtgcttttgtgtgcacctgtgcatttgtgtgtgggggagtgctgaggtacagagagcagctccaaggtaggaaagaac

SEQ ID NO: 174546 - DNA, 1060 bp, Homo sapiens
agataaatctttaattgggagtgatgtttcttatttggcctatgaactgacagtggatttccttatgttttgaaataaatattctgtaatttgggtataatctataggtgagtaattgaaccagccacagagatcccgttagaaagatggctgcttttttgttgcatggtcacatttgacttagagaatcctggtgagaccgagtggttagaggatctgagacatctttcctacttctggattgtcactgaaattaccttaaagaaagccttgataggctgggcgtggtggcgcacacctgtaatcccagcactttgggaggctaaggtgggcggattgcctgagctcaggagttcaagaccaccctgggcaacatggtgaaacctcatctctactaaaatacaaaaaattagccgggtgtggtggcaggtgcctgtagtcccagctatcgtgccaataatcccaactactcgggaggctgaggcaggagaatcgcttgaacctagaaggcggaggttgcagtgagccgagatcacgtcactgacctccaacctgggcaacagagggagaccctgtctccaaaaaaaaaaagaagaaagccttgataatcctgtatatgtacttggggaagcgataatgaagaaataatttaaaatggatgagggggttatgcagctaaatgtagcatcttattaagggctgaaagttacctgaatctatttgagagctaaaacattttgttcagaaattccaaaatagatgccaaattggaatacttcatttcagactcccaagagctttactttttacgcatggttttgtggcatgtccttggttgaggggatggcgagaagagtggcctctttttgaatgattctcatttttgttgttgttgttgttgttgttgttgttgttgttgttgtttttctgagccagggtctcactctgttgcccaggctggagtgtagtggcttgatctcagctcactgcaacctctgcctgcccctggctcaagtgatcctcccacctcagcctcccgaatagttgggattatcggcac

SEQ ID NO: 174547 - DNA, 976 bp, Homo sapiens
ggcacgaggtacaggaagtcaaggtcaggccatacccaccacagttcgggcagccatagaggagagctttcttaacggtctgctgggacccaagtgggcctcccctgggactgcgtgctcccctacagaacctgatggctggaaacactcacactactgcctgtcccggcatctctccctccgccgcaggggctgatgctgccacaggacacagagcagcaggccccagaggcttctctgcacctctgctgcctttctgagtaatcagaggaggccacacccactccaggacacccacacgggccttctgggcgatgacgctcctggcccaggagtggggggctgcctcacacctgctgctgtggggcagagtctctcctgggtcggggcctcgctggcggatctgctccatgtcgtgtgatgtgctgcagccccgcgtcaccgagagcctcttatgggccaccaagtccacacagccactggccatggggcaccctgcagggcctctggacacggagacctgtggttctcagccagtggtgattttgtgtccagggaacacctggccaagtctgggttcaattttgtttgtcacagtttaaggttggggtgtcactagacatcctacagtgcacaggacggccccacagcagaccagccccactgtcagcagcaccgagccgggaaagcctggtctggagccgtttctctctagggtccctgctagggaacccctcactgccatggagaacccctctcctcctgtctctcaggactctccgagggtcaaggatggatgcctccccatcgagggccaaacaaactgacaaatcgagtgggcaaacggcttactcaaaggccaggagcagctacccgatgactgctccctcgacctctctcttctcactttcttccctattccatcctttgatgggtggcctgttacacgtttggaaataaaaacaagtgggaaaga

SEQ ID NO: 174548 - DNA, 332 bp, Homo sapiens
aaggacatgaactaatcactttttatggctgcatagtattccatggtgtatatgtgccacattttcttcatccagtctatcgttgttggacatttgggttggttccaagtctttgctattgtgaatattgccgctataaacatacgtgtgcatgtgtctttatagcagcatgatttataatcctttgggtatatacacagcctttcttgcagcttctgcagcctctgcctgagagatccgctcaatgggccatctgctcggaggcctttctgcaaaagctttaagagttccatttctccagggagctggaagctggggaggtgtcagctcca

SEQ ID NO: 174549 - DNA, 425 bp, Homo sapiens
atctgtttaaagaaccaagtgcagggctgatgaggttagagaaattgataaggcgccaattgttggtcagatgccctggaaaacagatccctatagtttgatccagcattctagtaggtttagatgcggtcgctgacttcagtgttaatgatctgatctaagagcattggtctgttcagaagaacctcagaataccaactggaaagaagacaactcattaacagtgacttgctcaatattgcacatatggaggacatagttagtctcctgagttctgagtattctgactccctggtagtaccaagctatgtcttttgcgtttcaaagaaacgttaacaagtaataattttgcgttattttcatttttcatacagtaaaatttactgtttgtagagtacaggtttataattttgatagatgcatgg

SEQ ID NO: 174550 - DNA, 267 bp, Homo sapiens
tccaggtttgtagtttgagagaaggctaggctaggcggaaagcccatgtcctccaaactcaatgaccacttcaaaaaggctgggcctggtgatgcagtattgggactaagagaagaaagatggtgttaggtctgaggaataaaagaagaaaacaaaaacagagggaccagagttctaaagcacatttactgaatacccacatctaaggaatgcaaggatgataagcccaaacataaagaataaggcagatactgtgtcgggtgcagt

SEQ ID NO: 174551 - DNA, 368 bp, Homo sapiens
cctgcaggagcctctctcctcagcctccacggagcgcgcggcgctgcttgacggccacgacctgctgaggacaaacggtgtgtgcagagccgggcgcctgggcccccggggcgtgaggggcgggagtttctgagaccccggagatggagtctcgagtgcgtgggggccctatggtccctgaggctggaagggggtcccctgagtcctcccaagtgacccgaggggcatgcattttggggcgggggtcgttccagcctcgaagcagacggcggcgctgggtgccctgaaggaggaggtcggagactgccacagctgctgtgagggggcgcggtcgaggctgtgggcgcagggatggggtcttgcggccg

SEQ ID NO: 174552 - DNA, 407 bp, Homo sapiens
atgctttgttgtttggatatatcggacgatggggattctcgctaagatgatgatggatagtaataaggcaaagacgcctgctagtctgttacggacagatcagagaattgtgtatgcgaataagacatatactcctggcttgatcgttgggacgggtgttgaattcatctaggatttagcatctcccactttaacagggacacagtgacacctgctcctgtagtcacagtggggagaggggagcagagctgtgggccaggggcctgctgagttccatgaactgacatcagctagttcgtgtgttggatgagacttgatgaaaatgtgtggttttttttttttcttatgaaaaacttttcagagttcttgtttgcaaatgcagggtgttaggccatgtatgtctctaa

SEQ ID NO: 174553 - DNA, 1007 bp, Homo sapiens
gggaaaccattccagaaattctcataaaatctctggttccacttttacaagtcgagactgcaacaaagagagcgagtgcccaaggtcacagggtggcgcagccaggattagaacctgagtcctcatctgcctttcctctcggtggaacatgggatctgaccgcagctgcttcagttacatgccctgtgccaagcaccagagtcatatttttgccacccacggcatggcttcctcacatcaggaagccaattccagagagaaaataggttgtgcctgaacatctagggttgagaggttaaagggttgcaggaaagcagttagtaaccacactctccatcatttttgctgttgggggagaaatcagtattatagctcttacattttgcaatggcatttgtactaatatgaagctttctccctccctctctctgctaatgggctggtcataaagaatgaatcaagtgtggagaagactgctttcccagacctcatctaaatcctaaaatctgccgttgacccacaggtcaaagctacttgccacatgaagctgcttttttctctgtattctttctcttttacctagaatgcctctgttcatataacatagagaagtaacacacttaatcttaacacagtaaacatctggctttttgtcacaggcagaattcttggaaggccgcagtcttgagagtccaggggtagaaatcagaaaaggcacaggcctgcccttccatgaccctgaccccttgaatgagtctctaaattcatctaggatttagcatctcccactttaacagggacacagtgacacctgctcctgtagtcacagtggggagaggggagcagagctgtgggccaggggcctgctgagttccatgaactgacatcagctagttcgtgtgttggatgagacttgatgaaaatgtgtggttttttttttttcttatgaaaaacttttcagagttcttgtttgcaaatgcagggtgttaggccatgtatgtctctaa

SEQ ID NO: 174554 - DNA, 242 bp, Homo sapiens
aaccaaaattttaagagccatctgagattgaaattagaaacaaaaacagtaacacaataaagcatcattttacctgtgtgcatacactgaacaccaagttaaatgatgaaagttatgaagacactcattcttgacagcaaaaatccctggtgaacagtgacagatcatgagaaaaccaagacttaatgatattttaggtacagcttaaatatactttaaaacaaaatgatctagccaggtgc

SEQ ID NO: 174555 - DNA, 467 bp, Homo sapiens
tgatgaatacttgaatgaatgcctgtatcctgggacatatatagtgtcaccatgcccaggtctcctccacagatggagtcactgagacccaaatgacccacaggctgtgttcaggtcggtgctggaacctggctctttatacccagggctggttcccctcccacctccctgggctgcaccgcaccatgccgcctcctctcagcaagcccaccctccccctgactctgctggaagatgggctgggtgtggggggtgttaacacagccaaacaattaactggaatcgcacaaaggaaaggtggggagagggacactcttggcaacgcagcagcgttaggagagatggatgaactttcccacttcaccggcgccacggagctgacagtaaatatcagaagtaatgatattgactttaaggtattatggttccaaatgtcacttgtgctttcgttctctttctctctttta

SEQ ID NO: 174556 - DNA, 404 bp, Homo sapiens
tcggggatggccaccatttgtgtttgctgcctggtggtgtttgcagctgcgagaagggccttggaggaggagcaaagtgtagtggtatctccgtgctgtggccttgggcactggggtgggggttagatgagtaattagctgaatatgacctcacccatgaagaatgtgcccttgctaggtattagcagaggtttaggctccagggagccattgtcagaagcttgtcagtgatgtcatcagctggaagggccagctttcaggcctcaggaaaaagcttgaaagtcagggctccagttttggtaataaatgggaatggagtttcacaggtagggtgtggaggaatttattgtgacaggaagcctgatggagcctcttgcctgtgtgcagcccccagccaggtttct

SEQ ID NO: 174557 - DNA, 437 bp, Homo sapiens
agcaggaaaacaaggatttgaatgttgacttacttgagtctcagtctattttctatactataatggcatgttccaaattatgtcttttagaatattttttctgtggaaatatatgctacataaaaaaagttcattgtcaaactggtagatactgatttaaagtctttcttataggacttctcagtgcctttagtatctttatatgagctatcaattttgaagaaagcatattattatttgagtgttccaaacttattttccaaagaatgcacatgtgccatgaaatataattttgggaggtacattccacttcagaatttaagtaatagaaaaaaaatctgtaaaaattagctgtttccattagcaacatcaagaaatctaggtactcagggcctcaattcaaaagcagagaattaaatattcaaatagagaagaaa

SEQ ID NO: 174558 - DNA, 643 bp, Homo sapiens
tcttactggaagattatttgctacatgaaagcagctgtgacaggtgtgagtttaagataattccaaaacattttatggaacttagtgcattattggcctaagcctttttcaaaaagtccctaatttatgtatcttggttgcttcttcctccttgtgctgcatgaaagcacaaaacaactgtgactacttgctgttaagtttattcatttcacaagtaatttatttaatactttctgtgcaagatattgtgctagtcactgtgggggaaaaaaaccctacaactgtgactcaggatattgccctgaaatttttatagccccatctggcacacaaaaagcacacaaatcaaataacaatacaagatgatatctgatgaaactgccaaacgaatgttaccatctgtaaatcctggggaagtgctagcgagcaagaaatcactgctggtgctttgggggagctgggccttgtgccttgatgataaatgcaatttgtataggtggacaggatagggaaggtactctatgaaactgataagaccctcccttctcacacttctgctccctcaccactcccacttagcacaggtgaataatgattaagtgcttaagtttttcctccattcacatatttgttcaaggagtgg

SEQ ID NO: 174559 - DNA, 431 bp, Homo sapiens
gggatgccaaaaaaactcagtaatcaagacaaataattgttcagagtcgggttgaccagatgtccctcctggatactaagtccagcagatggcccattgggcagccagcccactggccccaggagcatagggaccttcatgtttggcagggcagcaggtccgcctagcccaggccggcctctccattcacaccaccgatagcctgaatgactgcagtaactccccactgctctgcaagcttttcgactcctcccaatccatttactgcaccatggccaaagtaatatttctgaaatataagccacctctgaactgttcaacagttctgcagtgtttctggaatgatgcacctaaaccctcaatggaccttgcccccgatcctgctttcctctttagcatccacatccacatttttttgcaactctgtcagc

SEQ ID NO: 174560 - DNA, 150 bp, Homo sapiens
aaacaaatgaccctgcacattctcaccttctttctcgtccaatactccctgttctctgagtgggacaccactctgcctggacaagttgtattcgcctgccaggttctctcccttcccagcaaggaacatccttgctagttcccttctggt

SEQ ID NO: 174561 - DNA, 548 bp, Homo sapiens
agttttgtgtgtggctggcattcagcttcctgttttttagccatgagacacctccctgaagtcttgctatgaccaagaccctgacagccacaccttctttctgcctgttagaatcactttctgtcgggtttcccttataaggtgatagagaacatagacttcataacaaaatatcactctcactgggaaggctgaggggttggtctttttgtgcctggtactgtgctcagtggggacttggggacatgcttcgcatttaaggtataggttgttttaggcatgggcagtaggcgctttcagcacaggctccctgctggtcactctttgctgtagtttcctgctccatccatggggtcggaggtcttacctcctgacgttagagtcatttgcagcaggtgggagtgaaagtgggccgggtgccaggtcttctttacctgaacctctcctgtcttcctggcacattaggaatgtccaagcttatttctattggtgaatgctcccacatgggatggataatggcctgtggaacattctctgaatgctttgtg

SEQ ID NO: 174562 - DNA, 394 bp, Homo sapiens
ttcagaggctcattctctccccctccttttttttccccctttcaaagcttactggtaaagtacaaggtaaaatttgcttaggggcaatagtttgtgggttagtatgaacttaaaaataagtgggatattgagttttcattatttaacatagcttgtccaaaatagtgagcaggtataaaattatcaacattattaccattttgtctttagatgtctgtgaaacacccccatatgttttaacatcatcaataacaatttcattaatttgcttgaagtatatatattagtgaggttgtaataagaagttattcgaggctttttaaaaaatcttcctaagttcttttcttacctccccacatagatgatcctgtaagaggatactggaaactctgat

SEQ ID NO: 174563 - DNA, 258 bp, Homo sapiens
tctatttgtgtaagattaataaaaccactccagctttcttaggattgttgtttgcatggtattacattttccatatttttacttttagctcatttgtatctctgaatctaaagtatcttttatgaacagcaaatagttgaatcttgttttcaaaatccaatttaacaatttctgtcttttggttgaagtgtttgatcattttacagttattgtaattactgttttgtttttttgtttgtttttttttttttttttttt

SEQ ID NO: 174564 - DNA, 192 bp, Homo sapiens
gttgtgctatttccaaagataaatgcacacaaatgtttttcttccctgccatttatatcacaaactcataaactgaaattaagggaagctactaatgcatttgcacatttgtaatgtatttgtaatatacattcataatgtacatttgcaatgtttataatgcatttgtaggcttctttttgcccactccaa

SEQ ID NO: 174565 - DNA, 259 bp, Homo sapiens
gtcctgcaatgagatagataattagaaaatgctgtttttttggcatgtatgatcaaatagcttagagtttttaagtatcttatataatttattgattgatacatattaaagtttccagaagttaaattatgtttaaatggactaaggaatatgtcatttaaaagaaacatgccaaccataaaaattgaattcctcctttgatttccttgttttatggtttggatgcttttatataggctttcataaaatgaggcatagg

SEQ ID NO: 174566 - DNA, 405 bp, Homo sapiens
ctacaactggagaatccatccatcaggtgactgagttcctccaaaggggacactactaatgtgtctcagacactaactaaggtgagaaggaatgcactgttgagggggcagcacatccttaagaagctcaatggtggctgtcccctgcaggctggaataatgctagggatgttttatagaactggatcccccagtagtgagtaaaatgatagagttccagaataacaggggccaagtggcagcatttaactgtgaggacaagataaagtaatttccgtaaggggcatcaacgttagagtgacaactgggaggcctgacctgtaggtgtccatgaagatggctcttaggacatgctgttcctctaggcaagacacatattgctttagacatataatcaaaagagat

SEQ ID NO: 174567 - DNA, 825 bp, Homo sapiens
ataaactttgtgagtgctagtatctgtgaatttctataaacattatacaggaaggccgttttcatattatagcaggcactattggggttacgtagatgtgaaagttaaggccctggcctttgagatatggcatagctcatgggagggatgagatctgaattctgataacaattcaggatgatgtagaaaagtgaattgtacaatgtgcaaaatgctaattaactaataaccaacatttgtgtagcatgttgttgtttacatagtgccttcctgcatgcctcactttggattggcgtgatgagagtaaacgtcttgcaagacagggcatttgagcaaggggttgaagaatggcaagggtttatcagatctggggctgtggggtgatcattggggaagggcttgcagaagagctcaaggtgctttcagtgcaatgggagcggttgtgttttgccagagcacctgaatcctgtcaaaagcaggaggtgatgagcttggaaaggtagcagaggccaaattgcaggctttgaatggtggttgactcactttgcaagacaaaggggcagctgcgttttctcgtgtggtattcaagacttcttttcttctcctggacttcaggctgtttttgtacaagagcgcatactcatttctttctctctttttcaaatgtgactaaatcacacttcccagggacaccaagctgtttctgattgcaactgtaacagctgtgtaccagctgggatttttgtattaagcagctctatggggctactataccagcagaaaattagaagtcttgctctaaaaagcattttcagcaaatacttg

SEQ ID NO: 174568 - DNA, 450 bp, Homo sapiens
ttaaataagatctaaataaacacagagacattttgtgttcttggattgaaagacttaatattgttaagatatcagttcttctcaaattgatttgtagattccacacaatcccaatgaaatcccagaatgttattttgtggatatttaggaacttaatctaagtttatatgaaaagacaaaagacccagaacatgtaacacactcctgaagaagaacaaatttgaaggactgacactacccaacttcaagagttactataatcaagtagcatggtgtggtgttgctgagggaaaagaagacatacagatcaatggagtagaatagagacccaaggattagacccacataaatacagtaaattgatacttgacaagggatcaaggacagtttagtagagaaagaatagtcttttcaacaaatggtgctagaacaactgaatagccacatgta

SEQ ID NO: 174569 - DNA, 531 bp, Homo sapiens
tgcacacaagctttgcagcatgcactatattcaaattcatgcatcagcaaaattgtaaattactgcatgttatgaatcctcaggttgtttgcaaagaatcataactgttctcaggtactgagttctcaaatgtggaaggtcttctgcggagggggaaagggaagagtactcaactggcgatcagagacctggtttccagtgcagctctgtcaaatcgattcacttctcttgagccccagtattcccaagaggaataccatatctttgcccatctcactgcgttgtggggatcaatgaacacaaccaactgtggatgtgcttggggaaagcctggcacatttgtatacctggaaggcatgatcgttcccacagggagcgtgtggctcccgcagagggccctggtcattcgggatgacaggtatagggaaaaggctaactcatggccatttgacaatggagtggagccttcatcttcctgctccctttaaagagcatgagctccccccaccatgttttttcataaggggaatg

SEQ ID NO: 174570 - DNA, 671 bp, Homo sapiens
caaaaaagtattgccctgacctttttgggggtctttatttaggtactgaaaagttgaatcacatccacaaataaattattacgtctttccatataagaagactaccaaaagcttagaatttactgacagatattggggactgagccacttttgttgaaaacagtgacaccatacaaggcaaattcaataaaattggaggcatccttgacactaccgagagaacagccgagagactggccaggaaggccagaaacctggtgtgtcatgtgggcacccatccctgcaaaggtctcacaccagctcctcacaccagcaaggacacctcaacatgaagatctatggctgctgccagcctgtggcttttggatgcataaagtcacaaactaatttagagacctagcccctgtattagcagctgagaatccctgcccagggaatagacttcgtgtgtctcttccacccatttcttctttgaaattgtgttctcgtggtgcctagcagaggctatgtgtgtgtctcactctgcacagctcacattctgctttgtggccacacgacccaggaagagggcccacaaatggacgagaatagagggaggtgggggtggaaatagagaaaccacattccaggccgaccaaagactttatgtatatatgctcaggaaattgaac

SEQ ID NO: 174571 - DNA, 460 bp, Homo sapiens
aataactgaagcagcaataactgaatcatgctatgagccaggtgctgtgttaagtgtttcataacaatggccttggctagcaatatacccattttccagatgaaaagctaaagagacaggggccaagattaaagccctctaatcaatctgacttcacgcataatctcttctcattcattacactacagaaagatgaaagaacttgcacaaagtcacctagttaacaagtggtagtgtaagatttgtgccaagtctacttttcaattaaccctgtggctttccattcttcatgtctgagcactgtgtcccttgctgcacaccctggtgtccagaactcagcaggcattcaataaacacttgaagaactgaattggcttgaatgagatggtttgctatctatttcctctatccccatgggaaaagagaagaaatcttacagactgaagtaaaggattaaact

SEQ ID NO: 174572 - DNA, 280 bp, Homo sapiens
ctgacttggatcagattcatttttacaaattataattttcattcaaaatagatatctactagcttccctccctggttcttctggaattcctgaacaacaatgcctaatagctgctgtttgtatctagataaaactgttggtggacctggtgcaacagatattcaaactttcccaacatggaatattagtctttcctgactttatcacattggggccaagatttctttgttctctttcttccttgtggaaacgacattttaaatgtaagccttacactatg

SEQ ID NO: 174573 - DNA, 161 bp, Homo sapiens
catctgtgaaccaaccactgcggcaaaaacaataggagtgcctggttgttgttcccgattcactggctcaggcatagcattagctttccctaaaacactcgaaaggagagtaatagggaatcagaacacctaacaaaatcaaggcctttttatcacaagaa

SEQ ID NO: 174574 - DNA, 310 bp, Homo sapiens
caaaaaatcatcaaggggtaacttcaaagctcatcgctgaaaccccatttacgtagaccatgcagtttatgtatacagtcagccctccgtatctgtgggttctgcatccatggattcaaccaaacgtggattgaaaatagttggtaaaaaactgcctgtactgaacatgtacacttttttttcctgttattattctctaaaccagggatccccaacccccgggccacagaccagtactggtcagtggcctgtttggaactgggttgcatagcaggaagtgagcggcaagcgagcattaccacctgagctc

SEQ ID NO: 174575 - DNA, 184 bp, Homo sapiens
atagatattcttccttctttccactaataataagggattagtaacctgtgtaatcattatacctctaactcttctgggcaccagacttgcctctccacttactagatttttttcccacaaacctacacctgtcgaggtgttctctgtattaatgagcagcatccacccaagctaaaaacctggc

SEQ ID NO: 174576 - DNA, 184 bp, Homo sapiens
gaaatcctcaaatcagggaaccagtgctgaagaggtctgaggttactatggccctttcacaagtgggtaaactgaggctccctgacccacccccacccccgggggcacaggagcttgctctttggaccctccttgcactgcccccacaggaaagaacacttgatgtccatggaaatcttgctga

SEQ ID NO: 174577 - DNA, 154 bp, Homo sapiens
tgggaacacagtcaaaccatatcaatgtgatacttttgatacataaaagacattttttcaacatgttattatggatatttaaattacagagataggtcaaaagttgttacttaatttttagagttatcaatgtatttttggtgactttttaagt

SEQ ID NO: 174578 - DNA, 235 bp, Homo sapiens
tgaacctaaacaattaggcccttttactttccccagcatctactttccctttgttttggtctaaaaacagtctgtatgtctataaataaattaacacctggtctttctttgatagtggagaactagaaagtactgtaggtctaatattgtcaaagtgagaccttgtctgtgggccgcttctgaaactgatggaaaactctaaaattcttcctattcagttttaatttcaaaattt

SEQ ID NO: 174579 - DNA, 420 bp, Homo sapiens
tttcttaaaacattacgagaatttctgtgattttttttttaagttcatcagctgtcattagtgttattttatgtatggcccaagacagttcttcttcttccagtgtgacccaaggaagccaaaagattggacacctctgctctaaatgttcttagcttctctgtgacaagatttacttagagggatacatgaaaagttaaaaagttacaaagaacaaggtcaaacagagtttgataatagtgtttctaagcaatgtgacaggatttaagcacttcctgggaagatccatgccattttgagacacatgatcagataaatattgttaatattgtctgagttattattaagatctactagaatagtatagacaatgggtaatgaaaattggacttgggtgaatgaagagacagtatgttaatg

SEQ ID NO: 174580 - DNA, 365 bp, Homo sapiens
ttccaaagtgctaggtaaattataggcatgaaccaccccacctaggctggaacttctttcttatagtaaatttccctcatatgcttccctagggtgcttagcaggaaaaaaaaatccttaaaataaaaattgctggtagaaatcacaggaaagggggaaggtaagtatctggtgggaatgaaactccagacagagtgggtggtggccctgggtggggaagaggcagaacccgggagctgatgcgaaggaagggagggcagctggggaagcagccgcaggcggatgtcgctggctgacacagtggggctgctcagtcaatgcttctcccggggagggaagtgcgcctggggccctggtgtgtcctg

SEQ ID NO: 174581 - DNA, 157 bp, Homo sapiens
ccccctccttcccatccctcaacaccctccagcccccacctgcaccctcctgcaaggaatgcgcgggacccccaccgtgggcacgcgtccacctgaaccccctcctagctccgagcgccgagggaggggtagcatttgaggagggggatggcggccg

SEQ ID NO: 174582 - DNA, 920 bp, Homo sapiens
tgcaacgatgtcctcttgctgctgtgccagcatttctctgaggctggactcctgaagttgcaccctgtaactcttggaggctctgtcatattccctcagaaaatgtcctgttggcacagatagacaatacaggaaggagcccagacagcccttgaaacagtccaccctactccacagaccaagaccctcattggcgcaacctcatctgttaccgagtcccccaagatggcaaagccagacctggacagctggcctcacgattgtcctgagagccagaggcggaggcaggatcaccaaaaatcgcttgcaggaagggcagagagcacaagtctctcggttccaagatgcccgacacctgactccacagccctgggggtgccctggctgctgctgtgcgctggctctgatgagtgcatgttgcctctgccctttcagaacttattctctttcccatttgcgctagagctgctggtgctgctctgcaaagacgccctgggtggcttctccctcgcttcatgatagattattgccaaattctgccttgcaactcagtcagcatttctgacctcaggctgctgtggcggttctgtccctctacgccatccagtgacgtggtggggagcgtgtgcttgtgtagggacagctttccaggcggctccccagcctctcccaagatgccattgctcctcaggagctgctgggaagtgggcagtgtggaaagtcagcccctacttcacaggagactctgggccaggcacgtcctggcacctgcttcagccgccctgccatggtgcctgccgccggcctgagcagggcgtttgtagccacaagtggaaagcagagccaggaatacccaaggcggaaaaagcaaacacgacagaacgttagctgccgctcccttgagctgagggtcttagggt

SEQ ID NO: 174583 - DNA, 379 bp, Homo sapiens
caaaaacagccctattattttttcattgaaaatttcttagaatcagataatactgtccaaaatattctgtgaccatgtaatgttatcctaaattgctgtcaacatcaaatggtggtcacaccgaagaaattattaggagactaacaatgtgatattctaattttgttgttgtattctgtaatgtatttaagaattaaacaactaaatctctgttgttctcacattttcctattttctattttttttaatcctagttaagattagagagccttctagtatgactttctttttttttttttttttttttttttatatattaatttttttttttttaaaaaaaattttttttggcacccaaggggaaatatgagagtacata

SEQ ID NO: 174584 - DNA, 336 bp, Homo sapiens
taaaaaatgagttcctactatgtgacagacccatccacttttaggcaccggaaaacagaattgcagtttacattggagaggcgggtatcaacaaacatgaaaaccatacaaaggaacaatctctgatagcagtaactatcatggaggacacaaaagaaagtgatactatggagaagggcctggagcaaggagggaggttactattgaaccagggccatccaagaaggtttggcctagggcctgacattcaagttcagagtgagctcttcattccgagccttaggttaaaatgctctcaactcagaccttgctccctatcttattttgtttgtttga

SEQ ID NO: 174585 - DNA, 203 bp, Homo sapiens
aggggtgggacttgggcaaggccatacaagaatgaaccagactcctgccttccagacctgttctgttctaccacactcctccaaaggaggcctgctcaaggctcctgggatttattggtgaccaggaacatttttcatcaaatataataaaaaatgtaaaagcccaggtctgtaaaacgtcctgctaaaaaaatataatttca

SEQ ID NO: 174586 - DNA, 1042 bp, Homo sapiens
atgtttttgagggacaagctataaagcagtcgactcagcccagactaaggaatgcttttctttaaaaatcagagggtaagtggtagacttagtagtagcctatatggttacaaattatcaggtgttagctctctcaggtgtcctgtggcaacagtgagtgaatatttctaaaagttttggaatttgaattagttgagaacctatgtttgtgcattttgaatatattgaggatattttcccccttaactctaaacattttgagttaacattttaaaagtacattttcaacatgcagaggttgagtgcccaataagtggcaggccataatgttcggtatggcaacacaaaaatgtgtaagagacagtttctgcttgtaggaccttctaagagtgggcaaaacaatacaggcttataagaggtagctacgaaaggcctaaaggagaggacacagtgagacaggagagaagccagggatatttcacacaagaggtaacttttgagcagtgttaggatttagaggagtctgcatagcagataaagggagaggtgttagcaaagagtatctgtgaggatgatactcttggaattgcaggtcataagactgggaaagtaggtaaatgctccctgaatggggcttatactttatcctataggcagtgggaagccttaggtaagaatacagtgatacgaaagttttgcattcactttagtaatggtgaaaaactggggaacagtctattaggtggcagtctttgggctggaatatcccaactgatttctggttttattttctaaaattgttgccttggacccttcctatttttataaccagacacagaaaatcaataaaagtttgagcccagtttatagactattgccagcagtagttcaggttttaaaaaaatgatgagggattaatctaggggcatgaaggagaaaggatagattttttatttatgtctatatataaatagacatttatatttacaaaggttgacttagcaggccttagtgattgcttagcaagattagggaaaagaaa

SEQ ID NO: 174587 - DNA, 693 bp, Homo sapiens
acagagagacagatgaagagagagtgaacggagagagagcgagagacaaagagcagggtgccttgcagctggtagagcccattcacaccctctcttcaccctcccctggttttcccacttttctagcctttgtcctcttgtaccaccaggttgaaacaccctcttctttcattttacacctttctgtactcttagacgaaagaaaaggttgttagaggctcatctccaacctcattgcttggcaaaaggagttagagtctgcagagaagccgcagtgcggcagggagtctaggatcccaaataacagatctgggagaatcctgcctcagtacttggatgcgcctcctgcccatgagcctggtgagcacagatctgttggcagtaaccggctgtgggtaatcacccccaactgcttcttgggcagagatggttggagggttgtgagttagggagacagaatgaaggccttttttcgaaaaccagcaacagagacataggccattagatgcaggatggctgctaagacaggtaagagaagactttagtcactcctgaactctcataaccagttcacactgctcctgctcatccatgcataccagacctgaatgaaataccacatgcaggtccaaggacactgcggagacaggcaccctgcttttgtctctcgctctctctccgttctctcatcca

SEQ ID NO: 174588 - DNA, 379 bp, Homo sapiens
acattttaaatggttgaactctctgaaatgtgaatgatatctcagtgaaactgttttgaaaatccaaaggcaggatcaagataattttctcaactctcaatttttgatgtacatgctatatcaaatctaaatatttctagagttttatagtatattttaaataaaagataaataaagaaaatgcctaaattttcaaatagtttgtaaattaacctaaaacatgcacatttcaaagaatggtataatggcctttctgtacaagttaacctacaatctgtgaaataaatagacacagattcagtgtccattcacaaaagtgaagaaacaagacaattttctggaactttccatgaaacattttcctctgattttatctggc

SEQ ID NO: 174589 - DNA, 754 bp, Homo sapiens
catatacttcacctcccaggtaagggccatttccttgattccaaatatttaaagatcctatcaactatcctgatattttattccttcaatttccttcctctcaataggatttacaacaatttgcagttcctccctgtcttgccagctgtcaaatattacctgttttcaactctgctctatttaaacacatcaaaccagcctcctctgttccaaccgttcccataccttctccatataccttgccctaaatctatgtagaaaccctctctacaccccactttcattaatgtccaaccgttggctttccccaccaatcccctggatagcacttcctagtttttctctctcagccctgcctcttccttctctcctgtgttaaccccatgcctcctcccaggttctagcctttcaacttgtcccaaccctaacgtgattctgaaaaattctcaagtcccagctttcctggttagattccttggctacacatactctattcctttctcctattacatatactctctttctcaccctcatcctctccaagatagtttcctagaacatgcatatatgagaaaatactactaagaaaaaaccctaaggaatacgtaaagcggagagagtaatcaaagatgtaaaagaactggatagaagggaaggatgcatttagaaaattccagaatgaagaagcatcatacaaatgtttggaaaaatatactagcgcatgcgcctaaggatgggtccctacccaagccca

SEQ ID NO: 174590 - DNA, 219 bp, Homo sapiens
tgccaacaagagtcacctctaagatgatccagctgttgcatggtgtagcatgcctagtccttgcagcacacacgctgccattcttcttcgccgttgttaccgtattaatttagggatgatgagaaagtggcctccctttccctgttaattccttggaggaacttctgttcgaaatgaatagtcttgaaatatgtcataaagttacctatcaggaccact

SEQ ID NO: 174591 - DNA, 183 bp, Homo sapiens
gagaatcgcttgaacccaggaggcagagttgcagtgagccgagatcgagccactgcactccagcctggggacaagagcgagactttgtctcaaaaaagaaaaaagaaaagaaaaaccatgcccagttttggggatactgttattctaccagacaggctcattttccgggactgtgtcattgca

SEQ ID NO: 174592 - DNA, 393 bp, Homo sapiens
aaaaagaaaaaagttccaaaatgcaaggtttgttttaatttggtgctgatttattccaacatttaggttaatccaagaagtctggatgcttcatcttacagacaaccctaagacgaaatggcctcatgttgcatctaggttttattttaagttaaagagatgaatggaaatatccaactagagtgtgaccaattcgctttctcactccagaaaatccccccttctgctccttcctattctaatcctactcatcctttcaacctattttcttaatggggagaaagctccacacatcaaatttcgcaaacacttacgtcacacaactgcctaggccaggagttggtaagcttttcccataaaagaccatagggtaaatatttcatggtttccatt

SEQ ID NO: 174593 - DNA, 316 bp, Homo sapiens
ttgtattgaacattatttgtatcatatcaattatctaatcctcaatacagctcttttatttcacagaataggaaattgaagcaaagagaggaaaagttgcatgaacgattttacacagctgttaggtcgttgaactggattctgaacctagcattctggctggagagcccaagcttttatcagttgtgtatagcagtgagagtagattccccatggaaaggtaagagctgaatacagagtccagagggaacaccaatatgaagaaggagttgtgaagcggcctgaaaagaaatgacaaagataggaagagagttac

SEQ ID NO: 174594 - DNA, 176 bp, Homo sapiens
tgagagaggaggaaagagatgggaggaaggcaccaggctcttttcaacaaccagctctcaggagaactcttgcaggaattaacagagtgaaaattcactcattatcatgaggacagcacccagtcattcatgagggatcttgatccctaacacttctaattaggccccacctccaa

SEQ ID NO: 174595 - DNA, 337 bp, Homo sapiens
aataaagcctgagtgctcccttctttggtatatgctggaagttcaagacatgcctgggtacctttacccttgccctactccttaaccatagtcacaacacattttcctgctctcacaagccacttttgaaccagcttgggaagtctcctgctctttccagagtctcattatgtaacaaatattctcatgatacttcactatgtgacgtcatcagtcccagcatccaaatcaaagtgtgggtggggttccactctgttctagtggagtggccacagtgctaattaacaaaatatgctttgggttgaatatataaagtttctactttactcaccctgca

SEQ ID NO: 174596 - DNA, 608 bp, Homo sapiens
cgcctgacctctgtgaactgcccgcatcgggctcccaaagtgctgggattacaggcatgagccactgcacccgccccaggatattctttttaatgcattgggacaaccggacatccatgtgcaggaaagtgaacttcaacctaaacctcacaccttaccccgaaactagaaaggatcatagatctaaatgtaaaacctgacactgtaaaacttctagaagaaaatgtaagaggtccgggcacggtggctcatgcctgtaatgccagcactctgggaggtcaaggcgggtggatcacctgaggtcaggagtttgaggctagcctggccaacatagtgaaaccccgtctctactaaaaatacaaaaattagccaggcatggtggtgaatgcctgtagtcccagctactcaggaggctaaggcaggagaatcgcttgaatccaggaagcggaggttatagcgaaccgagatcacaccactgcactccagcctgggcgacagagtgagaccgcgtctcaaaaaaaaaaagaaaacataagagaaaatctttgtgatcttggatgaaagcttttagctatcagctgagtatggtggctcacgcctgtaatcct

SEQ ID NO: 174597 - DNA, 574 bp, Homo sapiens
gggtattccaaggagaagtaagagaatgaaaagcacagaggtaggaaaaataggacatgtttgaaaaacagcatatagtagtttgtccacaatgtagagtacacgtagaagagtagtaaggcaaagctagaagggaaggttagggctgtaccacggagggctgtggatgtccacatggagtcctgcctaaatattcaacaaggggctttaaaaaagcacaatcagtaacttaaggaaaattaacttagcagcaatatatatgttagaattaggtgactgtaatgagagggctgagccagtagagtatgagggaaaagaatggtggcaaaagacaaatgaagaggtagaatcttaatagacttgaaaactgatggaaataagacaggagagaaatcaaatctggaaactgtaatgctagtatattgaaaaaacactgtaaagtagaaaagaaatgagagtaagtttaaatgtaggcatggttaactagaaatgctggactcttgaggaacaagatgaattccagcctatactctatgaataatggaactaggaaagatgggcagtcctggtgctg

SEQ ID NO: 174598 - DNA, 517 bp, Homo sapiens
ttgtcaggctggtctcaatcttctgccctcaaatgatctacccgcctcagcctcccaaagaggtgggattacaggcatgagccgccacgcccagccgataattcctttaaattatcttagatgcaagccttattcaaatgcccctagctattcctaaaatgtacttcgtagctggtacgtccaaaccagaatttaagaccatacactgtatctggtgattatgtcccttgagtctctgaaattagaatagttttattttttcatgattgggattcagtttttcatgatgctaacttttgtcttatagaatgttcctttccgatatatcagattgcttcctcatgataacatttagctttatcttctatcacttgtattacctttaagttatgattagatcttacagcttaactggattcaagatttttggcaagaatgcctcatgtgtatggtaggtttcatcttgcattacatcaggagacacatctggctaccatttggtgatacttgtattaag

SEQ ID NO: 174599 - DNA, 356 bp, Homo sapiens
gcacctcacattatccagagctctttctcagtattaattaaggagagtttagtggtaggaccaccaggtttaaattattctaccaagtacaagctatgtgaccttgaacaagtaacctctttttatttattttatttttttgagatggagtcttgctctgtcacccaggctggagtacagtggtatgatcttggctcactgcaacctccacctccggggttccaatgattctcctgcctcaggctcccaagaagctgggattacaggcatgcaccaccacgcccggctaatttttgtatttttagtagggacggggtttcaccatgttggccaagctggtcttgaactcctgacct

SEQ ID NO: 174600 - DNA, 365 bp, Homo sapiens
ccaggcccaagaggacactgggagctgcccggtacccactgacaggagggtggccaggccgccatggtacactctgcaggcattacacagcagtgagaccagattacaaccacctgtgtcaacaggcatgactcacaaacatgacatgcggagaaagaagcctgaaacaacatatactgcccgattccaatgtatgagctgtgagaacaggcagaaccaccgactccacacacatgagctgtgagaacaggcagaaccaccgactccacatgcacgagctgtaagaacaggtagaacccgccaactccacacacacgagctgtgagaacaggcagaacccaactccacacgcaggagctgtgaga

SEQ ID NO: 174601 - DNA, 345 bp, Homo sapiens
acccccatgcccaccagcacccacatctccagacagccctccaggtttccctgcctgggagaaactgtggggttcccttggcgctggggaaggaggtgagcagaggggacgcccttggtgtcctcccctggcatcagcctgaggcccgtagacctgacaaccgcagctgtttggaaaataagctctccgcatccccggcgctccactgaaggtaaacagctgagctctggaaacgggccaccctcctttgtgtattttccaagcattttcatgccagtaaaacccttctgtgagaacagcagcttgggacacacatcaggcctgggctgctctcgggtgcggccg

SEQ ID NO: 174602 - DNA, 424 bp, Homo sapiens
gtagcactgaattattttattgggtatgcagaagctgtaagcaaataatatagttaaagggtagcttatacatttatacagtaaaataatgttctgaaactagaataagttagaaagtaagggaagggccaggcgcagtggctcacttctgtaatcccagcactttggtaggccgaggtgggcagattgcttgaggccaggagttcaagaccagcatggccaacatggcaaaaccccatctctactaaaaatacaaaaattagccaggcatggtggcatgtgcctgtagtcccagctactccagaggctgaggcatgagaatcgcttgaacctgggaggcggaggtggcagtgagctgagatagcaccactgcactccagcctgggtggcagagtctcgctctctctcaaaaaaaaagaaaaga

SEQ ID NO: 174603 - DNA, 642 bp, Homo sapiens
tattgttgattgtttaacttgtattaacatctgtggcccacagatcatctgaacataagaaaactatacaggttttgtaagaaagtaatgctgatttaaaatcttacatttgcatatgtgaatattaaagtccaggaatctttaatacatacaagaaatgtttagcattattttttaataaatgaaggtacaaaacattttttcataatatgattatgaaattgatagaattaaacttctgtaaaaaattttctactcccacgatttcttagaagtattttctaaataatagtaagggttagtaaccacattgatatggaaagacagacttatggtatctgcaagttttagttttacccttgtggaaaattgaactctaacatctcttcccaagattaatatatgaattttaccaaatacatattagcaaatactgatttggctcctttgaaagcagcataccaggttgtactttatgtatgtctttctgttggtgaccccttaatgactgcccagtgatataccttcttttgtattcttctggtgaacctcagttctctaattgaggtaatctaaatgtgtctgctaggtttttgcgagggtttgtttggcatctgtgctcagatgaatgtcagtgtcctt

SEQ ID NO: 174604 - DNA, 465 bp, Homo sapiens
tgtgcaggcaaactcccatttttaaagccatcggatgttatcttattcactatgatgagaacagcacaggaaagaactgcccacttggttcagttatctcccaccaggtccctctcacaatacatgggaattatgggagctacaagatgagatttgggtggggacacagagccaaatcatatcagagagtgccttccccaaacagtatattgtgtacagtaggaggatgactttgtagttcctttcctcatttctattccctgaagcctggctattcatgtctatccactttgcggtttctgaaagtgtgcagaatcccttaattctctctgcaaacccttggggtgagactgggagactgcatgtgatggtaataatatatattatctactgaggacctgtttgctaagggctttatttcaccctggtaacatatatcaagtgcctcttctgtcctggacaggg

SEQ ID NO: 174605 - DNA, 403 bp, Homo sapiens
ataaaaaaaagtattgtagaaataaaaagccccaaatttcagttttaatttatttcctctacattaagagaaggctgtagaaaagtgaggagtttaacaacgtatttcagtttactgatatccttgataatatgcattttagggaaagcactataatttcacattttaccataaaatatatgtaatacatgtcattagtgatgcgctgaacacctcacattgttcccaatcttaagtcattcactacactcagatttaacgagtcatgtcacaaaaagcatgcctgtaatttgactgctgacaccacttgtttttcattttcaaatgtaagttatataagcaaacatatactcagtgtctgttttgggcatagatactaaggacactacagtgtctcatctca

SEQ ID NO: 174606 - DNA, 976 bp, Homo sapiens
aacccaaaagagagagagctctaaggaattagaagatctctcttaatacagccaccctgctaaaagttcagaaaaatcactttcacgtaaaaatgagcaatataaaaattttgaggtaaaattctatacaaagtgataaaaaaaaaggaacagaataacatcttacacaaaatgaaagcatttatcagacatgtcattacttgtctgtaacctattacttcaaaatgagctaaaagacattaagaataagatatacggcctgaaagaattacataaatcaagccacgtacagtgctcacacctgtaatcccagcactttgggaggccgaggtgggaggatcacttgcactcacgagtttgaagccagccagggcaagatggcgagacgctgtccccacaaaaaaatacaaagaaatagctgggtgtggtggtgcgtgcctgtgatcccagctatttaggaggctgagaaatgggggaagaaagaataaacttgaaaaaaagaaaaatcattctagaaataagaaaatacactagagggacagatagcaaatagatacaacaaataacgctttaaaaaaaactagaaggttaaaatgaaaaacaaaatcaaacagaaattaagagagagagaaggatttaagggaaagtatcgaatactgaagacaggtaaaggagatccaacatatagaaaataggaatccctgggtcaggtgtggtggctcacgcctgttatcccaccactttgtgaggccaaggtgggaggactgcttgagcccaggagttcaagaccagcctggtcaacatggcgaaattctgtctctactaaaaagacaaaaattagccaggcgtggtggcacatgcctgtagtcccagctactcaggaggctgaggcatgagaatcgtttgaacctgggaggcacaggttgcagcgagccaagatcatgctactgtactccagcctgggtgacaaagctca

SEQ ID NO: 174607 - DNA, 652 bp, Homo sapiens
gtcgtcaatccgtacaacagcgcgattaagggctagtggacattttcccccttcccccacagatgggaaccaatgctccagacagcacccacagacacacattcacctgggagtactcatcctaaaacatgcagaagcacacgccccctaagcaagggatccaaggcccatgtgagaaaagttgcttttctgtcctggaaatggaatctacacttggggcaaatcttaagagcaaaagggagagtaaattctgccattaaagcacaatagacccaagatacacttgaagaaaatgtgaatttgccaggcccaaagataacctttaagaaatgagcttctttaccttacaccgatctgaaaagatctctcaacaatttaccaacatgctaatgtgggtgtcaaatcacctttttcttctttcagctgtaatcacaacctgactatgacgttatgactatcctaagctgtacataactagtgcttttccgtgatcttgggacaaactgtgtcatctgcaacaatctcactaaagactgagttttctcatttttcctcagtgaataaaatctaaactctggcacctcaaaccagcaaattaccattacattaacataactgtctttacaacactgtcctgacacagaatattatg

SEQ ID NO: 174608 - DNA, 1052 bp, Homo sapiens
ataatttgacatgcaacgtaaggttagcttttccagctttatttctatagttaccttttcagttcagtatttgatcatgtatggtagaatacagaatagagggtaacaatttatcaacaatctgacaaatgcagaagaaccagtttaatagatttctcagccgagtcaagagataagcaaaatagttaagtgattttttaaaaaaggagagaccaacaattcaaaaacaggtaaaaaaaaaaataataatataggctcaagatcaccttattagtttctatcagatctttccaaataggctgtatttgtgtagaactcctccctgctcccaattctctagatgtgacttaaaaaaatgtccttttttccctgtcatctgaactagcagtaaaatctacagggatgcatactgactcagtataggctttagatcccattgtctgggttggaatcagttctacttgagtggctttggtctcgttattttaaactgtgtctcatttcctcatttgaaaatggaaataaaagtatctacttcttacagttcttaaagattcaaatgaaataacttaccctatgcaaaatgtgtagcacaatgagtaacacataggaagtagccagtaaatgttaatttgctattttttaaaattatatctatctaggtgtttatagtgcttaagacacctaaaggacttcaatagcatattattttaataggtagctgtatacctgggagttgtcatggattcttctctcttcactccattatcaagtctgattcattctaccttggtatttctggaatcaattccattctctctactccactaccttatactgggccttattatttcttacacgggaagaggaggatacaagaggcaacgagaaaacattaatttgctttacacctcaatttcaatgaccagattagagatgttaagtttttttgtttttttgagacagagtcttactgtattgcccaggctggaggcgtgtgctcgtagtcccagctactcaggaagttgaggcaggagatcacgtgatctgga

SEQ ID NO: 174609 - DNA, 324 bp, Homo sapiens
tggcttatgggttttcaagaagtacccatgggatgggattaatgacagctttcttggagatggtaagtatctccaagtgttatgcatttggattgttagcaagaaaatacagactgtattttaggcaatagagaagctatggaggtgataaggaacaaaaatgagtgaagtatgtagtgaggaagcaggattaaccaaagatgatagggtgacacagtggagtgattgaagaaaagatttcatttgtatggaattgggaatcaaagcaatagatgcccttgaaggcttattgaaaaacactttaaaacacaaattaatcattca

SEQ ID NO: 174610 - DNA, 212 bp, Homo sapiens
ctttctaaccagaaaactaagatttctaccttcatagttttacgacattcccggttgacattagaaaccttgagccttgctcctctcctccctcacctctgtctacatgagaacagcgaggggctcattgaggtaaataacattcatgcaccaaaaaatacacatccttattgtcttttaccgtccagataaagaatcttaaagtcaaccca

SEQ ID NO: 174611 - DNA, 1013 bp, Homo sapiens
caatattctctagacaataaatcaaattcaatcccaagtcctctacaattaactgtattaccttgagcaagtcacttaacttgtctgaatcttcatctccttatgtgcagaaagagcataataatgcttcctatactgtggggttactggaagagatgatccaggtaaagtattaaagcacactgacaggcacatagcagaagccaatgcttctccctcttgcagagttcctgagtctcaatggagactaaccccacataagatactctgaaatccataaatggctaaatgaaaggcttcagatactcagagacgcctttctggtaacttcttaaaatacgctggtgggtaaactacaattctaaaatataatacaataatcatagaaaagaatctggaggaacgaacaccaaaatgttaagtgtacatatctctggagattacaggaaattttcatccctaaataatctgtttcttaattgtaactattcaaataatgaacagatattactttttaatcaggaagaaaacattatacacagcatgtctgttttaaagtcccttgtcattcaatacatcacaactgtactggaaataagtaaaaagacactgtttcctaaatgtgtaaaactgaagacatccacaatctttaccaaaagtccctagaaccaataaaaaaaaattaaaatgagaatgtatccagatgtacattaacatcaatcaaattcactattctttagccacacctacacatgctacaagagaagcctttaacaagcgctccaccgttaatgacatgtccctaaaaaggggggtggggagtcacaggcccaacatcatataacaaactggaaacccttctgtacctgttaacttggtgatctcagcatattttctaaggaccagctgtccaggtctgacatacctaccacatcaattgacagggtttttgtcactctcaacagggaagcttccaaatccacaaaaaaataggagggggcagatcaccccta

SEQ ID NO: 174612 - DNA, 734 bp, Homo sapiens
atgaaatcatgcacccagtgcttcattaacgtcgtacgtgtagtgactccaaaatctggagctctcaatttagcattgaccaactgggcatctccatctgagttatgtatcttaagggcatcacttttcctaccagataccaacagtcctgagagtcatcactgacacttctttccctccacccaggcattaccagatagatatttttatgtacccaataccattgaaaaccatctgtttctcttgatatactactaatattctagttcttaaggtatttatttattgcctataaatagattttaccaaaataacctcctaatcccatcccttgcttatagtcttgtctcctaattaatcccccactttaaagcaagaataatctttcttacaaagtttttctactgaagtatactatacgttcagaggaatgcacaatacatgtgtccaacccattggatgttcacagactgaacacatttgtaaaaccactcaaatcagtaagtaggaaattactagtttcccatagtccccttgtgttttcttctagtcactcctccctaccctcacccctcaaaggtaactactgtcctgatttctagcaccattgattagttttgtgtgtttgagctccatataaatggaattgacagcatgtactctttttgtgcctagcttcttttgttaacagtattatctgagattgtactttatttcacatatcattcattaat

SEQ ID NO: 174613 - DNA, 177 bp, Homo sapiens
ccattcttagatagacagctctctgccttttgacaggcctacgcactcacataaccaccactgcaatcttgaggaagtttccatcacctcaaaaagttgcctcgatctgctttgtagatcccctctccatccccagcccctggcaatcatcgacctgatttctttccctgtagtttt

SEQ ID NO: 174614 - DNA, 1014 bp, Homo sapiens
tgctgggattataggcatgagatcccgtgctgcacaaaggatgcctcttaacagttgtttattctgtctaccaggaaaaggcatatggcccctccctgtgtaggccctctagttctgagagatttgggaaacttcacaggttcaggaatgttcacagcatccccaggatgtgggcttgtggtgggtggcaaatactgaaatagttctctagatcaaggacctgagtgagcagagatgacattaccagctgaacctcccaaagagaatcatgagcagaggcagaaacagcacaggggaccccagctcctgctcacgttcctacccagcagccttcagagccagtgctgcagtgaatacaggctgtctctgagcccgtctgtatacttcatctcacttcatattttattctgtgatcagataccaccttagaaactattatttacccccttctagataattctgttctgcaggaaaaataatgtggctcccacaagagatttctgagcagtccaagcctgcatagcatggtgtgtggcagcgatagaggcagatcaggtgtctccttctgaaatgctgacctgggtgagggacgaggttctcctggagcaatcctctgaacaaggacctgctccagggagaggccaggcttcctctgcacagaggttggagatgggcattgcactggacgctcgtcatttttttcataattgggatgggtaggatttggtgggtgattaatccacagtgatggtagggctggtgctgtagacaggctgtgaagttgaaccctcagtcctgcacgtccagctagccgacctagaggattttcctcacctgtttactaataatgccctgtgtttggtgaggggttggcttaacaattttgtaacctgacagggacttggcccctctgggcaggctctcacttcgctggccccacagctgtggctgaggggtggcccgtaagaagagagttccaggcatcctttgtgcagcacgggatcctctattttc

SEQ ID NO: 174615 - DNA, 501 bp, Homo sapiens
gatcaggtgtctccttctgaaatgctgacctgggtgagggacgaggttctcctggagcaatcctctgaacaaggacctgctccagggagaggccaggcttcctctgcacagaggttggagatgggcattgcactggacgctcgtcatttttttcataattgggatgggtaggatttggtgggtgattaatccacagtgatggtagggctggtgctgtagacaggctgtgaagttgaaccctcagtcctgcacgtccagctagccgacctagaggattttcctcacctgtttactaataatgccctgtgtttggtgaggggttggcttaacaattttgtaacctgacagggacttggcccctctgggcaggctctcacttcgctggccccacagctgtggctgaggggtggcccgtaagaagagagttccaggcatcctttgtgggggcacacaggccacccctgccctgtgcctctatctataattgttgctagatggggt

SEQ ID NO: 174616 - DNA, 705 bp, Homo sapiens
ggacggtctgttacccaagagggcgcttagcactgtttgctgctcacttgcccgaaattagtactggctcaggcagagactgtggaaataggagactagaaaaaatacgttatctcatattcattttcatgtgcaatattttcatgtaagtgatagcttaattttttagcagacttcagatttcaaagttttaatttatctcactgtgctagtttacctcttcagtggagtaaaaataacagcatgaccactggtccctgggggatagttggcagtgtctaaaggcattttttattgtcatcaaaaatgatgacaccatattgtcaccataagaatatggtggtatttagggtgataatggtagagatggagaaaagtcaataaatttggggttcattttggaggtagtattgagagagtctgttgttaggctggatgtaaatgctgctcttctgttcttacttatcacaaagtacagactgctaggaactcagtaagtatttgtggaaaacttcctatattaatggttttccagtgtaataaagttaccgggaaccctttatttgatttgcagtttcagtcttgggaatttttttcttaagttttttgtttgtttcataaacttctagagcaaacagacttagtgtcaaaaactcaaaagtgtaccaacacatatgttagctacttccttagctactgtaacca

SEQ ID NO: 174617 - DNA, 748 bp, Homo sapiens
tcaatgaaagaatttcatttagaaaaaactgcctgtcccatccatgagtattcttaattttaggaaagatgcacagctttatgacactcaggctgatttcccagtttgggaattcttggccctggcttttcccacctgtctttaccttgcagacaaaccaaacaagacaaaatttaatcatgtttgcacaatgtcaaacacttgcatagagactatccccaaagtcagctcatgggtgttttatcttcacagtgccaaataggaaatagctacatatgtttcccattaaaatgagaatttccatgttggtatctggtgttgcattgagcttcaggttagctgcttattcactgatctttggaaggaggctgaagattgaacctcaagagttctagggattatctgcaggttgaaggtgttaaaagtcccaggcacattgtttgttatcgctaactgcggatggcctgaattttaataagcatggtcaactgtgcatatcttgtcatgtgaactaccaattagcacaccataatttagcaagttagtacatgcagatatgaacacccttgggaaggaagcaattttcgaatcagattattactgacagtgtacaatttacatgcaggtaatcattatcagaaagtcatgattatccagaaggaaaagtgatttttgtggtaatatatctttgaatggctgttgatttttaatacctttaaggtaaaaacttcaatttgttccatcccta

SEQ ID NO: 174618 - DNA, 238 bp, Homo sapiens
gagtagctgggattacaggcatgcgtcaccacacctggctgattttttgtatttttagtaaagatggggtttctgcatgttggtcaggcttgtctcagactcccgacctcaggtgatgcacccgcctcagcctcccgaagtgctgggatgacaggcgtgagccaccgcgcccggcagcagttgctaacattttcacacagcttcttgtggagaaggcccctttccactgtgaagtgtg

SEQ ID NO: 174619 - DNA, 504 bp, Homo sapiens
agtccctgtactacagtgtggctagaccctccctgaagaacagataagagccattcacaattagaagcaaccctgcacacagagaccacagctccaagccctaagccacccacactggaatcttgtttatccttggctaagcaaacacaagtcttcttagataatgcaaaggtcaactgtagacttgtatgacctgataaaatcgccaccaaccctgaattacagggtgttcaataataaaatatttctacagagctatgagggagagagagaaatcagaagtgggctattttccatcatcctccattaacaccccactaagacacaggctgagtgatggagttctggattccaggatcacatccctgtccacccactccccagccccctttataaaaagcaagaaccggccgggcacggtggctcacgcctgtaatcccagcactttgggaggccgaggcgggcggatcacgaggtcaggagatcgagaccatcccagctaac

SEQ ID NO: 174620 - DNA, 783 bp, Homo sapiens
catgctgttctagaggatcccccacggtgtcataaagccagaacacagaaagatctattatcaacccagtttaggattcagtggcaatcaatacaacagccccctgagagcctggcgcagctgggactccccagaaattcactgccagctcttaaatatggggtgggggaaagacaaggtggggtaaagtgattctgatcacactccttcaaggtcaaataaataatctcttgaaactggctggatatgcaaaccctaagggaattatgagaataaccctgtccacggttacaatccagcccccagccctgggcgaaaagcccctcactcctctttaccaccagagagatgagaccagaaggccctgattaaacactcaccccttcaggagaacccagagttatagaagggatgtcagtggcgctgagcagtagctttaagtcccagaaaagccttttcttactatgcaaacccactcgtgcctggatgcccactttacatttgtggtggctgcctccaccctggcagaacccattctgagcacagatcccattctgagcaggcacctcatccttgctgtaaccaaaccaccgaggttgtgagtgtaaaatccctgggaccatggaagaccctccattcatctcagaatttctctctgaaggttctcctccaggacagcaagggtccccaaggtctccaaggtcagcacagccatagcctccagttctcctgtttgtcagctgctgtttatgacaccgtgggggatcctctagagcaccatgg

SEQ ID NO: 174621 - DNA, 794 bp, Homo sapiens
  misc_feature (31)..(31): n is a, c, g, or t
agatacgatcgatgctcgcgtaccccacggngtcatgaatgcataaagccagaacacagaaagatctattatcaacccagtttaggattcagtggcaatcaatacaacagccccctgagagcctggcgcagctgggactccccagaaattcactgccagctcttaaatatggggtgggggaaagacaaggtggggtaaagtgattctgatcacactccttcaaggtcaaataaataatctcttgaaactggctggatatgcaaaccctaagggaattatgagaataaccctgtccacggttacaatccagcccccagccctgggcgaaaagcccctcactcctctttaccaccagagagatgagaccagaaggccctgattaaacactcaccccttcaggagaacccagagttatagaagggatgtcagtggcgctgagcagtagctttaagtcccagaaaagccttttcttactatgcaaacccactcgtgcctggatgcccactttacatttgtggtggctgcctccaccctggcagaacccattctgagcacagatcccattctgagcaggcacctcatccttgctgtaaccaaaccaccgaggttgtgagtgtaaaatccctgggaccatggaagaccctccattcatctcagaatttctctctgaaggttctcctccaggacagcaagggtccccaaggtctccaaggtcagcacagccatagcctccagttctcctgtttgtcagctgctgtttatgacaccgtgggggatcctctagagcaccatgg

SEQ ID NO: 174622 - DNA, 173 bp, Homo sapiens
cgaagacattatttaaaaaaatcttcagttctccctggggggcaattggattgacaattgcaattcctttgtaaccaatgggcttctgtgtgagctgttagacgcacactggtattcgttcaagatggaaaaccaaacaacatggacacaacccatgacagccttcaaagttc

SEQ ID NO: 174623 - DNA, 154 bp, Homo sapiens
agcagagtttcctaacctgggtctacagataggctccagggcttctatgaatctcctgaaattgtttgcaaaatggtgcatatgtgcacgcacacacattgttttcctctggtataaaattcttaaatagtctcctgaccccaactaagataag

SEQ ID NO: 174624 - DNA, 436 bp, Homo sapiens
ccctagacttcctgtaccattagcagttcactacctactgcccttcctcccagtccctggcaaccactaatctacttctgtctctatgaattttcccattctggacatttctaaaaatggaattaagcaatatatggccttttgtgcctggctattctcatttataatgttttccagatttattcatgttttaatatgtatcaagcactgtatttcctttttattgccaagtaatattctgttgtatggatataccacattttgattatccatttatcaattaatgaacatttggattgttttcatattttgaccatatgaagaatgctgtgaacattcatgtatacatttttgtatggacatctgttttccgttgtcttgggtaagagcttgaattgctgggttatatgataactttgtgtttagctttttaagg

SEQ ID NO: 174625 - DNA, 144 bp, Homo sapiens
tctcttttgatagtaatacctaaaaacctaaataatatcagaataggaagagttttcagtagttacttgttgattctccaaacaaaggcttattgctttttaccatattccatgtctctcaaaatcaacgccagccaagcttca

SEQ ID NO: 174626 - DNA, 189 bp, Homo sapiens
agttgaaaaagaaaataaattgtttattttaaaaataaaattcagttcctgtttctagagtgttagcattaattaaaagcattccatcattcagatagctatgtgaagtattaagtaatacccctagtatttctgcttttcaacagaactttaaatcgagcaccagctgggcgactcctctacgagtcg

SEQ ID NO: 174627 - DNA, 635 bp, Homo sapiens
cagaaaagaaatagcaggacaatagacttaaatccaaccttatcagtagatttaaatccaaccaggtcaaccatatctatattatgttaaatataagtggattaaatttgtctaattctcccttaacaccatcagtttttgcttcatgtatttggaagctttgttattagttgcaaaaacatttgtgcttgttatgacttcctgatgaattaacacttatcattgtaaaatatctttctttctagtcatacttcctgatgtgtagtttttaaataaacccgctcctgctttcctgtgcttacatatgtatgttatctcatttttcatccttttactattatatttctttatatttaaagtctctattaacagcacataattaggacttaaaaaactaatctgatgatctctggctcttatcagcgtttactgcatttgtacttaatgtaattttaaaaatgttattttaaaaaattgttatatttcagtagctttaggggtacaagtggttttcagttacatgatgaattgtatagcggaagtctgggattttagtgcttctgtcacctgaatagtgtacattgtacctattttcatcctcacctccctctcactcttcctgcttctgagtctct

SEQ ID NO: 174628 - DNA, 731 bp, Homo sapiens
gaaaagagctttggggaggagctgctgacacttcctcctggcactgcttgcccgggagctgggtggaggcagggcagggcagggcagtcccaggttctgccaggaaagtcaccttgggctggggcaggaggcttggagcttctggccgttactgtttgtctgagcaggagggtgagcactgtgtactggtaccatggccccaggtctaggcgagggatggaaataaggacagtgccactagggcctcctgtctgtacaggaggggccctgagacagctcctcaaacccctttcccattatacggatggtgcagatggggacactgaggtacagagagacagtcagttgtcctcagaattggatccagaacctcgtcttctggcatggccccccagtgcagcaccacatgtggcctccgaattcccagtctgggattgggggagctctggtccttgggggaccaccatgctcttttggagttgtcaacttggtaggaaccctctggttccaacgctgtgcctttgcggccctctcctggcatctgctgtccctttaggaggtcctaccacccttttcttctgagcctggacaactccttcccttgcccccaggagcccacagccggctaaaccaactggtcagctagaaccaaccagcaggggaggtgcgctccaggggggcttctaagaggaggcagttttggagtcagaggtgaagtgtggggagtggga

SEQ ID NO: 174629 - DNA, 448 bp, Homo sapiens
acttgatttttttgcggcagtgtgtggtggctttgatgatctgatacaaaccttggttattcatctttctgttcttcccagaccccatttgttttccaaggaaatagcagttcactttaccacatgaagggaaatactgttaggaaagtcttgcagccttgcccgtcattaatcaaatttctccaaacttgaaaacccaagcctaacaagctttaaaattaagtctaaaggaagagtgaataaattggaatcaatttttgatattataaaatcacagtagcaatattggaatgtcattttcatggttgaacattaatgtatttacttgctaacatttcagtgaattataaatatttaaccacttaacatggacaaaacattatggagaatttaaattattataaaatgttttctctcccctaaagaagatttttgtttgagccaagac

SEQ ID NO: 174630 - DNA, 520 bp, Homo sapiens
gacattgtgcagtgtagagttgccttaaagtgcgtgatctgccagtgctttcttcaagtcacccttgccccgattcctcctgtttgcgctccccagggttgctcaagtggaaattttgtcagctgtttagccttttcgtacttggcgtgatgtcaacttcacttctaatctgcaaaagcagaagctgtttcctagtttacctcgcgtgtgtttacctatatggagtagctcgcagagatcacagaaaatgcttgcagcctaaggcagggttttcagaccgtgggtcccagcccatttagtaaaatgggaaatcaattagcaagtggtcaccagcattacacagcaatgaagcagaataaagtaggccagaatgcatcatgtagtaaaggcaaatactgttttgtgaaacttttcacccatacatctaaatgtgagaactggttgcaatgtaagacatttcttgctgggaagttgtgagcaaaataagttgaaaacactaataaagaaaagtctgtctgag

SEQ ID NO: 174631 - DNA, 365 bp, Homo sapiens
ctgggaagtttttttaaaaaaaataccagtgcctggatccaatcccagaccagttaaattagaatctctgggtgggcttagctgctttattttttgttgttaaaaacaaaacaaaacaaaaaaacatctatacaggtgattctaatgaatccctgttttgggatcccctgtatccaggcttgagaatcacattctaggcagataaaccttcttaacaaataaaaagtaagtattttgctcttctcatattgttgaaaaaaccaggagattggttcatcttgaggaagggaggttttggtgggggtgagaatagctgctgcagattgttctgtgttaaatgtactttaaagcacttggataaaatt

SEQ ID NO: 174632 - DNA, 950 bp, Homo sapiens
tattgtgtatgccatggctttgattctcatcaccttgtaacatatttgaagggatataagctgccagatattccagcattgctaaatgagtcctggaaatatcaaagccaggtatcaaaagccagctatattttgttcgccagtgaaatttctttagcagcggcaaacatatcccatctgctgtgcctgtctcaagccagtagcggaacctcaagtactctccacattgcatttaatctttatctttctatcattatgaccctccgtgttgggagatattttcactttacatcataataataaaataaaaggacactactaattgtgtatggtgagtctagctgattagggtgtgtgttaattagtttgaggtcacaggcttatccttggagaaaccagttagctcttacaggcaggaagccaaggttctgaagtctaaccgatctggttaaaactgtacagagtaggattcagaaaactttgtatttaatcaacctatgccaaagtctgagttctatgttttatttctatcaccttcccacttaaacctgctgtacgtctggtaatttgtcttgttaatagcaccattatccaaccacccagaccagaaacatgggacacatcctagactcttttcactctcttctgccccacgtgtaattatccttcatgcagttaaattctaactcttaaatacttcagctcattcctacattgcctccttagtcctctttcatcatatgtctcttgtgcagttctaataactatacatggctgttcatagaataatattgataaatatcctaatatttagcagttgaatggtttttctctacctgtccactgccaaaaataaataagtaaatcattcttctataccactacaactggagtgacctttataaaggcaagtctggactttgttgtaaattcactggtgtttcctactg

SEQ ID NO: 174633 - DNA, 286 bp, Homo sapiens
catggttcagttttgttttcttctgctaaaatgggatcataccacctgtattactgtgtgattcatttaatatttctaggcaatcttttaatgtcagtacacatagatttacctcattcattttcagccgttccacagaattccacaagacagacatgatttacttaaccactcaccatctaatgaatattgtttcctaatttgtcatcatcacaaataatgctgctgctctaaggaacactcttatatatgtaaataagcatttacagagtttataaaaattggc

SEQ ID NO: 174634 - DNA, 201 bp, Homo sapiens
gttccgagggataaagagagtaggagcatttaataataaaaagtgtgtaatataaggtgaacttataatcgtttggtcattaagaatcacttaactgagttttaatggacacctatataacatacttctaggaagaacaagtgaagttaagtgttctttgagaagaatttaaaagcatctatatagatcaatactttacta

SEQ ID NO: 174635 - DNA, 575 bp, Homo sapiens
gagatggtttggggatgattcaaatgcattacatttgaatcaactagatggccccatctggaagtgatgggagatagtgacggatcatcagtcagtagattctcataaggagtgcacaacctagatccttcgcatgtgcagttcacgatagggtttgcactcctatgagaatctatgccgcagctgatctcagaggaagcagagctcacatggtaaggagaggaatggggatgaccactattggtctgtggcccaggggttggggacctctgttctatataacagagtctaggggaaccactaaataagtctatgcatactatgtgaactaaagtaaaaatgacaacatccctgagccttattagtttcttacttgatgtgatcagggtgattttaagaattaaatgagaaaagacatgaaaagtcctgagcacagtgttaggcacaaaagagatataacacttctgaaatctaacttcaggactcaagactgctactaagtagtagcaaaagaagagaatcacatacttgcagtcatgtggattttggagccatagtcttacttttagtaaact

SEQ ID NO: 174636 - DNA, 388 bp, Homo sapiens
tttttgtattttttgtattgagaccaggtcttgaactcctggtctcaagcagtccccccacctcggcctcccaaagtgctgggataacaggcgtgagccactgcgcctgatccacacaccatagtttttaaaatgttattttactcacaagagggctttggaaaggaagatcctgcccagcagagcctacatgcgcagacaggacagaggacccttaaggatcaatggtcttgttgccggaaatggatgtctggcgcaacccccggagctagttttggggaggccgccttgttgactgtgcactggaaaatgcacattgctttatcgtgagctctcggtgcacagtgtggtttccaggctctgagtggccaataaagctggtgctgtc

SEQ ID NO: 174637 - DNA, 444 bp, Homo sapiens
gttgtcctgcagaatgttgatctccaaatatttcctttagcacatttttcctgcattaggtttatcattgaacagggagaacatagggcttctgttatgatagaggagtgcagtgttcccatgaaccactcactggtaactatacaaacttaagatttttttttaaagagctattttaaaacacttgggccatatccaaaaggagacaaagccagaggatatagtttaatccccaaaactgcaattagaagggaaaagtattgctagtttatggtttcctgggccaagggtgctatccaactcccattgctgtggctccagagagagacagggcagaggaaccgaagggctcctggctaaaggtgctagaaatcagaattcaaggctgggaaggcagctggaaaattaaaggggaaatcatagcagcacgatagcagcacaaga

SEQ ID NO: 174638 - DNA, 538 bp, Homo sapiens
atcacacagcgaagcagtagttaggctaggatttaaacccaggcattttggctctggagtctggcctcttagcctccatgccattaacagagtccctctgtgttgagtagatgtggctctgttgatactttggtctgcaggactgtaggaaatgcttagtaaatgctgagtcagccagaagcggtggtgaaaggagcagccaagtactcatcaggagggaattcaaaaaaacggatgcatttaacggctgccttggatatggtcagcattggttctctaacgcaggtgatacctcggtgcttgtcagcagggcattaagaaaaggctttatcactggtgatttccaagtattcagtaaaggcaaaggcccttgggatctgtgttaattctgctaggagatcggggtcggggcaacgcatgagattgagaaatccaagataaacctttgctttgagaacaatttggggatccatttaattgtatctggttgatataaggccagaagttgccacagggctattaaactgaataaaaaatc

SEQ ID NO: 174639 - DNA, 424 bp, Homo sapiens
tgggagctcagattgtagtaggttgaatatgctcaaaagcatgctgaagcctgccacctaacttgtggaaaaaagctggcacttgcttcaagttggttgtaataacacaacaaaaatctcataaagcctggaatttaaaaatgaatattctctattttatatgacatagtaaagacttacaaataggtaagtcgtcgatgattacactagtaaatagatatttgaacatatacttgcacattcagtgaaagttcatcttcagtctttctgttttgaattggagttgtaactatgctgttggtctctgatgctactggggaagccggagagattgtattgtatgggtgttagaagttcagtagacctaggccaggcgtggtggctcaaacctgtaatcccagcactttgggaggctgaggcgggc

SEQ ID NO: 174640 - DNA, 474 bp, Homo sapiens
ggcagagccagaatgggtattggttaaaaagatgagactaacttctcacctacaatgttctgttcttaagataattattcatataatttcaaaatatgtatacaggaaaaaaaaagactagctgtaaatatgactgaaaggttcatagtgcttcattctgggattcgggagatgagcaattcttattctctccttttatctttctcctaggaaggaagaaaagaagggagggagggacttatgcaattgttatcatcccttgacattgctgacctgaaatccaccagtgctcctgggacttatcagatcatgggtttcaaaagagtgaggaacagccaggagctttccagcatgctttcatatctctgggtacctaataaccaaatcatggtttctctgcaccatgcctggcagacttgaggctgcctgcccagctgacaaaaccctgtttctctgggaaccaagcacactcca

SEQ ID NO: 174641 - DNA, 377 bp, Homo sapiens
tattttgtactggctcctattgaagttcataatgattctgtaggagagatggaaagaagtccctgggctttctgctttgcctaaaattggttgatttccttgtatagagtagatagatttttcatctctggcaaaatgttgccactgtatatcccttttcctcttggatttgatcttagagtcacgtctaaaatagtttctactttaactttttgggaatttgactgtggcatcacttaagaacttatttgcaagaacgctagagacccacccagacatgagttgtgttgattactttatatgtgaccattttcattgttctagttctcttattcttgattgtaggtgaaatcgccatgcttggtggtgtgggagaa

SEQ ID NO: 174642 - DNA, 268 bp, Homo sapiens
attctttacttttctacattatctgcacaaacagcaagattctctgttttactatgaaaacctatggtttctgccaacttattatgtccttgattatttaaggaacaagtttctccttcaggaaagtttcttgacgatcatgttaccacttatgtttactttcaaaatatttattgtcacttgggttaaatataaagtcatctattatttcttggtaacccacgatcctatcttaattgaagttttcaaatctcctggcaacttttaa

SEQ ID NO: 174643 - DNA, 414 bp, Homo sapiens
gtcacttgtgataagagctgggcatctgcttccaaaggctctgcagcatcaaatactctgcattgcaaaaccagtggaccacctcgcctagacaagggctcctttagctacccctggactggtttgttcactttttcttctatctgttttgccctttgatgttaaatgttactttgtttgttgtagaatgtttagcctataacattcatatattgattaagtatactatgatgtatggtgtgcaatactgactggcttgtggggtgacttgagcctgtgtgctcaggactatgtgcccgtgactccctagtgcatgggaagtgtgatggagaattgccttcttgggaactccatgtagctcatggcttttgtgattgaaataccttcaataaaagcctgacattgtggaaagac

SEQ ID NO: 174644 - DNA, 173 bp, Homo sapiens
taactcatctcccagttgctaaaggttagtgttcttggtccagtcctcacaatgcttgtctaactattcaattcctttaggaatctcttccagtccagactctaaatgccatttctatataaagacttcaaaaatttgaaatgtaggttggaccactctccatggaactccac

SEQ ID NO: 174645 - DNA, 470 bp, Homo sapiens
gacgactgcccatctcacctctacctatctaaattcatgcctatctcaaaccatggcactgagaggagaggagaggcatgaaatgaatctctgagaactcttcatcgtaaagttagccttaacaaagacaggccagtcatcctggacaagaaacaaatcatttctggatgaaaccaacttcaatttaatgctccaatgatctctacagataaagttccaagaaatattgagtccatagtaaaaaaatcatgaggcacataagaatcaaagaatcacgagaaagctagcaaaaatgacagtgacaacaaatatatgtattagatattggaattcaaataattagattatcagaataatctaccatagaataaaaaacaggtgtgttaaaaatgtttaaaagttgggcatggtggccaggcgtggtggctcacgcctgtaatcccaccactttgggaggcagaagcaggaag

SEQ ID NO: 174646 - DNA, 241 bp, Homo sapiens
attagccaagtgtggtggcacatgcctgtaatcccagctactcaggaggctgaggcaggacaatcacttgaaccagggaggcagaggttgcagtgagcccagatcaggccgctgcactccagcctgggcaatagaggcagactctgtctcaaaagaaaacaaaaaaccacacacagacgcaattaattatttgggctggacaaagggctcatgctcttgatcccagcacttcgggaggctg

SEQ ID NO: 174647 - DNA, 220 bp, Homo sapiens
ttgactggtcgatctctagcaggatccccgtcatcaaccctctacctgcctggcacctcttctgtccgtctgacctgcaaagcagccagactcatgtccactctgtcttcgcttatgctattaccacatggtctctcagcccacccagatctttctagagccagttcacatttggcctccccagcaactagactcaggggcgctttgtattgttacttaa

SEQ ID NO: 174648 - DNA, 176 bp, Homo sapiens
ccgtaggtaaaataataaagcagctcttggatgattgtcagttttttatatttataaccctctctaggcactttttacccaaaatagtggaaacaaggttgtgtgtccataaaactatgttttacttactcagcaggtgcataaaaggttgtgaagtgagctcttcagccagatct

SEQ ID NO: 174649 - DNA, 561 bp, Homo sapiens
ggttcacgccattctcctgcctcaacctcccaagtagctgggattacaggcgcccgccaccacgcccagctatttttttttggtatttttttagtagagatggggtttcctcctgttagccaggatggtctcgatctcctgatcttgtgatccacccgcctcggcctcccaaagtgtgataattcctatttcttaagaataaatgagattacagattgagctaggtgattactcaacacattttatgaaagagaataagcacaatatagaaatttcacaggggtagtgtattagttattgttgcataacaaggttttccaaaatgtagtggcttaaaacaacaaactgattatcacaagtttctgtgggatgaggcttaactgggtgcttttggctaaaggtctgtgttgaggttgcagacaaaagctgtcagctggggctacattttaatctgaagactgggagtgtgggggttatatataaactcattcactggcttttttcttgcagcataatgttgtggaagttcatccatgatgtatcatctattagtatttgttc

SEQ ID NO: 174650 - DNA, 328 bp, Homo sapiens
tcaagggacaagacttataaatgcaatggaaactgtctcaagaaacaaaactttattccagtggtctctttggggaaacatgtacacagctattcagcaaattcactgtcaccttcattgcaactgaagagaataaatactcaagtatgtgtcttagaaagaactggtcagtccatgcttactaacttatgtaattctgcaataatctaacttcatttcttctttggacagcctcaaaaaaggtgaagaagagttcattactactctccataaaacactgcttcatataattttcaactgtttaaattggtccttggtctttattttc

SEQ ID NO: 174651 - DNA, 747 bp, Homo sapiens
cagttaatggattagggcccaccctaattcagtatgacttcgtcttaaacttgagtgcatctacaaagactctatttccaaatgagatcaccttctgaggttcccagtgggcatgaatttatgggcaacactatgttaccaaatacagtcgctaactgagatgaatttaggattcacactgaaggtggtacataagattttatggatccttgaggtatggtgggataagaatccggtttggaacatggtttcaatagcacagaatatatctatactcaccctcctttcccccagactcaaattatagtgagtttgaaattattatatcagagacagtaagttaagtcacactggtgacattttgtgtgaattcagagcagagatgaagaggagttgttatctgggggaaattgtggaggacgtgttcctcatgctcgccctaaaactggtgcagaggcagcatgccctgtagtggtgtgctcacttggtgctcacgtgtgcttggagtacacctattaaaatagaaagtcaaacagatttttaaattggttggtaacactcagcatctcttagaggatagagaggaagcagctggggggaactattacttgaaattagagtactttccaaaatgacagagttgatgggtggagtgaaagtgacagatcttgagagaaaatgagctgatgagcctagtacaggaaacctgaacttggtcaaatgtttatagactagaagagtgtcaaa

SEQ ID NO: 174652 - DNA, 277 bp, Homo sapiens
taggagggtcaggcaccatcgctcatgcctgtaatcctagcactttgggaggccaagcaggaggattgctttgaggccaagagttcaagaccaacctggctaacagagcaagaccctgtctcttaaaataaaaaaaaaagaatatctttatgatttagagggagaaacatctcttaagatacaagaattatttactatagagaaaactattgatatatatatattttttaaattttattttaagttctgggatacatgtgcagaatgtgcaggtttg

SEQ ID NO: 174653 - DNA, 322 bp, Homo sapiens
ccaatatggtgaaaccctgtatctactaaaatacaaaaaattagccgggcgtggtggtaggcgcctgtagtcccagctacttgggaggctgaggcaggagaatggcttgaacctgggaggcggaggttgcagtgagctgagatcacgccactgcactccagcctggcaacagagtgagacttcgtctcaaaacaacaacagcaacaacaaaatcacaatcacagaagccggaaagtgttttctgagccccaggaacatcaggcggtcttaccctgttaggatgctggtcaagtctttcgtggtatgccttcatctgacctcc

SEQ ID NO: 174654 - DNA, 426 bp, Homo sapiens
taggattgcagacatgagtcaccccacctggcctccatgtttactttttaaaataagctgtttatcttggaatatggcagataagaagccaccttacaagactgctcacaaaattcctgtgaaacaacccctcattactgctcttgagacattttatagctttatgcactcaggcactgtgagattaaatggcttgccgagaactggataatgaagagatgagagagtccagagaggattgtttctgtttcctgtttgtagacacccactcattaacccaacaggaatttatcagtgtttttattttttacaggagcgtacaggaagggtatttgtttctgttcccacagcattttgtagaaatctcttgatgtacttaacactttttacaggaatttcttgtctgaatcttcttgtctgtctccc

SEQ ID NO: 174655 - DNA, 537 bp, Homo sapiens
cctcttgatttcttatagccaaagctcaagcccagcatctttttttttctttctttttttttttttttctgacagtctcactctatcgcccagactggatgagagactgtttcaaaaaaaattaggcgggcatggtgatgtgtgtctgtggtaccagctactcaggcggctgagctggttacatagcattcagtcacttacacagcactgccacatccttgtgatctgcactgtggttgatgtttttattatcatctcttccaccctcccatttttcagaaaaggacctgagttccagagagtgctttacccaaggtcacacaagtcatcactggaaactctgtcaaaacccagctgttctgaatactcagtgatgcatttactttatttttttgagacagagtgagactctgtctccaaaaaaaaaagaaaaaaatcaagaggcaagaatgctttggtgattctgctctggtgggtttgagaaggaggcagaatgatcttttctgaaagcggtgtcagggagttgttacgacctgg

SEQ ID NO: 174656 - DNA, 267 bp, Homo sapiens
tcttagtactagagataaattactatttgattgtatttatcagtatacttagaattcctactcatttttttctgtggaaaaaaattaaagacttgctaccaagattagggctataaacttaaaattttaagattatgcaatatcacaagtgtttttctttccataacctcaactcccacaaatccaaactaaacttataacaaaaatgccataagaaggttcaaccactgggcatggaacctctactgccaccataccgctaaagga

SEQ ID NO: 174657 - DNA, 402 bp, Homo sapiens
gaggtttacaggaactgagtggcttcctcagagtgtgacttctacagtgagtgaccagggggcgagggtccagacaactcagggcacaccccactccaccccgccccatcctaccccttcctggcttccatatcgagccacacaacatccagcaccttctccatgtctttatggtgttgatatctcactaaagctggtgagagaaaagctctttccaaaggaaggtgctagatgaatcttttggaaggtatgggaacaaaccttggtttctgcgtatctgactctgaggaccagctaagcctcatgtttggaaagcagaacagaaacaatgtgcagactggcattacctcagagcacacttgcccacttggagtccttctgtaggccatggacctgtgcttt

SEQ ID NO: 174658 - DNA, 481 bp, Homo sapiens
acgcgagtctccatacccttggtaacacaggtcaggtggagaagttgttgcaagtcgtgatggacgaagttgttgcgcaacaacttcgtccataaagacctcaacgcgaagaaccaccagttcatctagtccactgacaccagaagcctgggtcatgctcgcacctatgctatcttcttttttttctttgagacagtcttgctctgtcacccagtctcgagtgcaatggcgcaatctttgctcactgcaacctctgccgcctgggttcaagtgattcttctgcctcagcctcccgagtagctgggattacagatgcctgccactgcgcccagctaatttttctatttttagtagagacggggtttcgccatcttggccaggctggtcttgaactcctgacctcgtgatccacccgcctcggccttccaaagtgctgggaatatgggtgtgagccaccgtgtccggcctaccggcctaggct

SEQ ID NO: 174659 - DNA, 234 bp, Homo sapiens
agtcagggccaacactccttggttcctctggctccctggaaagggaaagtcaccaagaggcagctgcaggcagcaaagagaataagcaggagaacctcaaagccacaaagggacagcacacagcatcttccctgtttagcctggacttgagaatgctgtccccagcagtaagctgctcaacctcaaagcaacttgcacgggggtttacaaaaaaatgcacttggccgggcacgg

SEQ ID NO: 174660 - DNA, 554 bp, Homo sapiens
tatattgtctatgactccatttgtgctacagcaacaggcttgaatagttggaacaaaaaccatgttattgacaaagtcaaatatttatggtcaggccctttacaaaaaagctttgccaactcttgttctctgttttattatgaacattaattatattaaatgtgaataaattaaacattctaagtacttaaagtgcacacgcatacacacacacaaaaccaactatgtgaacaacaatgtggttcaaaatgaaaaggatagaaaaagttacaccatgaaaatattaattaaaagaaagcaaacataggcctagtgatatgaaatgaaatagatttaactaagaaatattactatagataaataagtgaaggagttaaatccgtggtaaattttgatacttctatacccaacttcaagcttcaaaatgtacaaaagaaaaaagtgacaaaactaaaagtaaaaaagaagcaaatatacacttttaagggagaattctttcaccatggagaataagcaagaataagcaaagaaaaaaataaaaggttctaaacagc

SEQ ID NO: 174661 - DNA, 327 bp, Homo sapiens
actctgaacaatgttgcagtgattatcctcatacacatcaattctcttgtgtacaagtaaatctatagaataaattcctataagaattgttaaaggttaaaatttttaaatccaccaaatttggtgggtatttccgctattcataaagataatacatgtttatactcctaatgacaacatatgagtgccacttttatagcttgtcagcagtgtcttatatgctttgatccttgcaaatctgagaggtgaaaatattttattataattttaatttgcctttctcttatcaggagtgtgatttagcatgtttcaacattttcagcaacc

SEQ ID NO: 174662 - DNA, 847 bp, Homo sapiens
ctccacggagctatgaggagccagggaaagaacgccgtgtttcctgaaatgaggctcgcataccagtcccagccagaggcaacgcgacacgaacttcacacggagcttaaaataaccttgaataacgcagtgagaaagtcattcctttttcagttctcctgacgactgtcaaggagagaggctcagccgggtgctagaatatttttgaatgcctaaccctttgctactcttttgaacaagaaaagcaggcctcgggctcaaaaaatggagctggcaacagccatctagcgagtagggaaacacctttgtttgcttttcattgtctttggcttctgtgtggcttgtttcttcctctctgtgccaaatggaacaggtttccatttggaaagtttccacatataaaactttcccccacctaaagaaatgcacaagtctctcttgctttctaaaggtgattggcacctgagtaagtaacaggggtttggagaatgagaaattcatttgaaaatgtagggtcgggtatgatggcccatgcctgtaatcctagcactttgggaggctggggccagaggatcacctgaacccaggagttcgagaccagctgtgcaatatagtcagaccctgtctctaaaaataaataaataaataaaataaaataaaataaaattagccaggtgtggcagcatgtgcttaggaggctgaggcaggaggatcacttcagcctgggagatcaaggctgcagtgatgcagagagctgtgaccacgccactgcactacgacgtgcacttacagacgtgagacatatgttcggacacacaagatatcagtaagtgcaaagtttctgcta

SEQ ID NO: 174663 - DNA, 157 bp, Homo sapiens
ctgaatcatgtgtactgagctgggaggaggctgagatcacccagggatgattccagagtgtggggcaggatttggagacagagccctggccttccaaataggccctggatatgagaaagaggggagcccagagagagacttgggaaggggcagccag

SEQ ID NO: 174664 - DNA, 467 bp, Homo sapiens
aaaataaagaataccatctacagccatatgtctggaataattcaggcacagccctgtctgacaccagggggagaatatgctagataatctaaactctctcctagtccctaaactctgaaactggaatcaaagccactggcttgcagtcagatttccttttgtctattttcactctgagcctggaaaggaggtgatatggcaaggatgacccaacaccccatttggactcctaactgatatctcagtatcaggaaaagcttttctctgtatactgtttcacacctccaaaacacagtcaattcacagaccacttaaaacggaagataatgcaaatacctggctctaatggacgctaggaggttccttgccttactctctacaactgcctgctttcctaatcatgtcttggcctatgctcagaattgcacaccacctgaaaaaaattatgccaagagctaaaactataa

SEQ ID NO: 174665 - DNA, 447 bp, Homo sapiens
atattttttctgccccctcctctttctcttctgatacgtgaaaatcctctttgctcaccctggctccagtgtgctgcaccaggaaggcttgtggactgacagctgcctgccatgaggttgagggtggaagatggtagctgctacaatgtgaaagctgaacttgaccatgattttctgaaatttaccagagactttgcccctggatgctacaagtgttcttctatactcagagttccaaaatagttgtctcacacagttccttacacaattaattcaattgttttggtgaaggcacaatttcctggagctttctactctgccatctaccctgataccattccaataacaactaatatttactgagtacttagtctgtgccaagtattgttctaacacttttcatcttcatattggccctataaagaagtgtattacgaagatctccat

SEQ ID NO: 174666 - DNA, 316 bp, Homo sapiens
tgtgctctgattactgactgcttctgatgatagacatgcagatacccagacaagcagtcattattgcaaccaccatgagttgaaacagcttccaggagatttaaagggttacagcctattttcctctcttttatttttcccccttttcccttttgggagccagacattcaaaagcaactgtatatatgggacaatgtagaaaatcagcaggcatgcccagggaaaagcagaggctcagaaaaggcctaggaagatgttaagcttacatgtaaggctgattcttggtaaagagatagccaacaaccatcaaaaaata

SEQ ID NO: 174667 - DNA, 407 bp, Homo sapiens
tgtatggatcgtcactgtgaattggggcaggaggagcagggtatttatgtgtttttgcttatggaaatgcactccagagttctgctttttcctctgcttgaatcacttgtcaccatctctggatttgtttttattttaattacttggattagaattcccactgcatgtaagtagaatgacacaggttttgggttttaccttctctctttctttctctctccctatctttctttctttctttcctgggacccagacagaggtcaagcttcttcatgcccagggctggtgaacagtgtttctagtgcccaccttgtagtcaggatggtatttgttgagttaatccctgcctcacaagggtctggagcctgaagacatcaccctgcacaaacgttaaacccccggcccca

SEQ ID NO: 174668 - DNA, 447 bp, Homo sapiens
tcaggatatttcaaaagagacctcacaatgatatgcagatgcccatggcagaaattcatcctggattatacttacgaaatcttgataacttgttttttagtcacatccactgttttctgcaaaggtttttgttgaaatccagctaatatatttcagtcagtcttgatatcaatcagttgttcttacaaactcattgcaaaatttaatacttttatatgttgaatttaataaatgggttcaagacccctgaaatacttcattttgggagattttaaaacaagttttgatgttctgttttgagtgtgtgcagataaggagattttagagatgacatccttacattgaaattggcaacattatcacataatggtagaaatgatttccaagtgcctgttttaaaagaacaatggctttcttacccattaaaaaaaattctactttcaccat
